United States Patent 11,549,145 (METHODS AND COMPOSITIONS FOR INHIBITING AND TREATING NEUROLOGICAL CONDITIONS) - sequence listing, part 25

SEQ ID NO: 262 - DNA, 924756 bp, Homo sapiens
ttttatggtatcaagttaaaaactctttaatatctcaaaatatcttatcagattgaattatatccaatatcaatttgatggctatattcaacacatattaagaacctactgtgtaccaggcatagttttaagtgctagtgatatattggtaagcaaagaccttgctctcatggagctgtggtctggtgggagagacagataacaaaaacaaacacgtatataaatctgtgagaagtgttataaagaaaattgagcagggttatgagaataaagctacagaatgggggatatctcacacaggatggttagcaatggctctgcggctccaggccctgcctactctctcacttttcctcagtttctccagatgtctcaagctcatttatgcctcaagatctttgcaaatgtttcttgtctggatccccttcctcttcctgtcaactttttccctagttacctcttacaatccttcagaactcagatgcaaatcactttctcaaggcctcaaggaagccttctgtggccctccggaacagatcaagttcaggttcctgcttatttaccccactgagctccttcattgtactgatcacatatataattatatgagtattgtttaagcctttgtcccctccagactgtaagctccatgaaagcaaacactgtgtctcattaacttattgttgagtccttaaaactttgtagtttgcggagtaggtaaccaaaaataattgtcaagtatctgaataattttcaatatcccagaatattcaattaagtaagtatggaaggcccctttcaaagcttgcttagaaaacaccatgcttaatcttataggccatctaagtaattttggtaatttttaatgtagcaaaattactcaagttggctttatttggttatgaatatcagtactaacttatgatgtcactatcctttcatttcaaccacgttcagtatcctaagagacatgctgattgaactataatttaaaatgaataatcttttatttgtaaaagattgagtcataaataggcagaatcaacccatgcttttattttcattgcatataaaaatttcatatgaaggtattgatgtacagtactatccccgtgggctgtaagagaggctaagaaaccactaaaagaataatcatttgtaattctcacacacaatttaccactctgaaaatatatccaaagaaataaaaacaactcaaatcagttaaggatgtttttgtaattatagtgtcccctttgtactgtttaaaacaaaagtaatcaaattcctttgggccagggctgctaaaatctacagtttgtgtcaaaaaataaaataaaataaaataaaataggctcatttttcctagaaaaagaatctttcctttcactgaaaagccacatgattcaagggctgggcaagtactgggaggatgtttccatataatccattataaatgtttcctgctttaggggctggccattgtacaaggtgaaattttaaaattctaaagcaatgaaagttttgcagaaacaaatcttagaggatagtgaatgctttctgctatgtaaactgacatcaacccacctttgcgtttaaatagatgggtttacatatatgtaaggacatttggtttatcttagtggaagaaaaattttaggattaaaaaacagtattttctctttaatgtattctcttaacatgtcaggaagctgatgaatagataaccaacacgagtaaactctggctccaatttcaaatcaagtccattttcctatgagctctagaagccaaaaggacttaaaaaaaagaaaaagattgtttataatcactgggaaagaatatatttccccagttgtgtttccgagttaaaaaaaaaaaaaaaggaaataatcaaatgcaagtagctgaagtagttcctgatcaacagatggcaaacaaccatcacacatgcagtgctgctccctggcaagaagtacttaagagcttctgtctcaaaagggtctcagaatctttcagaggttgtctgtggttttgtaaaatccacctattggcagaattctaatcaattaaaagcctggatgtaaaatgcccagccctagctccactgttacctttcaaatgcagcaaaacagaagaaaatattggttaaagttaaggcacagccctgggaccaaagacctgcagctatgtttttttaaatttatatatctttaagtattttatagttttcttgaatcttccataaacaagctctaaggtgacaagactatattacaggagaaaagaaaaatgtacagagtatgtatacacaccattcattctctcaccaagagtttccaaatatatcaacaccatcccatcatgggatgatgttttaataagaacagataatttacaattaacattacagtatgtacattgcaataaatacatggttgtaaacagacaaacaagactgtattacaggtaaggtcatttggtgagaaaaaaaatgcatggcacaaaaaataaataatgcattcaaaaattatcataaagctttctgtaaaatccatttcattcaagttttttctttccttgtctgtaatttgttctatctacattattgtgaattttaactgatataaaacaaaattaaaacagcattattgtgttcagtaacttgcaagctgaaatgcactggttttacacaaacttggacatttttttccccatacagtacccagatattgcattttcttatggcattttaggaaatgtaaagccacttgtaaaaggatattcttttattcttttttaaagcagtatatatttctgaagcacactttggcaagagagaagggcaaggataagcagattgtacagtgcattagtccctgtctcttggatattgagccttttctgcaatttgattgtccattagtgggtatctttacaacacggtaccattaaaaaccaacaaactggaagaaaaaaaaagagcctctctttattagtgcagttataaaccctttaccctttcaggtctggatttgttaatgacatattgctgctttttattttattcattattaagattctaggcactctgtgggggaaatactaagtgtagggaggagaggaatgagaatgttttggaaagaggaataaactctagactctttacctttctttctagacttcactcagggacaaataaaattaaaagaaacaagttcccaaatattcttgtgaaactacttggtcaaacatacgtctttatttttttcttatttgaaagattaccatctgatctttacagaggaaacagagtagaaaccttgcaattaactagttgattcctcttctgctttatgtaaaagatcagagttataaagacataatttttatttcaaaggatctaagcatcagctagatctcaggggactgaaatggggactctcttcagcatgagtcatttgcctggctgatgacttactttccagtccccaggaggctccttgagaagttccacatataaatgcttttcagagttgtaattcttcttaaacgtttgattttccacttgtcagatacccactttggcttctatctatctcaattcttgaatatcaatgtgaaaaatgattatttgggctttaaagtcttcatagagaaggtaaagaagactttattaaggctgacgtggggataaagtcagaattaaatgccccatgatgccaactgctataatcaggtaaacactaggaattaatctctaaaactgtaatacagttcctggtgctgaaatcagccaagagtgatctctaattttttatttaaccagaatttttaccaatataataaatattttaggatgcatcacagtactaaccctctggtgccagtggcatcatcttctttccctccatgtgtttaaagaagtagttcccctctgcaagatatgcttatggatcgaggataagtgataaaggacttcctacacgttatgtggctgtccattaaggaagagtagttgctacacttaaaaccgtttctcagggatgttcctgatatagttcttaatcccatggtgaaatcattaaaaccaaataggattagttgtattggtgtttgttaatatattgttaatattcttaaaaactgcctagttggctgtttaacttttctctgtaaaccaagagtaaaagctagtcatgatatacaacctcgtggttgaaatgaatgttaaccctaacttaactacctgtttcttttcaccggtgacaatggtagtgatatatttgacaagacctcatctagcaaacatggataaggttcagacacacgctaaattataaagcagcacaaggggaaaaacctttttcttactataactggctgtaaaaacaataaaaatgagcatgaaatgtgtggattattagagcatgaaatgtgtggattattagaaagacatgcacttgtgaaatgaacatctagtgacacagcaaaacgttattaggagatactaagtaggaaaacatctaaaaaagactgaccattttagctactgggtatttatatatctcccacttgcttcagacaacacgaactgatgactgagtttgcatgaagcttaagacacatttgatataacacacataaaagtattatagaacaaatagtcactttgcacatgaagaaaaacactggtgaagagcaactctgcttatctggaaagagtgaaacaaaatgcaaagtaaataataaagacttacaaaaagggtttcctgcaacataaagttgtttttctcttttaaaatatggaagtcattggtatataaaacaaacaatgaatcactacaaatcagttaattgctatgaactataaggtgcaagtaaaattcataaattagatttttatccagtgtagcacagatttgtactgaaaacttgcaagttactccttagaaaaaaataaccagtggcagatgaagttctgaacatagttttttttaaatataatacctcaatacatttaataataaaagtaagctctacaaaaaatctgttttacatatcatacaaaatgtagaggtcagtgcagctcactgaaccacactattcagtcatgtatcaggaagacttgaaattagaaaattatgcaatttctgtggctcatcctcctcctactggtaacagattcgtgctatgtcctgttcttgacatatttgttgcttcgtccattaagttcactctgtgcaatgcctttcttctgaaaatattgcaaacaaataaaaaggaatagaaaccccaagtccaataaacttttgggctgcctgatgagtcacactctcttgaaaataatttggagtagattttatctgctttgtcagctctaccaagctgaaatcttgttaaaaacgctgttcgtgaagatgtccaccttgctcggatgacatggaggtgaaaaaactggttacgatattcctgagcgctggactgagtagtcaaggtcagttttgttcaacaaacgtcctggcagatgacagtgaggtgtgaccgtggttgtggcatgtgacatgcactttggaaacaatttttctacttaaaaaaaaaaaaggcatgaaagtttttgcactgttacgtgtcaggagaacgatcatctatgacacaggcttcaggctggctttcctcttcttcccctactgcctcctcttcaacctgttcatcaaggggaatttcagtagactctgagtcttgagtacaaagagtcttggagtcactgcagctagtgtcttcttccacttgactgccactgtccttttccgtgtctgactcaccatcttcctctaaagttagttcaaactggaatttctcagtttgaccctgccggccctcctctgggtcatcaggtgcaggagaggggctctgagggattgtgctctggtaccattcacgattgtcctccaaagtgtccaaaatatcctgggcgtcagggtggacgaggtctgcccatgtctcccagaggggatgaacaatatagtctatgaagcccacctagttaagaaaaaaatccagtatgagtagaggacttgggactaagaaacaatggaaaagcttaattagatcatggcccacaaataaaacactgaacagaagactactaaacttagtttggtaaaattgtcactattttcaacaacaacagaccatttaaagtaaagtattgctactagctggtcaaaattagcttctagaacctttggttaaagagcatgttctatagcataaaaaattttccagttgttgacatggtagggcttattttacaatcaccaatttgtaggtgaatccagataactgaaataatgccatgtgctctatgtatatgaatatattaaatgaatatagtcataataaatgaatatgtctttagaatatatatatgactatatgaatgtaagtcataagaatgaaagttctttggatcataaatactaaggtgaaattgagcttgtcaaaaacaaagtaattttaaaaatccagtaaaatactatcatatgtaatacaaagtaaccaaatgctaaagcggtagctctgttctctctgaaagctatacacttcatgcattacctgtgatttttccacggaagcattgtgcttgtcacacatggggcttatctccatgccacgttccctctctcggtctccttggcggaagaactcctccattatccggtccgtccactggcggtacagctggagaggctttgttgggttgctcagatctgcacagtgcaccatattctgaagaacctaaaatagatggatgcattctctattcactcctgttccttttttttaaaaaaaaaaacaaaaaaaactagaaattcacattggatgactgcaacacttaaaaatacacgtagtgtaagatttattccaaacagctcaaccatgatgtgtctgtgtatagttcacacttgtattaatagttccaaattatgccacttctactgcatctaaatagcttaagagaaactgtttatgtgcatggctgactagattcagagctgcttaagtggctggttctgtggggtgtttgtttgttagtttttttaattaatgtagatgcaaacagaaagaccagtagaattttacctggttaattctcaggaataaaaatttggataaaaatcctgcctacaattgctgaaagtataaggtgggagaaggaagaaatacatcttatcaaagctgaacacgcagacatgtgcacatgtgcacagacacacacacacagagcaaactcaaacaaggctttacctgaatcctatcggaataattatcaagaagaagaactccagagcttgtcactttcttagtttcaaccatagtcttcaaatcagccagtagattcatgtgttttgacatatctgttgcaagtaccttaaaatatagagtatattattaagttcagagaaaacagaatttacacatgaaaatattacgcagaatataagaatgaaaaaggaataaaacaacactatgccttttaatgacagtggaaaatccttactactccttgggggcagagtcttttcccctttgctatcaagttttcccaaagcccagataaatgtgtgtaatatacagaaatgctaggcactgacaaccactttcatggtgaaaaatgggtgacatctccatggataagacatcatcacaagtttataagtttttgaaagctagagattttcctgtgtctcataatcactgaataagatgcatagaaaaaagagtaaagtcatggatgtctaaatggcactgtctactgatgagaaaaggtggggaaaaaatccatttgagctgtggcccacacaatctgcttttgttagtcatttttctctgcccgccaccagactggaggggcccagaaaataaatgatgagggtgagctgacattattctcaagtccaaactgctagaagtgaaaaacctattacagaacatcacagccagcatcacgggcagcttctataacataaagggccataatatgttttgaaatgcagttccttttacctaatactcatcttgttcttatgtctaaattataaacaacttgcatcacagttctcttctttggcttttatcagctacttacgatgtcaatgaccattttccttaaagattgtctttgttttttggtcaaattctggaaaatgtcacagttttcttcctgaagcaatttaaagcccacagccaaatgatggttctctaagactgaggaatcattgtacatcaaggcaagttcagagtctgtaaaaaagacaaaaggccaaagatcagcaaaactgtttgtgagaagtttatctgattcttaaaattctggatttaggatgtaatttcccctaaacttctctgctgcccttatcattacctgacaatatccaggagagaataaatcagataacataagagcaggaacaacactggaatgaatcttggggagtgaattctaatgctactaacatgtggcaggtcatttcactctgtaggtctcagctttctctaaagtgaaagaattggatctttaacctctcctctagagttgccatgagctcagcagaatatgacattattcttagtatctataacacatccagagcataaggttttgtattcctgataactgtgaattacctaccctgcactatataaagtgaggatcctgtgttacaggattgtttgtactcaaagagggtacaagaacaataaggaatcatatgaacaagtttagatttgctcatttgctcatgtatagctctgaaagtccaagctttattcattgttttccattttcttttccaagtatcgtggcagtcattgtatactgtacagggatattgctcttcctgcctgcttgctcacagcttcacagtgatgttgtgtttggctgtctgtataccctctggtgaagattctgccactctctccctactgccctagacctgtgaattttaggcagggagagattctgcctctctcctacttcttgtaaatagcagacccagagctacaagataatcattaaaaaacttttgatgctttattctctttccacttaatcactgtaaagactaaaagcaaatccgaggcaggaggattgcttaagcccaggagttcaagaccagcctggtcaacatagggagacctcatctcgacaaataataaaaaattatctggggatggtagggcgtgcctgtagtcccagctacttgggatgctgaggtaggaggattgcttgagcccaggagttcaaggctgcagtgagccattatatcgtgccactgcactccaaactaggcaacagagcaagactctgtttcaaaaagaaaagaaaagaaaagaaaaaggttaaaagcacaggtatttgatcttttttctaacgaatgcatagaaaatatataacgaatgcatagaaaatatatttggaaatatatatctttttttaagaaagaaatacccaatactattcaatggctattttaatggagctaggaaggagaggagaggcttaagacattttcaactgagaaattctattattttatcggaactatagaaatacaaatttgcacacttaaatttctgctcccaaactacaggagcagagctgtttagactagtagggagtaggtttgtacagtatttttttgttattttttgttttctttagataaaacaatagtgtttatcttttaaaaggcagtttctggtgaacttttatagtgtctataaatgcctttatgaacctttatctacagataggtaagcatatagaaatgaaaaatttaaaactatataggttcttagcacatattattgtatttctacagtggaatcaaataaacaaacatatattgaaaggaaggcataattattagatactggataattattagagttcgtttaaggaaggaaatatgcatgtagacaagcagtgttaacagaattgacttagccttacaaaaaccctaattggcttatatgaagctgaaggtgaaggaaattaaggctgttgaccctgcaaaagaataagatgatgagctcttccttcaaggaaaagggtgatctgttgtatggaaggtgcaacaaagagtctgagttctactggatataagtagggcctttcatgtagggcagatgtccaagaatactggcaaggcctgtcttggagagtggttatctcctgacacttaaagagtccagattggctagaaaagccaggaaaggatgccttagtggactggcaggcctccatagcctcttccatctcagatgctgttacaggaaagtggtggtgactgttgatttttaaatgaacaaatgttagcatttaagaaactgaatctcaaggaagttatttaactttctactcttctttaggactgaaggcatatggtcacatttaaattgggaggtaggagtctgcagctcctcagcagattttcatcaaagacactaatccattacttgtaagtagagtccttgaaggttcaggaatgatcagaaagttgctgtcaggatggtacagtgcacagcacagaggggcaaagaggttagcttatataacatttttgttgaaaccctttcatcttcaagcccaatataagttacctcttccatcaagtctttcttaattaccagatgaaactgcccactttctcctgtaaacttctatactactttgtaccacccatttagcatgtatcgcattctaccttttttgtctttatctctacaaatcttttaatcgttcctccccaaaccctcccaacctacttagagacttaagcccctacaaaatattaaaggttattaatttaatatgtttggttatctggcttcccctaggcacttcaattatttcaaacttacaaagtacaaacaggaatacagcaaggcacaacatttagaggatttaggtgccattgtgttaaatggtttatgtgaatcatctcatttaatcctcataactcttttaggaagatactgttgttatcgacattttaaggctatgttccattcatggatggcatggagccatataggtgggaagtaagtctttgtgtccttgggataggctgggggatagaaaatgtcccttggggacatcttttatacacataaatatttacatagacatactcatataatcctgtacaaatgaagaaaatgtacctcagagaaggtaggtaactttgccaacatcacctagccagtaagtgctggggccagcacttaaaaccaggcagtttctagagccctcaccttatactgactatgattacaagtaccttatagaggtgaaaacctgagcagtgaacactaaacatgaaccaggaaatcaacacagtccactcagtgcctggcacacatttataaagacaactttgtaagtatttattttttattgagaggccatgcatacctttacaaactcaaagccatcattttattatatatagatcaattgtgctcatttgttacaactaccctggatcatcaagaataaattaaattatgcccaacatatgctactactgaaggcaggaagaccacttttgtgtccctctcttctgagtgctaatgaaatggggggaagggtgggcaggtactaccacataactgagaacatgtacttcatctgtgctaatcttttctctctctgtattaatcatggttctccagagaaatagaatagacatatgtatgagtgtgtgtgtgtatgtgagaaaaagacacatttatttattataggaattggctcaggcaattatggagtccaagaagtcccatgtctgcaaaggtgaaccaggaaagcaagtccaaaggccagagaatcaaccaggaaccctgatgttagaggcaggagaatatgtatgtccaggctccgagaaagcaaattgcccttcccccaatgttttgttcttctctttgaggtcctcaatggattgactgatccctgccaacaatggtaagggcaatcttctttaatcagtctaccaattcaaatgctaatctaatctcttccaggaacactctcacagacgcaccccaaaatagtgttttaccagctatctgggcatcccttagcctagtcaagctgacacataaaattaaccattacaaattctgccccttgtcaccctggtacccataagcatctcctttaaccatatttaatctccataaggccataattctaccaaacaggctacaactatcctgcatacaactaaaagcacactaacacattccccagaagtgaaagtaaagtttttgagtaatgtttactcttatcctgatagcctataacttaaatactatgatataaaataaatacttaaatactaatataaagttaatacctcttatgttatataagggaataagaaaaagaaaatgaagataagttaatacctcttatgttatataagggaataagaaaaagaaaatgaagatatatgcttaatatatgtatatatacatataaatgcattcataagaaaatactcatgacaattatagtccttatttctataactggtcatatggtcatagctggtatttgtaattaccttcttttactactcattctgtattcccttttccctcagcaagcacctcagctggtcatgattctttacctggtggggtgaccgaaaccttcattcgtgaagggtatgggttattagtggtcctgcctggattgggttattttgtgctgaccttaattacagggcatggttaatactaagggatgccctaagggatctccttattccacacatactcttccttaccttcattgtggagtagtaacccaatttccccttggtagtcaggatcagtcaccccagtcaacactgtaatgcccttcttggatgattgaatcagatgcataaggagctcaaagtggctaggtcttaacttccagttcaacggaatcactgttgtgtctcctgatagaagcattcctccttctgaaactaagacctctagctagcagcacataaatttgcaggaacaggaagcaaactttgctagtgggtcactgggggtaattatgagtcgtaacagtcccatttctatccaatgattcctggacccatgaattctggttatgcgagaaatagcaccacatattggatgctgattcagagcatatatggcctttatggccttctggagaaccttgccccagccctgcaaggtcttgcctcctagctgagtaactgagtcttcaaaaggccattctaccaatttatcaagccagctgattcaggatgttagggaatatggtaagactagggacttccatgggcatgagcccagtgcagctcttctttgccagtaaggtgagttcctggttagaggcaatgctgtatggaataccatagttttggcagaaaaactgcagggaaggcacatctgtttccagagaaagtgccttttccactaaggacaaaatgctaccctttccaccatggaagtggtccaatgtaatcaaccagccatcaggtagctggctgatccccccaaaatggtgttatatgggggttcagtgttggtttatgctgctggtggattgcgcacttagcaatagtcatagccaggtcagccttggtgagtggaagtccatgtttctaagcacatcctgccacctccatccctgccaccatggccactttgttcttagcatgttgggtgatgacaggggtggctagggaaccaagttgactagtatctacagaatgggtcatcctattcacttggttattaaaatcctcctctgccaaggtcacactttggtgagcattccttttttgtccattcagagagatcattcacatatctcttccccaaatttctttctcaccagttttccaatcatattccttctaagtccctcactatccagacaaatcattggctacggcccatgaactggtatataattgcacatatggccattccctcttccaagcaaagtgaacaacgagtcaccttgcctaaagttcttcccactggaaagactccccttcaccaccatccttcagagatgtcccagagaggggcagtagtgctgcagctgtatacttccggtggtacctgcgtatcacgcagaaccatccgtaaaccaggccctctgtcaactacttgcagggaactttccatgcgaccacatgtgtaggctgggagaaagaaggcagtgtaattaataggagtggcattagggccacttctttatgtaatttgtgcctttagtgtctgctcggacctgatagatcgtgtattacactacttttatttgatgatgaaatgtcgtacatgcccaacatatggcttggcgcgttagataataccctattaatgatgggcagacagcttaaaccacatggaaacttggtggcccatagtcagtcagtatctcctaaggcccagcagcaggcctatatctttctttcaaaaggagagtagttagttatctttctttggatgatggcagggtcttgctccagagtctgtgctgtgattcacacagagggctctgtcaaaggctccaaacaacattcctatctgccactgacatttcaagcaccattaaatctgctggatcatgtggcccatgtgcagagcagcttgcacagcaggctggacctgttgtagagccccactcaaaactagcagtttttgtgacactctcttgttctgtgccccatctaaactagcagcttttcagatcacttagtaaatgggccagagtaacacacacaaagaaggaatacattgcctcccaaatccaactaagtccactaggtattgtgcctttttgtgtcttatgatggagtccacatggcagatcagagccaatattaagacctggagctgaaacagttaagactggggcagacactatagatatgtatcctgtaagtaagacttacactcactgttcttacagctttactaggcttagccttgagttagttagaaaatgacagcatgctacaccatgtctctaagttacaactgaaataaacataaatcttcaaaaggacttcagaaacaaacatttctccatgaaatgacagagggaagtggtggttttaacttaatattcagttgtcaagaaaactgcctcattcatcactccactctctatgccctcaccctgcattattttcctccatagcacttagtaccatcacatgccataaattcacttattatgctccaccttttctagcagaatgccagctcttaagagccagggatttgtcttgtcttgtccacccatgtgtcctaagtgcctgaaataatatttattataacatttagtaggcttgcagtacatttttgttgaataaaataatctctgtagctatatctatataatcacatttgataaacatgaatttatccttattttgaaggtgtgggtttatacagaaaaataaaattctacatacaatctactagtgtagctatgaaaattttaatttcaaaataaaagtagagaaataaaaaagtgtatactgacagctagatacatcttaaccttaatataatgaaatgcctctgctcttggaaaccaaaaaccgcatgctttgaatgcatcactaatgtgaataaatctttctgccccaaacttaggcatctttgctattaacaaaaataattcatttgccaagtaaaatttaatgctatattctgtacttttgatactttttttcagaaaataaagctaagttaaatataccctccagcattttatattcaaaagttcatgctgctatttacattttatggatttatttatttatttatttatttgagatggagtttcactcttgtccaggctggagtgtgatggtatgatctcggctcactgcaacctctacctcccaggttcaagcaattctcctgcctcagccacctgagtggctgggaatacaggcatgcgccaccacacctggctaatttttttgtatttttttttgtaaagacagggtttcaccttgttggccaggctggtctccgaactcctgacgtcagtgattcacccatcttgacctcccaaagtgctgggattataggagtgagccactgcacctggcctatggatttatttatatgcatcatcctttaaaaatatttacgcagcttcctgcctgaaatttcaatttctctaaatcctgttcacagtacccacactcaaatcatttattatagcttaaccaactctaccaggtagaattgttctctctgcttgcagaacctccagcatgctttcaacgagtgtaaatacaattagtataaaatcatttggcacctaaagctaaaacaactgaaataattaagaaaaacgaagagcacatgtaagaagcaggaggattaactgccctgggaaccagccaagggaatccccagcgccccccatgtgccttaagctctcagtgcttccgtagcttccttaaagtaagacaagtaaccaactatgggtttataaatttgataatcagaggtctttagaattctttattatgagaaatatggattcagctgcaggctttggacaggatggcagctccagctctgaggcaagagctgagaatgtgctggcttgacacatggatgctcaagccatccataaaatataaaaagtcaaattttaaaaaaggtttactgcaaactaaaaataagcacaaattttgataaaatatttcacgaagctacatatcacaagtttacaagttattagaaggattcctttactgcatgctgggaagataattctcttacatgatccctagccaaaccaaactaactaaggctgtaattttgataatgccctggggcccggaacaaccctgggatactttcctgtacaaagtgacaatgctgattcattccctcaggaataacacagcctcatcacacctcatcgtcaaaaaaactttagcaatccaaagctactctggcaactgtgaacttccctatgtcgctgtggtcacacagaaaggagatcattgcaatattactaaataacaaagaaagaatttgcagcggcaggattagttatccttccatcccaggcaggtcaccagcaaaatgactttaaacagacatcctaaggagataaaattatcttcttcagtttcctccactatttcattggttctcaaactttagagtatcagattcatctgtagactgaggccttgttagcttaaatggcagactgcacagggaccctgatgccagggtcctccaggtgccagtcaaagcccaagtgccctttaaagcaggggtccccgatccatccatcggctgtggaccaatatcggtccgtggcctgtcaggaactgggctgcacagcaggaggtgagcagcaggcaagcccgcatcagtactgcctgagctccgcctcctgtcagatcagcagggacattagattctcctaggagcgtgaaccctactgtgaactgctcatgcaagggatctaggttgtgcgttccttatgagaatctaactaatgcctgatgatctgagatggaacagtttcatcccaaaaccattctctccctgcgcccccagtttatggaaaaattgtcttccataaaacctggtgcctggtgccaaaaacattggagactgctgctttaagggctcaaaagaatgaagaatagagcaggtcctcattacccttaaaaaatgtatcagagtacttggaagacagtgacctttctatcagttgttttaatttgtcttctaaatctactcttaattctaagggaacatataatatgctatataacagaatgcaaagaaaacataccagtttgaatgtttggtgtttaagatagatatatatatatacctttaacacaaaaattttatgtaaaaatacattttatgtatttactaaaaattgataaaattcagaatatctcaagacattcataagcatcaaaataaatcaggccaggctcatgtaaagtgccagcatgcactgtattgcatgacctccctgctcttcttagaaaggacataatgaaccctccccactgatacctccccactgataccatgtaaatgcagggagctgcatccaatgtatattaatatttgtatgtatgctttgatgagttctaaaagtacctcattataggtgctcataggtaggtagaacatgaaatgttatcctgtctaatctggataaataagttcctaaactaaacttgtaaaaaaatacttgactaaccacacatctcaggaaatccctgacttttccagtcctctacatggatgagtcattagagtatattttgctataggatagtccagaggccattataagatataaaaataggtaaataatcctaaagctctgaattaaatctctcaaagcaaggttacctctacattccttctttaaatctggctacagcaaagtacaggaaatgaatggtgaattcataaataattctatagctagattgctataggcacgagaagactattattcatagcctcaagcaaaaatgaaagaaaggtggattcttaagcatacaacattttcaacaactttgcatattttttatatataaaagtgaatttatgattttataatctaccataatttataatctaccatatgggagggaattaagtcatagttcacttaaatcacttaccaattaacttcaagtaccaaatagaatttctataaacctaaatctctttaccaagggatagctcaagcattacctaaacattccctacacaggctttctgtgcggcaatgtcagagatgctccatattaaacagtctctactattccttatatttccaaattcagtgatgacttcttataaggtgagatgttaacagtgagaaaaaaccaaatggttgaaaaaatattaagaagttcctgttacccttattagaagattttaaaaaggaaagaacaggggttgggcatggaggaggaagggaagctatggcctctgaagaggattaaatgatgacctacataaagtgaggaacacttaccattaattctcataactttttttttaatttaaaactttagggccaatacaactttctaaatctttctgcacactttcatttttaattacccttgtctagtaacacagcaatatattacttttaaagagaactggaacacatttttcaaatatcacatgcctcaagggatataatgataattttcagttaaattacattaacatgaactatcactaaaacacatatatacacatctcaaaagaacattatggctctggaagactctgagtttataaagacccttagtcattctaaaatgtacaagggaaaaatgtgttctgaaaaaataaagtttacttacttgtattgatcagaaattgattggacacaccaggatgatctacatcatgtattgcactggcaaaaattgctgcaagaatctccaaatctgtaaacacagcctggaaaatcagacaatatagataatattactattctacaatgatatgaattaaaagtataaacaaataagaaatctctagaatttaaatggaaaacaaaatgaagcttcaaaatgtgttacaatgtgtcaagggagagtcttagatacttgtgaacttttaaagtataatcttggaagaaaatattttatctaattttattacatctcatgatcaaatgttttccattcactgtattttttaaaatattattttaaaactctgaaattattttaaaagaaaataatagtttattttctaaatatttaagatgtctaagaatattctgaaaatgtacataaaattagtaagacattagcaattattttctttcatcgaaaccagggtttctcaacttcagcactattgacattttgggcccaataactctttgcgtgggaggctgtcctgtgcattgtaggatttttagcagaattcctggcctctaccaacaagatgccagtatcatgtacaactaaaaatgtgatagttgtgacaaccaaaaatgcctccagacattgccaaatgtccctggtggtggcaggagggaaagaaaggggaagagaaaccatctccagttgagaatcactcacccatatgatgaggtattaacataattttataatgaaaacaaactgaattataaaatatatttcttaagaaaatcaaattgctttagtaaacaactaatgaaataacttcttaggatttagaaaaattaaagtatgtccttctaatatattctatgaaaaaatatcaatatattgcttatgttttataaaacgttctttggcctataaataaaagccgtcagactagatttcaagaaaacaaatgaacaaaaagtgagtaagccagatgtgctttatgaaatgttcagtggatcatttcaaagaagcaatatcataaacagatcaatcactaaatctgtgaccaactttcataagcaaaatccatcaaagacttgattgtctattaactatagcattttcccccataagtcaataagttatacttccaatgaatccaattatcttctccattgaaaacccttcagataaaagtttaatagacctttatgagtggcaagttagtgttcttgaaatttcagaaacagatttacctccaaagcaggtgtagataatagcacatgagtagactggacaacatctgcagcatggatattgttgtgataggccacatcagcatggtaatggtcttcgagagtcataagatatgtaattaaagtatctactggaattttaaatgtttttaataaatcccgttcctgtaggaaaaaaaatcatcttaacatttttgtctttatgtgaaaaatttctccatagagtatgtttaaaaaaaaaaatcacacaccagtgttgccagtggataacctggaaatggcaactgcactctcacatgtctagtgaggaaaatgggaacctctgagaagatccagggactctgggacaaaaccagagttgggttgtcctgctggaacccaagaatactacgccctagctgtatggtgtcaggaatgaggtgccaactctaaaagtttctatgtcccattatcatggaggcagctccagtcaagcactattaactcaacccctgcatcacaccaactaaaaatcaacgtcctctctagggctgaagtttcccatttcggtcccgagatatctacagcagcctcaacttctcatttaaatcccaccctaagctggagcaaagggtcaataagagagagaaatggatatgaagaaagaagcaggacacaagaaagtgactgaaaaaactatattctaaggttagtagccagcaggggctttattcattttttttaagttagtactccattctctatgcagtcaggttcagatgactaagatgatgtctaaattattattttaataaattgcttcaatttggctatatcacatctttttcttaaatgcaaaaaaaataacaaaattgatgttatttgtggtttatccacactccacctttctgtatctttacttgtcccttggcaaaggagcaaataaggataaaagtataaaaataagcaaaaggtggggaatattaaaaaagacaaaatgtatgcataagctacagactggacattaagttcctaaataaaataaatgtaatagaactcaaccaccttacctgaaaaatggtgtgcatgataacagtcaagggccggttaccagacaactctgctattctgaaaacatgaagaccccatttgttcacatcttctagttcctggagtgaaaaaaaaaaaaagatactaaaatattagaaagtggagtaaaatatgactcaatgaacacaatcatttaaaaattacagaccttaggtggccgggcatagaggctcaagcctgtaatcccagaactttgggaggctgaggcgggcagatcacttgaggtcaggagtttgaaaccagcctgcccaacatggtgaaaccccatctccactaaaaataaaaaaaattagtcaggtgtggtggtgtgtgcctgtaatcccagctacttgggaggctgaggcaggagaattgcttgaacccaggaggcagaggttgtagtgagccaagatcgcgccactgcattctgcaatccaacctgggtgacagggcgagactatgtctcaaaacaaacaaaacaaaacaaaacaaaacagacttcagtgtaaagattgttagattgttttaaacaatgattcattttaaatgttaacagacacaccatgtaagcataggcaaactttaggcacatttacttaaatgtactgaaaattgaacagtatggcttaaccttgtgactttgacattacaacacatttatgtactttttaagtatcaatcacaaagcacttctttaatggataaaatctattcacaaaaccttaactgttttcctaaaacccagaagacatgacagatttctaactctttaaggccaaacaatgaaatgaagatgcaaataatcaccccccaaacccctaaaacataccaaaccacctgtctaaggcactttaaaaggagctttataaaatgccttcccatcttcaaaaaaagaaaaaaaaaaaaccccaattaataaacttttctatccatttaaaagactagaagtgaaaattcatgaaagggcatcatttaatatttatgatcctgatctttgaaatcatcataccttggcaaggacatcttcttgttcagttttaactccaaaccttgggatacttgaattagtcagactagagctgtgcatcaatttcttgactccactgatctgagacattggtcttttctttttctccttttccttctgagttggagaaggaatttccacttcatgttgcttatcttgagaaatttagaaaatgttctatatttattattaattctatctgttttatatcatatgcataattggaaggattataattgatcattatatattccaggaaatgtttccaactaaaaagtttccttttagagagttcagtatttacatttgaattggacttaatttgatgtcttcaaacacaaaattaagcaaataagttccattacaaaataataatatcaaatgtattccatggttacctctttgatacaatgtcctaataaaaaatgctgcaagacttagcatgacagcagactcagaatacacaacaggtggttatttccactgttcaattccattcctttgtgaaactgacttaatgaactgaatattgttcttgccaactaaggactacagtttcaatacatactttgaaatggtagaaactttatacgcaaatgtcatgaaaacagcagtatataaaactaacagctaactgaaatgggtaacactgtgggagctgaaacagcaggttttggatgacttagattaattctgctactttttatttctgtatgatagtgagataagggttaaatccccaggttttatgggagcatagagaatcataaatattacctgataagtgaatacgtacataagctaattgtgttctatagtaaaagacctaagatatcttcttactttcatccacgatttcaaggcagtgatgagcaactctaactcatccttatatatagaacatattctaagtgtttaataaatgttaactatatataacagcaattttgttttgaaagtaagtccaggatacattcaaattactgacctttatttactgcattttctttctgtggatgaggtacaagagttgtcccaggacaccaaactcagctattattagcaaacttttatttagcaattgtattttatctgcccaccagtttactaggcttgatgtacacaagacggtaaattcatcgagggcaggaatcatttctaatttatcattaaacacctattgcccaacaatggctggcatttaataagaatttgttgaagatatgaatagatctctctataaaatatattttacagtttggtactatgaaaaaatggcaatatataatcttaattcaagaattcctaaagtcctaaataaaactaagaaaatgtaccttgtcacctgcaactctaaaactcagaggcggatagtgtcgaattattaatatgacgaatgaaaacaaatagaacttctaacacttgtttggtttccaaaatgagttggcaccccaatcctcctacaaaaacaaacaagcaaacaactgaagaaaaaaatttaattgcatgttgttattctcacctaagaatgtgtttgatataaactctgacacttgatttccagaccgactcatttcagagagatgggtgagctcccgattaagcatccttttaaactgaaaaacagaaaagtaaaatgaaataatagaagaggaaaatttaagtgaaatatatatgcatactctgagatacaggaagatatgcccaaagaatttttaagttgtcctgacaatttagaacagtgccttccagcagaactttcttcaatgaggggaaaacaccataatcggtgctgccaattatagcagtcactagccacaggtggttactaagcatttgaaatgtggctagtgcaaatgagaaaccaaattttgaattttatttaattttaactacttttaatttaaataatcacatgtggctcatggccaccagactgaccagcacaaatttagactcccaagggctgaagggaaaatcaggagaaataagcaaagaaaagggaattaaaaattaagatgtattattagttatttagagaagagagaaactaatttatagcacataaaagtgttgccatacaataaaacatggaatgctttcttcaattaatttatcattagcagaaatgaatatatatactgatcaagggctcaaaatttagtcttttactccaaagcaaaacttaatagacttgagtactcttccaggactatggagaagtaaaatatttaaataaatactgtataatgtttccttttaaaagttgtttttcaagtaagagtataacacttattgtttctcaacatccacaaaatttaccattttcccaagtcactaaataggaaacaggtcaattttcaacaatctacttcacagtttttattactgatgccatagtgcctatttcattgaaagaaacactggaattaacctaccaacaccacatggcattaccagtatccaaatctcccaaagattttacacttctcccacccccatcagctgtttcttaagcattaagcatttcagagtcctttgactctgaaaacaacccgacgaggccttttaataagcctttaatatttgccttaatatacagaaacaatgtattttttctacacatagagtaactgctattagatacttgacaaaaaaaagtcagatgcatttactctaatcatcagattagcctttaaaatttgaaatttcaccataaattctcatttaagtatgaaggtaagtgttgaatgtatattttagtgatgtttgaaatataattcttagtatttaattatttagaattattttgcttctctgcataattcataccaagatggcctaactctataccgtttgctaaataacttccaaagtcaatcttatagaccatctagattaagttttaactccgcatttaactgttatcaaaacaaacaaaaaaccctcaaccatttcaatggactgttggatgagagaaatgtgtattcgcatgccagcgtagtcaaaaacaaagaactcgtcatttacattgggtgtatctcctaatgctttccctcccccctccccccaccccacaacaagccccaatgtgtgatgttccccttcctgtgcccaagtgttctcattgttcaattcccacatgtaccctagaacttaaagtataataaaaataaaataaatgctggggaaaaaacaaacaaacaaacaaaaaaacaaagaactggcatgaccagtacaaattctggttgttaaattactggtctagaaagcttagtctcaaactcaggaacactaaattcacttctttgttcatatgtttttataactcctttctaattataaaatgtacatgtgctatagaaaatgtagaaagctataccaaaaaaaagaaaataatgtaaatccccactgctggaagataaccacagataatttgttaaatttccttttatgccttttttctacccttgtatgtgaatacatatttttaaaactggcatcaggtggtatacagaacataggttactgcttgtgttcactcagcattatatcttataacctactgaaaaaaataaactttgggccttctaagaatatttgtagacatttataatagagttcaaaattttttctgtccctctttacaaagttatattttcttgagtaaattatgggctatcatataatttaatgagctaatatagaagtgtcttctatttagcctggcacatagtagatgctcaatattatttgagttctttctcccagctcactttctggcacttggtccataacttttgggccttttaaagtaatagctgatttttatcattgcaggtcagacagatgaaggatttgactgtagttataaccataaaaatagttacttaaatagctagctcctctttctcaaatcccataaagaatttggaatagcattagtatgggaaaccatagctatgtctcaaaagcacagctaaaatgtcatgcatacacaggtttaaaaaactctttgcttaagacttggagccaacccaaatgtccatcagtgatagactggattaagaaaatgtggcacatatataccatggaatactacgtagccataaaaagggatgagttcacgtcctttgcagggacatggatgaagctggaaaccatcattctcagcaaactaacacagcaacagaaaaccaaacaccacatgttctcactcataagtgggagttgaacaatgagaacacatggacacagggaggggaacatcacacaccagggcctatgagcgggtagggaggggaaggacagcattaggcaaaatacctaatgtagatgacaggttgatgggtgcagcaaacgaccatggcatgtatatacctatgtaacaaacctgcacgttctgcacatgtataccagaacttaaagtataataattaaaaaaaatttgctttacagataaattcacacttggaaaaatatactcattaggcaaagcatattccaaagaaaagagtctgctaaacattttaaacacacattcaatgaaatatctctttgacctaaaattgttcatgttatgagctaaaagttgctattaagaactacctggtcatgacaaagtcttttttttcataaaagataggagatgaggcaaagctttcaccattgctagaatctcagcagtctatacaggaactgctgccctccttgcacttctctcaataaagcaaaacaagggaagccttctgggagtgattgataaagatagatagagacccagttatcacaggtttatcttctaacttgtacacaaactagtataaggattatgttgcccaaagagaacatgtggatgctacctgcagatatgctacatatattattggatttttctaaaagaatataaagaacgaagtataattttcctggcagtttgcttaaacaattcaccaaaatagccagttagtacagataactgaagaaaaaagccagtgaaaggaatctaaatattgtacagactagataagtgacatcctgcatgttcatctttctggtcatatacattattcccagagtactttccagcctttgtttaaaacacaaaaacatggattggagaaatcctccatcacatgcccacctccctaccaaggcttataagggactccaaggaagtcaacatttcattttaacataattataaaagacaatatttgaagcaattacttctctactctaggaagacggtctaaggaatttcctaaagataattctgaagcgtacattaagttataacacaagggtattttctaaaaggaattaacattgttttccttttttgctatccatataaaagtttcagtccagcaaagctaaatgaataaccacaaaaattaccataagtgctttctcaactggtagttgatctcacaaattggttttggagtgcatagctagatgtactaaaaaaatgcactagatcattcaacaaacatttaaaaatgtgatacttctctcatctaaaaataattatataatatttactaagataactacataaaattaccaaagggggaaggactgatttaaagctaatacaatgtattcttctgggaaatcccatcatatttctcaattaatatatttagaagggacaaaacattaaactgctgtttgaaacgaaccgattgtaaaatgcagaaccatttaagcatttagtttatttttttaagtgacctctaaatattttccattgatgaatttctaattgtttttggcctaagtagtctgaaaacaatacacagatttagggttgcaactaaaaaaacgggaggatttctaagtgaatgcttttgaatcctttgttctcattatacatcagaatgtctgtgtacagcagttaaggcataaaggaaagtaaaaatgcagttgaatctcaatactgtattttgcttttcagaactgcaattcttcaatttacattaggcatttaagattgttcaggaagcaaactaaaataataaaacaaaatgtccttaaatgtaatctcctttacttctacatcacgccagtgtgctactgggtatattatatatcctcccaatatatatttaaggaggtggtatgggtccaatagtaagaaaattttcttattttttcctgacaatattctgctaaaaatcatttgaatatgctgcactgtgatgcattacaagtttggtagatatcagtattcaaagttatttaaacaaatactccattgatggtataaaaataaaaccttcaaaatgcataagaccaaatatatctatatttgctatttttacatgtttttaaaggtacagtattaaacataaagctgtccaggaaaaattttcctcaaaaagaaacgtactaaaattctatatgtagattcttggcaatattgttcataatcatagtacaaatggttcataatcacagtacaaatgtgaagcccttcaaaaataacatcagttgtgagctggctaaaagctaggagctgaattctggcggataatgagggcttcttatatttactctctatacttttctgcatttctgaagatttttagccaagaaatggctaacaaaattcaaataatggaagtctatatattttaaaaacatttttaaaaatctgaatcatccacagatttaaagggaggtaaggaatcatgactacttggacaaccaagactgaaataagttttctaatttttttagaattcaagtaaatctctaaaacaaaggggaacttgtccttcaaaaagaaagaaacaaagcaaacgacaaacactccaatctgaaaaatcctcagagtaacagaaaatgaatcttttaaaatgtgttgtgattggctcccaggttcaagcgagtggctcaaataccaaaaatctgtgaagtgatgtttcatttaggactgaataaggtttttctacctccttctattgtggagacaggatcacaatgctaatgttaccacagggcatggaaaaagcctgccaagcatggacacaatcttattgaattgtttattaattcatttcttgagattcacaaaacagtgtaataaaaactttgttcagttttgcaagtataatagacaatcaagttttcactttagtatcacttacatagttaagtaatgtcaatttttaatgtcacctagggctttatagctaaaggtgaaaaaaacgtattcctcgtcaggttaaagtagtatagatttttagaaacagccacaaattaattttataaactttatgtgcaacatactaactggaatccataaatcagtataagtaatttggcccaataatttatttgcaatgaatgtatttaattaccatatatttttcaagcacaattcaaacatataccacatgacaaacagaagaactactgcgtatctaaaaaagctattttaacactcaaactacaactgatgaaagttatacaatcttatcttgaccactattaacacgtatttcttcctagttcatgtgtaaggaaagaatacataactgatagtttgaacaaattacagtagagtctaagctttctaaataattttgtaatcagagtaaggagttttcaaaagctaagtaagtcttacctttatgtagccccaagacactgacagtaaatagtttgcttcaggcatttttgattgattatatgtatatatatatatatgtatatatatagtaagctctaaaatgtatttagcttcaaaatctcgacactttaacaacctccacaagccacgcagagtatgagtttttaaagatttttggtaattaagtatacataagaaagcctcgcattaaatcccatccagccgtcttcccatcgaatacatgccatttgtaagactccagaatggcacaaaattcagcaactattctgaataaagaaaatccacgtgataaaggaatatctaaagatctaagggtctgcatctttctctcccgagctccagggcttaatgaataatgtatgtcaagatgcttagttgcaagaaaggctagtcctgtcaaaagctaccaaataaggaactgcagggaagccgggaagagtgacaagaagcccctcccataaaaccccaactctgcaccaattgcattccagctcttagcctataaggcgagggggtgtggcctcggtgcaggctgctttgggattggttggcaagggccagcctctggggaggctttctcctcacccgacaaacgccattgaataatggtatccctgcagctctgaggccaccctgagaaaagatgaacggggcttccctcttgcagtgatgaataatgaccataaaactcctcaaaattcgtagttcattcttaagaattgcccatccttttggagggcattttctatgaattttaatgtcctctggcttcccttccttccaaataaaaactgctccaaaaatggcaatcgagcattttaattgcttccctctctcaaatccaaaacaagtggctccctggtgatgtagaaatgactgtagttctcccctcatccaacataaaagcatagggattaaacaatacgactaatgtccagaattcacagatggcacagatggcaatgacacattccctcacctgtgtgccatggctgctctcagctccttttgtttctattgttatgtatgacagagttctaaaaccttcaaaatctaggggtgggaccacttgcaattctggggggagggaaatgtgaaagctagggcactgtgtatgcataaggaatgcagtgttttgtatatagaactcaggatctgtattttgatcagaagagaatattttatttatttatttagagacagagtctcgctgtcgcccaggctagagtgcagtagtgcgatcttggctcactgtcacctctgcctcccgggttcaagcgattctcctgcctcagcctcccgagaagctgggattacaggcgcccaccaccacgcctggctaatttttgtatttttagcagagacgggatttcaccatgttggccaggctggtctcaaactcctgacctcaggggatctgcccacctcagcctcccaaagtgctgggattacaggtgtgagccaacgtgcccagccagaacagaacattttaataactgtacacaaagttaagaaaggaatgagtggctcttaggaatccagaattgagctcaagagtaatcagacattttacgaggagggttaaatgagaaatcaaagttctttctagaaaaacagcattttctatttggtttggtgtagtattaccctgtaactttaatactaaagaggtcttgtgggtgagaaacaaggaaaaactaggttttagttgattttagcatataattctgtgcattttacctcctctccatctcaaagcctgtgcttactactctgtgctttaacttgctggtatggctactctgcagtcttcctgacatttaactatttccacatgtggcatgtctgtcttagagagcatgctctctgataagcactcctgtaacactgtgtctctctgagtttctattggcctttagctgctacagtcctctgcttttgttaacatctgttgtattcatttccatcactcttactcctctacaaaaggaagaaattaaagctccaacattccactaaagctacccccagaggaatactaaggtcctccttttctctggtctccctacttctctgaagtgttccacatgtttgatcattcctactactctccctcaactcccaggatcctgaacttctttaattttccctaggcccacaatcttcaatgaccacttctaacttgaacttcagtgccatatttctgaatacaagattctcctctcgaatgccctgctagtcacgacaaactttttcaaaactgtgagacatttttctatttaaagtagttcttagtataattacttccatttcagtcagtgagcctatatttcttccagtatctcagatggaatctatgactctttcctaccattcaacaggtgtttcatgtgcgtcagacactgtcaggtgtttaatataaaccatctagctgaatccttgagtaacccggcatgttcccctatacggcatcaccttccctccttcattcaactttgttagcaagccctatcttttatccagagctgtttctttcagtttattccttaccattacccctcccgtaatctgaatccaaatatttaaaagactgagagaaatagaaagtaactttaatatcaccccctctaactccctcatttccacataaagttgagacctagagagaaaaaatgattttcccaggttcactctggtactgagaacaagaattgcaagtttaaatcttttgtgcacaatcactgacaaataatctttttagtgtgtcagcttcctcatctgtaaagtggattactgtggcagctagtctccaaagatactcttaatgagccacactgtcctacactgaatctgagttggcttgtgtaaccaacaagtgatggtgcatgactgctgaggctaagtcataagaaatcttgcagctctcatcctgctttctttgaatgtgctattgggacccctaagccattaggttgaaaaaaaaaaaggtctgactactctgagaggctatgctacaagaagtccatgttaacttcacagacagtgaagagagaaagcgcaagagagcacttgcacaagaaagagcacacatgcctggccagtcttcagcaatgccagccaccccagcccagagccagacctgaggggcaagaagccatcctagccatccagccagttcagctttcagatagctacccactgggctgcaaccatatgaggaatgccaagcaagaatgtctagccaagaccagttaacccacaaagccatgaaaactaataaaaatacattcatatttcaaagtattaggtttgaagtgatttcttacatagcaataaataaccagaacagatacatatgaggattaaatgagaccatatatgcaaagcacttaaaacaacaaatggtacaaagttgaagataagtaggtatcagacagtaaagatgacagtgacaatgatcattatgataatcattctattatactaatatttaaaaaaattctctggtttgtcatttgtttttaaaatatatatgttatatttcctttcaattgcatcacagcactccatgtctcagggccaaaatgctgtaattgcttcttagctcatcttcttgcccctggcttttccccttctagtctcatattgacctctactgccagatcaattttcctcaaatccagccgcagcctgttacttcaaagctagtaatgcctgcttcatcacatccctctgtaaattccagactgccatatctgaccttaatccccaacgccaagcctattttcagctgctctattacatttgctctgttcctgaaagactagtactcctccaccttcaccatacagctgacaatcccatctctgtcttaccaaattctcggcctaaaataccctccttcttctactctgccaacctcaaactggttttctcagtcagatttaaatcattcaaagtacatcttaggaccaaatattccagcctttttccaaattctaacgattctacatctgccccttcattcaatatttattaagctcctactctatgtcaggcactgcctgagaaagagaaacaaagctttctcacctgcagcttatattccaaaactaagttaataaatacataatacgtcatggggtgataagcacaatggagagaaagaagggataaggattacggatagaggttgctataaggtgatcatggaaagcccctctgatgagatgacgtataccaggagatctgaagaaaggaaacaagccatgtggattgcggggtgagaggtagggtagagaagggaaaaccaagtgaggaatggcaaaagcaaaggcctcgaggcaaaacatacttggtgaggctccctgaagaacaggtggaagtgtcataccacttgtcatttaaatgcaaattacactctgcagtcaggctcactgccttccccctcctttaaaaaaaaaaaaatccatccatccatcaattttattctttgacaaacttaagactcagttactttttactttttataacaagtattcatcctgaaatgaaattcctaaatacacttccttcataatactgtactgaatacatataggctaaatactccctacatagatttaaaaaaaaaatcagtataatggcttatcagtgaaataaaggagaaatgagtaatttctatcaaatactacaaaatataaatacttgtacacaactacattttaaaaagtagtcaaaaactactataactgattagctgtgtgaccttggggaagctatttaaatttcccatacttcagtttactcacatggaaaatgagaataatagtttctaccttacagggttgttgtgaggattaaattagtgcatatacataaggctcttagaacagtaagtgctatctaagggtttgctatgatttctcttatggggagaattaccacaaaagtaacagtagcatgaaaatgaatacaggggtgttatgttagaaaaattttcctttttcctgatatgatgaatgattctttgaaaggtttcaaatgtaacaaagtgccatcttcacaatatacactattgctgcattactagaaaatttggtgtggattaaaaccatgtaaaaatatttaatacttatacgtaaaaagtagttgggttctaggctcagagaattataaatgcattttgttttttcacctatgtgaatagctgctgggactttttggaagttgtgtgggacacacagcaaacctccctggtgaaaggctgtcccatgtatcccaggacatctagcctccctggcctctgcccaccaagcaccaggagtactccccagtcactgtcccctgaaatttcctgaatgttccccagtgttaagaatcactgttctatttttttcaactgtcttcaactttgactcctcatccagggtggaggatctttgaggccagaaaagtatcttattatgtccctgtatttctcaaggtagtgtactattgccacaaaaagattgttggctgatgcagatgcaaaacatcaatatttttatactgattataggtgacaggaaaggacaagggttttcaccctcagcaaaatcatcaaaaacatttaaaacagattacatatagtagataatactccttgtcttaaaacattatgcagaaacacacatacagtttcccttccctctaaaatctgcagcctcttctccctgctgaatgtgagtgatggtcccttcattcaacagacttctatttggcaactattatgtgccaggcattctaataggtgctggatgtgaaaggatttaacttattcaaataagtccctaatttgctgcaataagggagattatttaatcatattgagtaaaaagtaccaaggaaagtttccatatttctagggaataagaaatcttttcaaaaatctctgagccaaattaaaattcatttcattttccctaatctccatttctaggagactagaatctccttcctattgccacggtagctgctatctgcagagagaatctagataatttagaagagaaatttgaatagagccagagagatacaattcttatagtcagacttggcttcaccaaatttaatgaagaaactttaataagttacaacatttactaggcacctactatgcacaaagaactttacatacctcatttctaatcttggcaacattctgataagataaatattatccctattttaacatgaaaagatggaccttcttacatattcaataacttgctccataggtgacaggattgaaatgcaaacccagtccttgctcttaatggtgtatgacagctcatcatataattaggctgatgcaaactctatgataaacagtatgaatctaggagtggatttgtttatcctcaatctttttgctaactttacagtgccttgaattaaagaatcatggttactatcaccatggtcagatctctggacagggtgaggaagcaggtgcccacaggcagacagccctgccatatagtgagacacgcttatgtttgggagcgctatgtgaacaacacacagctgccctcatatgcagatgtaatgatgacgacacattcagacaaggaactgaggtccagaaaagttctgacaacacaacttgagggacagcgttacagctagagctcaggtttcttatctgtaatccactgctctcaaatgcccaaatgattttatatacatatatgcaagtgtgtttgttgaaatagaaaaaatagtttcttggcctggtgaagtgcctcatgcctgtaatcccaacattttgggaggccaatgcgggaggattgcttgaggccaggaggtcgagaccagcctgggcaacatagagaaaccaccgtctctacaaaaaatttaaaaattagccaggtgtggtggcatgtgcttgtagttccagatactactgaggtgggaggtgggaggtgctgaggtgggaggatggcttgaggccaggagtttaaggctgcagtgagctatgattgcaccactgtactccagcctggatgacagagcaagaccttgtctcaaaaaagaaaaaaaaaattcccataatgttcagttagttctctttttcagacttttcctagaaatacccctcagaatttctagaggccacttccctgctattccttgttttctcagtccttaccagatacccaagcaattaacaatctttttgaactatttcagtacatttcaggatatttgaaattctgctgatggagctgaactgctgatacattaacacatgctgtcattattgactttgtaacagaggtcaagagagaaaagatgcatttttgaatagggaaaaacaaaactaaattatggggaaactaaggctcagagaggtcaagttgtcttgctcaaggtcacaaagccagtagtaagtaacagggccaggatttgaacccagactgtctggtttcagagtactctaaattgccaaaaaaagaaaactatttcaggcattattttatatttagcctagagcctacataatagatccgttaatataatcaattctaagctgtatattatattactgtgtttgaaatatttaagaaatattgtttaaaataagtgtattagctcttggacctctccaacataaggagttttccaggcagtagcactgtttgcagtaggacttacattattggaaaatattttatcctataatcaatctacatttattttacacctttcaccttaaaattaaaagtcgtggtagttattaatcaagaagcaaatctatataacgtggtctctcatatatccagtactgttcagcttgaacaaatgcaaatctaatttttaaatgtcccttgaagaattctgaggcaaagttaaacttcaagtattaaacagaatagccacagaaaactagtgtttctcagcctccctttgctttcaaatgccttaaaaatattttagaggcagacaataatctagaattgattcataaccaatattttacataacagaatgttacatgtattttcatattataaaaactatactttctttgattaatgctagtattctgaaaacatcgttagtgccagtaaatccactaaatctgtttgtatttactgccctctagtgataatggctctacatttgattaagaaaaaactattcctttcagtaaatgaaaacatctcttgtaagttttatggagatttgagattaagaggaactccaggctgcttttttaaaaccaaataatcatctgaacaagctgagaatcgttctctaaatgatcttattttaatttttttttaacaaaaaagtctcatttaaaatagtaaacacctgcaacatgtatggagaaaggaaaccatttttgctaagaggctccttgaagctgaaataacatgagactgatctgatagctgtatttatatttctcttctacatgggctaactctcttattagatgttagcatagtattctgtaattgttgatacagtttgaattcatatatggtagagacagagttttgtataactatttagtcaatttacctaaaaccagcagcagcagcatatctactacagacttttgtttcactgaagaataatcatgacaataaatgggtgcaaaaacttcacataaatgaagcctccacaaaaataatcttgtatgaaaaagtattgtctccttatagagaaaattaggatctccaattcacttaaattggcctaaatgaataccataatcatcataaaatagttactaatgtcccctctgtacttcgtggtatgctttgtggaaacaatttaaacaaagagaatatctgtctcctaaagtaataataactagtgtaaataggcatgcttccagaaatatataatcttttacacatatcactttaatatgtgcatcttaaaataattttaagtaataaaatttgagctataaaagagaaatgatattcttttcaacaaagaatgcttgaacaattgagcatccactcataaaacaagaaacttcaacctttatcctgcaccacactaacatctacttgaaatgaatcatagaactaaatgtaaaatctaaaactaaagaacttctagaagaaaacacagtagaaagtagttgtgatcttgcgttaggcaaagatttcttaaaccacaaaagcatgaagcataaaataaaaaatggtatactggactttaccaaatttctctttgaaaaaaactgttaagaaaacagaacaacaagccacagacttgagaagggaatatgtacaaaatgcatatcaaataaaggacttgtatccagaaattattttttaaaaaatctttacaacacaataagaggacaatccagtgaaaagatggtcaaaagatttgaacaaacaaacacttcataagaatcaaaaagatcaataagcatgtgaaaagatccatgaccatcattagacattagggaaacaaaaagtaaaaccacagtgagatgccacactacatacttactagaatgtataaaatacaaaatacaaacaatacaaaatgctggcctggatgcagagcaaattaaattctcatacattgctagtgagaatgcaaaatggtatagaaactttggaaaaaggtttgacagtttcttataaagttaaaaagtagagtgaccatatgacccagcaatcctacttctaagtatctacccatgagaaatgaaaacatatgtctatataaagacctatatgaaaatgtttatagcaactctctatagcagaaacccagaaacagttcagatatcagtcaactggtgaatgggtaaacaaattgtgtccataaaatgacatactggaaaaaaatgaaatactaaaaagcaataaaatgaaacaaattaccaatagatgcaataacacaaaatgtattataagtgaaacttataattcaactcaaaactcaaaagtattgtaagtgaaagaagccattcacaaaaggctatatctttaatgtattattcattctggcaaggcaaaaccatagggacaatcagcactggacgtggggtttggggaatgactataaaaagcaagagaaaactttttgggtggtataaatatcctatattatatagtacatatatattataattacacattacctatatatctagattatggtggtggttatccaattgtacacatttgtgaaaatgcattcaactatacctctagaaagagtaactcttatgtaaattatacctcaaaaatctaactttgaaaaatattagctgatgttatcaaattatttcaattccagatttgcttaactttacaactttgcccaaagataaatgcaaaacaaaaacctcaggcatagttatgtatgataaaacaccatttttaccctttcaaagagctccaccattatttcccagaaaacaggcatacagttatccaaggtccacattagctttaatgatacaacattcagtgaattcccagttgtgaaaagcctttaggttggcagggcgctgtggctcatgcctgtaatcctagcactttaggaggccgaggcaggcagattgcctgagctcaggagtttgagatcagcctcggcaatatggtgaaaccctgtctctactaaaaatacaaaaaattagcagggtgtggtggtgcactcatgtaatcccagctactcgggaggctgaggcaggagaattgcttgagcccgggaggcagaagttgcagtgagctgagatcgcgccactgcactccagccggggtgacagagattctgtctccaaaaataaaataataagagaagcctttaggtgataaaataatagtcaaagtattcttttaagtattattattttatttttttttaattctttgtaataaaaagttccataaagtaaaatattgtccttttttgttttatttttatttgtatcaattcaaggggacaggtgcagtttgttacctggacctgatttttaaataaatcaaactcagtttagttatttcatggtgatcctgggagactgtttgtcagtcatcatcgaatagcgaatgagtatcctttgtatgctcattctaggctgtaagtaccatgtcagctgatggagacacaaaaatccaataaagtaggtatagctgggggaggttccaagatggccaaataggaacagctccagtctactgctcccagcatgagtgatgcagaagacgggtgatttctgcatttccaactgagctttgaaaagagtagtggatctcccagcatgaagtttgagatctgagaatggacacactgcttcctcaagcgggtccctgacccccgagtagcctaactgggaggcacctcccagtaggggccaactgacacctcatacagccagatgcccctctgagatgaagcttccagaggaaggatcaggtagctacatttgccgttctgcaatatttgcggttcggcagcctctgctggtgatacccaggcaaacagggtctggagtggacctccagcaaactcgaacagacccacagctgagggtcctgactgttagaaggaaaactaacaaacagaaagggcatccacaccaaaaccccatatgtacgtcaccatcatcaaagaccaaaggtagataaaaccacaaagatggggagaaaccagagcagaaaagctgaaagttctaaaaatcagagctcctcttctcctccaaaggaatgcagctcctcaccagcaacggaacaaagctggacagagaatgactttgacaagctgagagaagaaggcttcagacgatgggtaataaacttttccgagctaaaggaggatgttcaaacccatcgcaaagaagctaaaaaccttgaaaaaagattagacaaatggctaactagaataaccagcatagagaagaccttaaatgacctgatggagctgaaaaccatggcatgagaactacatgatgcattcacaagtttcagtagccaattccatcaactggaagaaagggtatcagtgattgaagatgaaatgaatgaaatgaatgaaatgaagcaagaagagaagtttagagaaaaaagagtaaaaataaatgaacaaagcctccaagaaatatgggactatgtgaaaagaccaaatctacatctgattggtgtacctgaaagtgatgggagaatggaaccaagttggaaaacactctgcaggatattatccaggagaaattccccaacctagcaaggcaggccaacattcaaattccagaaatacagagaatgccacgaagatactcctcaagaagagcaactccaagacacataattgtcagattcaccaaagttgaaatgaaggaaaaaatgttaagggcagccagagagaaaggtcgggttacccacaaagggaagcccatcagacttacagctgatctctcagcagaaactctataagccagaagagagtgggggccaatattcaacattcttaaaggaaagaattttcaactcagaatttcatacccagccaaactaagcttcacaggtgaaggagaaataaaatcctttacagacaagcaaatgctgagattttgtcaccaccaggcctgccttacaagagctcctgaaggaagcactaaacatggaaaggaacaaccagtaccagctactgcaaaaacatgccaaattgtaaagaccatcaaggctaggaagaaactgcatcaactaatgggcaaaataaccagctaacatcataaagacaggatcaaattcccacataacaatattaaccttatatgtaaatgggctaaatgttccaattaaaaaacacagactagcaaattggataaagagtcaagacccatcagtgcgctgtattcaggagacccatctcacatgcagagagacacataggctcaaaataaagggatggaggaagatctaccaagcaaatagaaaacaaaaaaaagcaggggttgcaatcctagtctctgataaaacagactttaaaccaacaaagatcagaagagacaaagaaggccattacaaaatggtaaagggatcaattcaacaagaagagctaactatcctaaatatatatgcacccaatacaggagcacccagattcataaagcaagtccttagagacctactaagagacttagacttctacacaataataatgggagactttaacaccccactgtcaacattagacagatcaacgagacagaaaattaacaaggatatccaggaattgaactcagctctgcaacaagcggacctaatagacatctacagaactctccaccccaaatcaacagaacatacattcttctcagcaccacatcacagttattccaaaactgaccacatagttggaagtaaagcactcctcagcaaatgtaatagaacagaaattataacaaattttctctcagaccacagtgcaaagtagaagttgggattaagaaactcattcaaaaccactcaactacatggaaactgaacaacctgctcctgaatgactactgggtacataatgcgatgaaggcagaaataaagatgttctttgaaaccaatgagaacaaagacacaacatactagaatctctgtgacacatttaaagcagtgtgtagagggaaatttatagcactaagtgcccacaagagaaagcaggaaagatctaaaattgacaccctaacatcacaattaaacgaactagaaaagcaagagcaaatacattcaaaagctagcagaaggcaagaaataactaagatcagagcagaactgaaggagatagagacacaaaaaaaccttcaaaaaaatcaatgagtccaggagctggttttttgaaaagatcaacaaaattgatagaccactagcaagactaataaagaagaaatgagagaagaatcaaatagatgcaataaaaaatgataaaggggataccaccaccaatcccccagagatacaaactaccatcagagaataacacctctacacaaataaactagaaaatctagaagaaatggataaattcctggacacatgcaccctcccaagactaaatcaggaagaagttgaatccctgaatagaccaataacaggttctgaaattaaggcaataattaagagcctaccaaccaaaaaaagtccaggaccagacagattcacagctgaattctaccagaggtacaaagaggagttggtaacattccttctgaaactattccaatcaatagaaaaagagggaatcctccctaactcatttgatgaggccagcatcatcctgataccaatgcctggcggagacacaacaaaaaaaagagaattttagaccaacatccatgatgaacatcgatgcaaaaatccttaataaaatactggcaaaccaaatccagcagcacatcaaaaagcttgtccaccctaatcaagtgggcttcatccctgggatgcaaggctgcttcaacatatgcaaatcaataaacgtaatccatcatataaacagaaccaaagacaaaaaccacatgattatctcaatagatgcagaaaaggcctttgacaaaattcaacaggacttcatgctaaaaactctcaataaattcggtattgatgggatgtatctcaaaatagtaagagctatttatgacaaacccacagccaatatcatactgaatgggcaaaaactggaagcattccctttgaacactggcacaagacagggatgccttctctcaccgctcctattcaacatagtgttgaaagttctggccagggcaatcaggcaggagaaagaaacaaagggtattcaattaggaaaagaggaagtcaaattgtccctgtttgcagatgacatgattatatatttagaaaaccccatcatctcagcccaaaatctccttaagctgataaacaacttcagcaaagtctcaagatacaaaaccaatgtgcaaaaatcacaagcattcctatacaccaataacagacaaacagccaaatcatgagtgaacacccattcacaattacttcaaagagaataaaataccaaggaatccaacttacaagggatgtgaaggaccttttcagggagaattacaaaccactgctcaacaaaataaaagaggacacaaagcttatagataggaagaatcaatatcatgaaaatggccatactgcccaaggtaatttatagattcaatgccatccccatcaatctaccaatgactttcttcacagaattggaaaaactactttaaagttcatatggaaccaaaaaagagcccgcattgccaagacaatcctaagcaaaaagaacaaagctggaggcatcatgctacctgacttcaaactatactacaaggctacagtaaccaaaatagcatggtactggtacaagaacagagatataggccaatggaacagaatagagccctcagaaataataccacatgtctacaaccatctgatctttgacaaacctgacaaaaacaagaaatggggaaaggattccctatttaataaatggtgctgggaaaactggctagccatatgtagaaagctgaaactggatcccttccttacactttatacaaaaattaattcaagacggattaaagacttacatgttagtcctaaaaccataaaaaccctagaagaaaacctaagcaataccattcaggacataggcatgggcaaggacttcatgtctgaaacaccaaaagcaatggcaacaagagccaaaattgacaaatgggatctaattaaactaaagagcttctgcacagcaaaagaaactaccatcagagtgaacaggcaacctacagaatgggagaaaatttttgctatctatccatctgacaaagggctaatatccagaatctacaaagaacttaaacaaatttacaagaaaaaatcaaacaaccccatcaaaaagtgggtgaagtatatgaacagacacttctcaaaagaagacatttatgcagccaacagacacgtgaaaaaatgctcatcatgactggccatcagagaaatgcaaatcaaaaccacaatgagataccatctcacaccagttagaatggcaatcattaaaaagtcaggaaacaacaggtgctggagaggatgtgaagaaataggaacacttttacactgttggtgggactgtaaagtagttcaaccattgtggaagacagtgtggcaattcctcaaaggtctagaactagaaataccatttgacccagccatcccattactggatatatatccaaaggattataaatcatgctgctataaagacacattcacatgtatgtttactgcagcactattcaggatagcaaagacttggaaccaacccaaatgtccaccaatgatagactggattaagaaaatgtggcacatacacaccatggaatactatgcagccataaaaaaggatgagttcatcatgtcctttgtagggacatggatgaaactggaagccatcattctgagcaaactgttgcaaggacagaaaaccaaacaccgcatgttctcactcataggtgggaattgaacaatgagaacacttggacacaggatgggggaacatcacacactggggcctgttgtggggtgaggggagtgggagggatagcattaggagatatacctaatgtaaatgacgagttaatgggtgcagcacaccaacatggcacatgtatacatatgtaacaaacctgcacattgtgcacatgtaccctagaacttaaagtgtaataaaaaaattaaaaaagtagatagtcccaaccgctgtattctttttgaatccttttgccactgtttcatatcacagtttttttttttttctgagccctagattatcagtctgttctttttttttttttttttttttaatgtagtccataggaatctgctgcctcacggtcagtatcgtgccccttaccccaattctaatatgacaggtttttgtctaagacagcatttcctagaatgtgttgtaatgtacagcagcttcatgtgataattctcaaagactcccactgtcaaatgttagcatattcaaggctctgccaggacctgtaatacatattctttctttattctgtttaacttagcatttctgaaacctatcttactactgaactcttgacatttattaacaaacaaatacaaacgaaaataccagggttccaagtaaaattcttatataaagcaaagggctttaaacatcagagttttttagaatggttattcactcatgcactcaacaaacacttattacatagtatgtgccagcataggggatacagtaataaacaaaacagacaagttccctgttcatgtaaaccttggacttatggggcaaaaagacaataaacaagcagacaaaaaaaaattacaaacactctcaatgaaggaaaagagggtaacatcgtacattgatgggggactataaaattaagtagtaaggaaaagctgcacttgagaaggtggtatttgggaagagactcgaatgcctagaataagccaaccagatttggggcacagcactctcaacaaaggctgagtaacacagccagtctgagggaggacaggtctacggaatgagagccgaggcaagtcaaggcaacatcacgtgggtcctgagggtatgagccttccagagggtgtgaggataccattagaaggttctgagcagggaatgataggatgtgatttacattttgtaaagctgtctctgtagaggatagtttgtaaaagtgcttgaggcaaaactgacaagacttgaagacttgcacaacagaactgaagaaatgagaagaatcaactcctagacttctgggatgatcaatgtctaggatggacattggtgccatttgcaagatggagaagaccgggggaggtacggatttaaaggagggtatgtaaggagaaagaagaatcctatgagacaagaccagaacatgtaaatacatgaagttttggatttcttactcttcaaagacattttacctcctgtccccgaagttcttcacagagttcaggataagaaaagctgccagacagttgagttttgaataagtagtaactttcaaacacttgaaagacattatattagaatagactacatccatcaaaatacttaaaaatgtttttagaatagtccaataatttggaatatgaaagcctaagaaacttccttatccaaggccgcataatataaccaaaattagaatttagtactcctagttggcaatatttttatgaaattactgttttactaagacattttagaaatgaagactttactgaaggcaataataagtgcaattaaaagtggtacaataataagacttctttttcatttgcaacaggttagtagtgtatgagaattatgagatgtaaaatagtgtagagcataggcttctctagttggcttcatgtgagttcgaatcttggccctgcctctcttaccagcaatgaaatatgcagcattttacttaaggatactgggttgtatggagagaatcagagttaaggttggtgatccagcagtgtcatgtgtcaggagctaataaattgtattgtgaccagaaacactgaaacttgttataaggaaagcaatctaattaaaacagctgcattaaaatttctacaatatcttcctaacagcttatgctatcaacagtttgtaaactatcagaatcacggatactggctgagaatgcttttggagatttcaaattggcataattttctcagaatgcactgatctgacaaatgtacagacaggcagacaggaatactaccactcttcatgaataactgtctgcctctcctggatttcttccatgttgtgtaagtctattacactttgggtgaatgtagctttagtacattgagttaatatcattcttgcaaagaagctctttataaattccttaaacttaatttgactctggacacaaacaaatgagaacaaaatacagctcaaggattaagatccttaaccaaatatgtaaaaaacacgaaaagccttacaaacagtgatcaacagttaaacatgcgctatcaccttcccctaacagctagggaagcatgtatatgaatggaacatatgaacttccatttggtgtactaagaaaacacatcacgcagatggcttttatagcttcccaaataaggttctaataattcacaaaagtgttgttccctaaaacccataataaacaataataaaacctaatgtttattgagggtctactatgtgtcaaggagagtcctatgtactctcctggaattacttcatttatttctaataataacctttaatgagcactgtcactcccgtttcacagatgagccttaaggtcttagctatcaactttgcagacaacacccaagtaaaatcctgccccctctttttttttttttttttaaccagaaatccagtcctgacaactgaaagcttatagggcatttccgcttagatacatagccttacctaaattatatgtctaaaaacttaactgtcatattgtccagccctcccccaatacccaactggcttctcttcatgattttccaactataattctgtccattattcaggtttagaatttcatgctttcttctggctgtggtcctgccaagtcttatgtatgctgtcacccttctctgtgcaatctttctcctactcattcctctcttttcatcactatcctatttcaggcccttatcactcttacacctaattccctaacggtttcttcttgctttcagtacaatttccccttgatataatctatcctgcacactaccaccagatataaccttctaaagtcaccttattttagtttcttcataatattttccttatagtcaaatgtaagggttcttcatgaattataggacaatgtgcaaatggcttgacctggcatttaagacagtctgcagtatggcctcaatctacatttctcacacctgccactggtcctataatcacatcctctgttccagagaggctcactcctccagaatgcccactaccctcctctccagcaaacatacaataaagcgaatccacatgaataccccatcctaccctgccttatccagcccctggaataccacctcttccctattagatgcctatataaatcctcagtattcaagatccagcttaaggagcactttttctgggaccaatcattctggtcctctgtattgaatactcgaactcctctacaggacaggaacataatgtattattaccctatcattcattaacacacaacaggcttacattatatggctggttgtattttcagaggtatgtctatatgtttcgctatctatctatctatctatctatctatctatctatctatctatgtgtttgaatacagatacataaaaatctcatttcacctataagaacctctggagcagatacatgtcatacaataattgggctaaaacaaaaatccctcagtgaaaacctaaagactgggttgtggttgtttgcagccaaaacgtacaaaatgaaaacctcctaacgatttattttccacatgaaattagtaccagatctagagaaaaatggacaaggatcaaatacaaataataaagtcatcaccaaactaaaaatttcattcaaaagtgatgatgttggccgggtgtggtgactcacacctgtaatcccagcactttggaaagctgaggtgggcagatcacttgaggccaggagtttgagaccagcctggccaacatggtgaaaccccatctctactaaaaacacaaaaaacagctgggcgtggtcatgcacctgttatacccactactcaggaggctgaggcaggagaatcacttgaatccaggaggtggaggtggcagtgagccgagattgtgctactgcactccagcttgggcaacagagcaagactccgtctcagaaaattaaaaaaaaaaaagtgatgatgtcagtaaagacccaaatcagggtcatatgtttaacaccagaaagtttgtatttgctacaagacagaaaccttgacaaaataacttttctgtgctttgttacttcatctgaatgaagaaggtaaaccagttgatctcacaaatctctttctaagggcttctggaatttttttttttttttaaacaataaaaggaaagagacttctcttaagcagaacaaagtccgactcctctgtaaagtggctgacagcaagtggaaaatggaagaagaacaattacctgcaaaatgactcattcccttgtaacaactacactactagggaattccttctcttaccggctgtggctagcgtcagactcatgacaaagacctcatcctggggctagaactaggtttagggttttctcattcattcctctgtttctcagctgcattttcatttttaatctgtgcaatgattacagaggcctatgtttggttttcatttctagtttccccaggaagagacaactactatcttgatattgattaacacttgaaacttctgttaatcacaatttcagtatttcagggaatcagagaaatcatttggaagagccttgaaggtcatccagggtgagagaaaagcaaagcacaagcaacagaccaatgtttagacacagtgaagtgaagacctacaggagaccctctcaacttcaataagagtcttttttatggctgtcttcatattctttcaaagaaatcataataaaggagttagtgagagtgtaaataaaaaataggctatcatagagtgctgggtaactgagctaaaactaaagtaaacaaactcagtgggccatcacatatgcaagctggtaaggtctcataaatcaccatgactgggtattgggatttcaaaggcacactctgtaagctttctcccagccctgttgattcaagctccaattgcactgggttacttatatggcagcatataaagttgaccttttatgtttaaaaatagttccattcctcatccctcctaaggataggccacagtacctatcatatgtccccaccacactacataatttatgtaagttttcacttaattttcaacacaatcctttgaggtagattatgttagtcctgatttacagggaaaacagaggctcagggaggccaaatttatttatttatccaaggttgcaactctactgtagggcagatttatatccagaagaggaattgcaaagctcctcagaatttaggagatttaaaatggaatcaagataaaggttcacatttttcatcttctattccattttactcttccagcatctaataataacctatgatatattagaacaaatcagcccatacttattttgacagtctcttttcaccccatttcagtttgtaccttgctgtctcagagcccatcaaccacctttcctcactcccaggcagccggtccttcaggggatggcttggcagttggcccaccatcctctgctaccagggcatgactcatggaggcaacaggtgaagctgacgccaactattagtgctaaaaaagactcaagcctcatgaaatataccatccataaatcgctctccagtcagctctacccctccctccatttctacagctgactgtctgttcttccttaaacatttacatccgccactgacctgtctgggatttcttttttacttcaaggttctcctaaaggttcagtccaaccaggtttcaccaaatgaaccctgcggtggaaaggggcagcaacgggcattggtcagtttgcctccagccaaggaaagtctgactcccctccttctcccactcttctctttctctgcctcacactgcctaatacgtctttcctctttctctctttctttccttatatcttcattttccaccctattcagaagtgaaacttcccttgccactttgcccccactaagaaaacagacctccaacacaacctcttaacaggctaattttaaaatcatgaacctgcttacaccttccgtgagtttatcctatatcttctctatctgctgtctgcttcccactaaggttttatccctccatcccacctccaaatcctttacagctcagattctcagatctgctttagtcacttggtctcctcatcccactgaccctattatccttctgtgcacatgttagagggcacatgctcctcctaggaactagggccaggtcagttatgctcccatcctgacatgacctagagaacaaaaaaggcaaaacgaggtactgtaggattcctctctaggaattatactttgctgaaattgctcttgctattttggaatctagtgctcactaaatacatttttaaaatattatttggatatattttgaaaatacaaccagaggtcgggcacagtggcttacgcctgtaatcccaacactttggcgggccaaggtgggcagattacgaggtcaggagttcgagaccagcctggccaacatagtgaaaccctgtctctactaaaaatacaaaaaattagccaggcgtggtggcaggcgcctgtaatcccagctgcttgggaagctgaggcaggagaattgcttgaacctgggaggagaaggttgcagtgagcctagatcacgccattgcactccagtccaggcaacagtgcaagactctaactcaaggaaaaaaaaaaaagagagagagagagaaaatacaaccagagaataaacacttgttcttctatctctccatcttccccaccaatacaacatccagaaaatagtcatctttacacttatttagaagcacatagatcttataaaagtttaactgagcattaggttttcatctttaaaaatattctgaggctgggtgcactggctcatgcactttgggaggccaaggcaggaggatcacttgagcccaggagtttgagaccagcctgggtaacatagtgagaccctgtctctacaaaaaaaaaaaaaaaaagttaaattaaattaaaaaacagaaaagccggtctggtggcacatgcctgtggctccatccactcaggaggctgaggtgggaggatggcttgagccagggagatcaaggctgcagtaagccatgatggcgccactgcactccagcctggttgacaaggtgagaacttgtctccaaaaacaaaacaaaacaaaaaacgttttgacatgtagaatactgtttctgggactaaattagagatttaaggtttgaggtatgagaaaatacctggaatcatgccttacattagaaggtaaggtaaatactggtgtttcccaatgagttgtagtcagattgttcatatgtatcaaacagacaatatactgaaatatttaaaaataaggctaaatagcaacaaataatttttcccatgaattctactttttttttttttttttttgagatggagtctcactcagtcgcccagactggagtgcagtggcgccatctccattcactgcaacctctacctcctgggttcaagtgattctcctgctcagcctcccgagtagctgagataacagacatgcaccaccacacctggctaatttttgtatttttagtacaggccaggttttgccatgttggccaggctggtctcaaacttctggcctcatgtgatcgacctcccaaagtgctgggattacaggtgtgagccaccatgcccagctgaattctacttttttttttttttttttgagacagagtcttgctctgtcacccaggctggagtgcagtggcacgatcttggctcactgcaacctctgcctcctgggttcaagtgattctcctgctcagcctcccgagtagctgagattacagacatgcaccatcacacctggctaatttttgtatttttaggagagacgggatttcaccatgttggccagctagtctctaactcctgaccgcgtgatctgctctcctctgcctcccaaagtgctgggattacaggcttgaggcaccacgcccggctgctgaaattctacttttgaaagaacaaattccccttctgtagggactgatgattcagtctgtaatgatgcattctcttcatcttctttttttgtcttttcttctatatatcctttaggcattctactgtattaacactagatagaaaaattaagatttaggcccaaacattatcttctggcataaagtaaactaatcgtttcctgatgtacaataaataaacagacatatttctagtagaagattccttatgatttatcaaaacccaattatcacttacccttatggagatcttagatcttagaaaccatactgacaatataagattaagaaaacaacagaaaatcaaaatatataccaaggataatgttaataggtttcatccttatcacagcatactgttgaaacttacttgaaatatttttttaaaaaagatacaagaggacaagtgtttagtttttaacaagggaggggactagtcaacaaatattgattacctaatttatgaacagctctggccaaagtggtcaaaaaaaaaaaattaggactttagttttcctaaacctatcttaatttttaacaggattatagctttgttcaatctttacagtctttagcctcttttgtgaaatgggtttccttgtaaataataaaatgacacctatatatatttaaagcactcatgaaataattttatctctttattaaaaactgtgataacccttccaattttgaaatttattgtcttcctaaattcttgctacaaagcctatcattaatattgcagttcattttttccctaaagattgaaaaaaacactaacaaatataaagtctttatggtcaaagaatgtactccttttataaaacttggagttgatgtaaaggcacagacaacacaagttaccttaataataaatgcacttttctttgtaattttgggtaattcagtgtgatttgtaattcttttaaaagacacacaatcacttgtatttttgcatggttctttttttcctaatttcccactatagtgaaatatctgtttttccttctctattgggtttggattggaatgatcaggtagaattaaatgtaaaataacaaaaggaaaatactttatagatcttctcaaaatactttgaagggtataatctctttaagatggctttattcatatttaagccaaaaacaaaaagcaaccaaaacactactgtttatacaaaaagcagcttcaaaatcagccagttattttctgaaatggagatggcagacattagcctgcacttactccaatatggcagccgcatctttgcctctttgctatggacacatccccagcaggcctgtactttctactctccagacctgtttatgacaggccaaggtgtttcctattatggtgcctatggctgcacagtgcactgcttgtcagtaataaaagccagaggctgtccctatagggattacagtgcagcagaccagagatgctgatgggaatgcaagcatgccctaggcaaacattgcagaatactctctgacaggcaaaagccaacaaacacatcctttcttcccagactagcagggaaagtattcagttatgtcattttcacttggaacaaactaataagaagaatgttattgctaaaataggtagagatgagaaagagcagtttatgaccatgaatatggcctctatggtttttgcctgtgcactacaaacttttaatttaaacgagatgagattgatctagcatatactatgataaaatttctgagacatgagtatctaaaagcagaactgagattaagtgagaaatgctcaggattcctgtcactgaaagaaaaagaaaaaaacctttcttgaaaggcacaaagtagaatgctcagactctccatctaccaatacaaggtaaaaaacagcatttgcattaaccaacatcatgcattcttgtactaatttatgtgactaactacaaaatgttatattgacactcactgtgtagggtgtcaggatggccaagtggtctaaggcaccagacactcactgggttgggctaaaaacaccgtagaagacctcatcagaacaataaaacagagacacaaaatattgtactaagagttaagagaattacaaataaaagttctgtggaaagtcaaaggtatccaattaggaaagcctgaggtgggagacataggacaccccagatataggatgggaagaagatgggattaaaaaaaaaggctttataaaggatgtaacattccagataggccttaaaagatggcttcgatcttttaaataaaactttttgttttagaacagatctagatttacagaaaacttgtgtagacattacagataattcctatatactctacactgtttcccatttttaatgtctgactttagtatggcacatttgtcacaattattgaaccaatactgatacattattattaaacaaagtccacacttcattcagatttccttagttttcacgtaatttccttttttctgttctggatcccatccaggataccacataatatttagtcctcatgtctcctgaggctcttcttggctgtaggtatctcaggttttccttgtttttgataaccttgacagttttgaggagtactggtcaaatactggtcaagtttcgagggtagaatatccctcaactgagatctgtctggtatttgcctcatgattacactggggttatatgttttcagtagggaaaccacagattaaaagtgccattttcatcagatcatatcgagggtacatgttatcacttatcactgtcaatgttgaccttgataacctggctgaagtagtgataggtttctccactacagtttcttttttttccctttctacactgtactgtttagaaggaagtcaatatgcacagctcacacttacggtgtagggggttatgttctccctccttgagagtagagtatctatagaagttattgggaattccgcacaggaggagatttgtctattttcccccacttaggtatttatttaataaattgtatcaatatgggtttatggatatttattttaccctttgggatataatccaatactatattattttcttgctcaaattgttctagctttggccattgggagctctttcagtttgctcttgcaactcttcagtatattcccacgggtgtagggttccatttgtttgagcaggtccttactttttggcactacaagatgctccaggctcatcttacatatttccttcctgagtccctagaaatcagctattttttttcaaagagtcttggttccttttaccagagaatggtattagaaaccaaaatgagggtgctaagtgtgctcattgctactggggtatggtagcttctagaccctctcggctgatagagcaaggaaatatttgtgtgtatactagatggtaagatgttgagaggtagaatggagagttaccttcttaatatacttttcttaatattaaatattaataagatattgtgtgcctgggttactttcagtcttatgcagaggaagaacgtatgtacattcatttatgaaaaacactggctagactattcttctgcactgcattatgcatttctgctagaaaaagctcagagattttcagatattctgacaaaaatctcaggcttgcttgatgagctatactgtaaaattacagaaggaaacaaagggcaaactccttgaaggatgaaaataaaggaataaaacatataaaacaccaccaaaaaaagtgattaatgggggagaagagtaaataaaacattataatagtcctctttggttagtatcaatattattaggtcactttatcaaaaggatagaaatcaggatggcagacacccttctctaaccctcaccccccaaaataataaaataaaaactaatgttattccttcacatatggaaatgaatgagttctactgagtatctagtatgattcctgactcagtcgagacaattcccatcttttaattcattaaatcaccacagcaactatttaacagatgagaaaactgaagcacagaaggcaacgtggcccaatttacgtttggtaaaaggcagagaatgaatccaattcaggcaggctgtctatagtagggtgctctaaatccacggaccattctgcctaaggaatgaatattttatgaattggaatatttctgctgaacgaatttgccattttctcctctagtggagaaatccaactgagggtaaagaaggaaaaatgttgattgtttaaaacaataaattagtctctaaattgttcttgcagctgatttagactagtgtgtccaaaagtatgcccagtgttagtaaatggtaggcaaaatgctttaaggtggtgcaagatgaatgttttctcattttgttattcattaattttagaaaaaatacagaaaaaatataacttgaacatcaaacctatgatttcatgtataccattacttaagatgaggcacttgggtgagtatttagatttaacaataagttgctcttagcatttctatactttgacaataaattatccaaaaaagaaattaagaaaataatcccatttgcaatagcatcaaaaaaatacttaggagcagccaggcgtggtggctcactcctgtaatcccagcactttgggaggccgaggcgggcagatcatgaggtcaggagatcgagaccatcctggctaacacagtgaaaccccatctctacttaaaaatacaaaaaaaaaaaaaggcaggtgtggtggcaggcgcctgtagtcccagctaattgggaggctgaggcaggagaacggcgtgaacctgggaggtggagcttgcagtaagccgagatcgcgccactgcactctagcctgggcaacagagcgagactccatcacaaaaaaaaaaaaaaaaaaaaacttaggagcaaatctaaccaacaaggtgaaagatctatacactggaaactacaagacattgatttaaacaactgaagaagacagaaataaatgaaaagatatcccatgttcatgcactgaaagaattagtaatgttaaaatgtccacactatccaaagccatctatagattcaatgcagttcctctattgattcaatgcaattcctttcaaaattccaatgtctttttttttcacagaaatagagaaaaaaatcttaaaatttatatgaaccaaaaaaagacctaatagccaaagcaatcttgaacaaaaagaacaaagctgcaggcatcatattccctcatttcaaaatatattataaagctactgtaatcaaaacagcatgttattgacataaaaacaaacatcaaccaatggaacaggatagaaagcccagaagtaaatccaagtatttacagtcaattgatttttgacaaagggtccaagaacacacaatggagagaggacagtctcttcaaatagtgttgggaaaactggatgtccacctgcagaagaaagaaactgtactcttatctcacactccatataaaaatcaactcaaaagagatataaaggcttaaacataagacctgaaactgtaaagctactagaagaaaatataagggaaaatctccacaacaatggtctgggcaatgatttcttggataggactccaaaagcacaggcaactaaaacaaaaatagacaaataggactacattaaactaaaaagtacctgcacaagcaaccaaataatagagtgaaaagacaacccatggatcaggagaaaatatctgcaaaccatacatctgataagaggctaatattcaaaatatataaaaaattcaaacaaccaaatagtaagaaaacaaatcgattaaaattagacaaaggatctgaatagacacactttcctcaaaaaagaaatatgaatggccaacagagatacaaaaaaaaaaaaaaaaaaaaaaaacaatgttccccagccctgcacagtggctcatgcctgtaatcccagtgctttgggaggctgaggcaggagatcacttgaggccaggaattctagacaagcctgggcaaaatagcaagaccctctctatacgaaaaaataaaaagccaggtatggtggcacacacctgtagtcctggctacttgggaggctgaggcaggatcattgagcccgagaatttgaggttacagtgagacatgatcacgccactgcactccagcctgaacaaaagagcaagaccctgtctcaaaaacaaacgaaaactcaacaatatctctaattctcagggaaatgcaattaaaaccacaatgagctatcacctcatgcctgttagaatgactattttccttttttttctcttcaacttttaagttcaggggtacatgtgcaggatgtgcaggatgtgcaggtttgttacataggtaaacatgtgccatgtttgcttcacgtatcatcccatcacctaggcactaagcccagcatccactagccattcttcctgatgctctccctgcacccatcccacccgccaacagaccccagtatgtgttgctctccaccatgtacaatggctatgttcaaacagatgaatgataacaagtgttggcaaggatgtggagaaaagggagcccttctacactgttggtgggaatgtaaattagaaccaccattattgaaaatagtatgaaggttcctcaaaaatctaaaaatagaactaccataaaatccaacaatcctacttctaggtatacacccaaaggaactgaaattggtacatcaaaaagatatttgcactcccatattcatttcagctttatttacaacagccaagatatggaagcaatctaagtgttcatcaagtgtgcataaagaaaatgtgatatatatatatatatatatatatatatattatatatatatatatatatatatagattatacaggccgggcgcagtggctcagatctgtaatcccagcactttgggaggccgaggcgggccgatcacaaggtcaggagatcgagaccatcctggctaacatagtaaaaccccatctctacttaaaaatacaaaaaattagtggggcgtggtagcgggcgcctgtagtcccagctactcaggaggctgaggcaggagaatggcatgaacctgggaggcggagcttgcagtgagccgagatcacaccactgcactccagcctgggctacaaagcgagactccacctcaaaaaaaaaaaaaaaaaaaaaaaaaaaagattacacagccttataaaagaaagaaattctgtcattcacaacatcatggaatggaactacaggacattatgctaagtgagataagtcaggcacagaaagacaaatattgtctttaataaatgatctcactttatggggaatctagaaaagtcgatctcagaaacagagagtagaaaggtgggttaccagaggctgtagaggaggagggagagagaaatggaagatgtcgatcaaacagtacaaaatttcagttagattggaggaataagttttagtgatctattgcactgcatggagaccccagtaattaataacgtattatatgttttacaatttctaaaatagatttttgacattctcatcacaaaaagataaattggtgaggtaatatagatatgttaattagctttactaaatctttctatgatgtacacattttaaaaatcacattatacccaagaaatagatacaattaatatttgtcaattaagaataattgacaaataaattttaaagattaataaaaaatacattaagttaaaacattcaacatataatagcagatatgaatgtacacagaaatgacaaaatcccagcactgtgggaggccgaggagggaggatcacgaggtcaagagatcgagaccatcctggccaacatggtgaaaccccatctctactcaaaatacaaaaattagctgggcatggtggcatgcgcctgtagtccagctactcgggaggctgaggcaggagaattgcttgaacttgggaggcggaggttgcagtgagctgagatcgtatcactgtactccagcctggcgacagagcgagactctgtctcaaaaatgacaaagtttgagcaacattaatttggactgtaaattcttaaagaatagaaaagtcatgtttttcttctaagaaatattatgtttttacattgcaagaaatatgtgacacagagtttttcttaatctctcttttttagtatattctagacaggcaagcacatgcaatttattgagcacccagtgtgtgctaatgcaccaaacggagctttacatacattatagctaatggtctcaataactttttcattttattttcccctttcattatcgccacttataaatgaaaaaactgagctccagagcggtaaggcctattgcccaaaatattagataggaaacaacagagctggaatttgaaaccaagtttgcctaatgaaaaacatttatgttcttttcactgtacaaagctgctgtaagtatcactggtgcctactccaggccagggagtaaatatcattcatccttatcacatacaaagtataacaaaacaaaaacaagaagctctgaatactaaataataataataaatactttataaaagataaactattctctaagagtaaaagataataaacctattgtcattgtagttggtcactgaacttaactaatttcctaatggacgcagcagaattgtttgttgtttaagcaaatatcaaggcataccccccaatccctgttacagggaataaaaaaagtcttcttcaaatgcctttcaaaactaatgtgaatattaaaataaagtgctactgatctctctacattctagaaagatctcagactaacagtgtcaattaaactattacaacaaatagccatgtaaaaactgctcccctactagagctacgctatcacaaaattaaccccagcaatctacagttctagaaaaagagttggtccctcctgctgaaaaagagaaaaccaaaccctacatattttgtgaatccactgaaaataatgacataaacagcactgcacatccatcatgtatttatatcttaagtgatagctacagtctatgtaactatcgcagaaatcttcttaaactgaacaaaagcattatctatcatcctttctctctagaaaaataccagtttgtttaatctacccataacattagaaaaaatacttcttttatcatgggcaatccttatgtttcggaatttttttcgaaaacgtagacagttcataatgctctcagacagaagttaccactactaccccaaatattaagtcaaaatgtaactgaaaaaaagaaatttatctagtaatgattaatttattgaataattaaaaattaggagtttttgataattaaatgttgggaataattaaactttcactaaatactggcacaggaactgaacggatgacaacagagacaagttaagatttgttttaatcctaagttttatgctaaggtaacatcaagggctctacttttcagtgaaagaaaaatttcctttaaaattgtttccctcttccattattacttaaaagcaaagaaagtattttttctaacagtgattataggattctcaatctttcatattaactttaaggtactacatgtaagctacataaatctttcccaaatctacctttattgagtagatgaaaaagcagatatcgaactcaaaacatctaaatgttgattttctataattatagaagatattttcttttgaaatttaaagtttgtatttaggcatattaacacttttttaatctaagatttaatatgttaatgtagaaaacaactgaggctgttttctctctataaaactaacatgccttttccaattaacttagtttccttcttagcaaaagtttaacatttatatctgttgagttacactgtagttgcataatgtggaaatatcttaagatttagccacttctatgaagatcctatatttgttataacacccctcttgcccagaagaaaatacatcaacaaaaagtcctactatatgttctgcattgactattacaaagcagtagggggagcagccagagaaagctctgagacaaagcacccagcaaagcaatttaatttataggcaacagaaacatgctagagaggtttgccaaaagccaaatacacaaaataaattccataaagaagtcatgaccacatttgtaaagctggcctaagtatatttggaatgaagtatagaaaaatctgaagtctcttagaaagggtctggattctaacttcaagacagactttcagcttgaaacacagtcatttccagccatgccaaacctcaaactgcccccaaaattagagcagaaacaaaatacatttttatagtgatatgtcttgggaataactcaaaatgatttcgttttctcctttgaacctcactgaacttacagggaaggcctggtgaaatgtgcattattaggtcacaagaggataacgttacagggttccatagcataatccttgaaagccctgaggcccaggccgctgtcctgctctcctctctactgactcccatcctcaatatactttccatgagagaaaggtaaccaaaaacatggtgaaactattctgcttaaaaggtgttttactgaaaaggcacattgaccactaacccttattacatttcacatgttctaaaaattagtaaggtctgcattttcagttttagagtaaaacaggaaaagtacttagttagctcttctgtctggcattctgtaactggaatttaagaaaagcctaaacttctaattagaacttcagaatgttcatgtctgtattataccacaaaaactgtaaatataatttaagcatttttatgatacagaaatgtgcgctatagacagttatctaagaattataaaaatccatcaaacttgaagtgtctggtataaattacaaccgaatggtaaaaagacattttagccacgtaggcaaccaatgaagtttgacctaaaacccaaataatagcaataacaacagatacagtgcctactattgtcagatactatattagctagctcttttgtatatattctttggaactcttacactgacttttcaagatagttattatggtgcccattgtatgctaaggaaactgaagctaaaaaaaattgaagtcatttctctaatgtaactccattagcaagaaacaaaaccataattcaacttccaggtttgcctgcctccaaagctttgagacctcactaaaattaccctcaattgtagcaatgaggttccaaaggaaatctgtacaaatctcaggcagattaatgtgcttataagggtaaatgccatagatttaatcactcaaattaaatgccatctggaatctcttaccctacttggtacaagcatcctacatgtgttacagccaaccctagccttggccaagaattcaataattttcctgcttcaatgccatcaacaagcaagaaacatatataataccaatacaggaaatacagctagttgctcctagagcatcatttaaaagctgctaattggctaagatgccttttattgagaagtctaagaaacagaaataatgtgttaacccagtttgttaaatgggtttgaggaatcagtttcctccttcctaatacctaaatccatctccataataagtattctctatcaccatttaaaaatcctgatctcttactagtgtttttattgtgcttttcaatctattagagtaaattttttaaaacctcaagagagaacacagaaaactgtcataatttttcaaaggctaaaggagaataaactgaaaatatcagtttgaacacgtgtatgtaaaaagaatggatggtaataaaactaacaactgaaaagcaatgtttctgactcattcattcatactcaagaaatatcaaataactgagtggagatgatgcaagctgtacacatttccagttcagactgaaggtgtggcaacactcacaggggccttccgatcagctgctccaactcagtttacagcttttgtggatgtggcttattcatgcccttgttatgaagaagaagggtaactttacaacctttagcaagagcttttttttctttctgtgctaacccttttttgtctataacagtcatgtaagcttagcactgatttagaaataaataagttaaagaagacacgaatggcttggacattaaaagtttaagcaacagcttaagctgagctaagtttaatgttaaaaattagtgtgacagcaataatttttcaattcagctctgtcgtgggctaggaaaaaatatcctaatttttcagccacaagacataaacattgctagaatgactacattttgaaaaaattatcttctcactttacctagatttcattttaaccaaacagaccaacctctcctattaaacctgtaaattaactcaaagtctaatctggggccttcataataaagattttttttttaaatccctgtcttatctggtgcctttaaaagaaaggaatcattttaggcaattattatgacctaaaaaatttttaaatcttaacgtatagattaattccttgacagctgaagtcatttacaatacattattaaatttcacattcagttttaaatccaaacatagatctcaacattaagaatatggattttagggaaagtaactagctgctcaaattcatttagctgaaaaactactgtcgaatcaccttgaaaatatacactaatgcttgcacattgctaagtggcttttgattctgctcttcattttcttacacagaatcaaccacacaatagaattaagaactcaggcccatggcaaagtgctcccatttagcagttaggacactggacatattcagcatatgtctactgctattgagaatcaaattatgaaaacaaactatattttataaaactaagaatttgttactcagatgagaataaaggtgcctaatgctacagcagggggtaaaagtcccagtaagagagcaataattggtcattctgatgaggagctgtgccaaatttagaaatgaggcacaaatgacaaaaaaattgatcatcagtgtggacatgggtaggtcagtgtgcatatgggtaggttagtatctgctggccgtgtctacagagccccttttatttatttgaagccaacttttcacttgacaatgctacctacaaaagcactgttaatagataagacaatcaagtggctgttatgccgtggcctttttgtaaaaactgcatgagaacaggtgggataaaaaccatagaaaggtagaaaaaaaaaagcatcactcatttaaagatatgtgcacatagatgaactgtaagataatataaccttcttgaccttgtaaataggtggccaaaaatacttaaatatcttgacgaggcaactattactaattgtctcacaacattaccagtccttactggctgaatccttcagccatctgcatacgacatgcacaggcaaatagccactaaaaacatacacaattccaattatctccttgcataactaaagacaaaaagaacaggaaatccaaaaaatacagcaaaactgaaaacactataccttgccttccgtgctattttaaggctgtcccaggctgaaggttacttctcagccctcaaaactccattaactgccaagaccagcaccttagcacatatggcacagatgcctagttgaagcctccttgtactaaatgacctcaaaaaactgggctttctttccaagattaatggaaacaaaagtaatgatcataaggaaccttctaactctgttaatgtttcctgcggatatgtatggccaactgaatatataaaggctcagttcttgcggggtaccctgacaactagatgaattagggtgaaggttccaagttcgatgaactcttctgagtttgagtgccctaggtggtgacattcaagtgatttcacagacatccaccaattcttattttcaaccgggaatcccaagaacacctttaaacatgcaatgcccatggaccctactgggtttctgctgcaagggctcagtgttacttaggaaccctgtgtcttgggagatacttaaatttagcacgtcaaattgcttttggaaaatgtttatctggcgtgactaggggaggcaaagcaaggaaacaggaacctccctctaaggagcagaatagccaacatgcagtaagcctaaaaaacctctcaatttatttcccggggctatgggtaccagtggctcgccggcatgggaatcagcagcctgggggcaccagtgacagcagaaccggggcttaccttgttggaggccatctcactgacggagtgcctggtctgtagggtctctagctggtccagacaccagtccagctcctccagggtctcgctggccagtttctggtaggcctcctctgcgaagagacagggaaagggggactcagttctcaagcgcttcacgggtccgctagcgagttcaaagggggccatcctgccataccccgccatgctcggatgcccggtgccggcacatgagggctgctccttcatattgcccagcccggcagtgcaacgggggcggaggctgtgctcgcggggcggccggcctcggggaggcacggtctctccagcttggcgtctcgggtcggcctccagggagggcgtgcaaagagcggcgagccaactttcacacagcgacgcgagcggaaaaaccactatgcgacttttcaactgtgcggcgggcccgagtcccagtccaggagcccggctctagcggatggcgagggggtggcgagcgcgcttgggtgcccgccccgcagaggagcgtctggtccacagccggatctcctcggtccccaacccggagccgcggccccacgcccgccccgcctgccgagccttctgcacggcacttgaagtgaatgaatcagccgcggccgggtgcgcggccaccacgtttcctgttttctttctcaactcctcgggcggcaggcgcagcgcggctccaacgccgcagctttccgggaacactccccctcacgcccctctcggccctcggcgctgcctggctcctcctcaacccccttacgaaaagattccgaattgcaaaagcctgtccctgtccgtgccacccgccgcgtccttcccctcgagctctgccccgggggccccgccacctcgcagtgccatccccccggcgcagccgggcgccactcgctttgaagtgcagacgaggaggcgcgggcgcgagcgtgtgtgtctgtggggctgctgtgggactgtctgtgctaggagagcggcggaaaacccggcgtggagcgcctgcagtccgccgtccggggtcgcgcccgccgcggggctcaggagggaccggcacgcaggcgcgcacggccgcgcacctgtctcgctagaaccccgcgcgccccgccgagccactgccctccaggttgcccagaccgctggagcctctgcgactccacgaccggctgcttcctgcgaagtttcacaaacaaggttatttaggaccctcaaggtttctgagggtttaagttttagggtttctgggggttcgtttctaaaggcttaggattcacctacttcaaggaggcagggttgtgggaattaagaccgcattctttttctacccagcccagtccctactaagtaccagacttctaaatgttggggcggacagaaacaagcaaacaaaatatacaatgttgtggggtcggaacgctttataattcacaaatttgacaataggctgcattttcatatgccgaattgcctaagagttctcttaaaggaacagcaatgtgaaagaaccacatggtaaggagaatttacgcatgtcctgcatactactcctttcccctgtgaattgcataagacctagatgatcttgggccaaggaagaaaatctggaagggtgtttctacccaccatgtgcagagtacactacaattttgagaaaacggaaagaccatattcaaaggcatacagaaaagcctgttctgtttacaaaggctgacccagggcaccagggacactgtccctaagcagatcagttgtgggagaacttttctacattagcatgcaataagcaaaccattcatagtgaggagaagtcaaactcccaagggtccatttgataaaactttgtcattgtcgagtggaaagaagatactgagaaacttacactaagtggtgggatcccttgtctttgtctttgaatctacaggtattggagaagaaattctgcccttgaaatttagactccataaattaacatggcacaacaaataaagttcatggactgaatttaggctcctgggatttttgagatagctttttatgtgaactttgtaaaagttagagtaacttttaaagtagttgttacatgtgccacgtggcttattgttatcaagaatacttgaactatttactgttcactttgagtactctaggttaaaatttgcctcttttttgttctacttcctccaccccgcagtctatgtaaatatatactttagatggacaaacaactgcctaaaccttgccaggtgaattaaagtttcagattgaagcttttttttcccccttaacaagcttaaagatattaataattttaaatggtaaatataaaatacctgctctgtatagcttccccaattctaagaatgtaaaaaatattacatgcttgttataaaaattgaagcattacacacaaatataggaagtccattgtaaccccacaccctaaagatcacaaacaatactttcgcctatggctctaacacaatcattttcattttactgaataacttccatatgcaagtatagcatcacctagttgccatggtagtgcatctactatatggtttggttttgatattttcctctctctctcattcccataatataggaatgtaggaaattttaagaggacattgacttgttttatgatcatttgagctgtccatagttagcctatccagtggattaaagatgcataaccattgtgtctgggatttgttcagtgccatcttttcaatcattggttacaatgaagctgggagtcccctctgaggttcggctttctgtggctcctctcccctgcactccaactttctcaaagcctgagcctcaagtgatttcccagtagctaagtaaactgcccccttcctccatcttcaccaagttcccaaagctgttcagactcaggcttcaaatctaacaggatgtggctccacacattatatttcagttgttattttttaatgtggaaaataattcaggaaagttttggctaatgcttcaagacatcatgcactttatacacaggatttgttcttaagaaggtagtatagtgacaggaggaacaatttacttcagaatatccattttatgtccaagccatgcaccagccacttttgacagacaggatttgagtatgatgataaaatggggtaagcatatattttaagttctaacatctgtataaataagaaaaatgaaaaatcactggaacacatctacatgctagtgagaaaataattactaacagagtaaagtttgctctgtgaaactgttgctcaaataaagaattattcttgatattagcatagagctgagaatattgcttttttccaaattcctaggtgagtaggcaatatagctagccacgatttttcaggatcatttgtaaagcttcacttttaggaattttaaccccaagtgttctaagacatcaagtaactgaccttttcatcccgccgaacaaacctcaaagtggagttgccaactatcccacaggaaattgagtcaccacaccaagcaacacacctaaatgtcgacagctagcaggacaaaaacagtgagccagtttaattttggcttttaccaagaacacatactgcattcattaataaaatacttcccctcaacccctgccagagtagtatacactgtggctctccttaaaaatacatgaaaactctttaactgcaccaaatcttgctaagtcaaggaactaaacagagaaaaacacccaagcaaaaactattggctaaactccctaaaggctgggagagggctatggaacagcaactgagaaataaattgagccttgaaggcccctgctacaacagcatcagttttcttcaaggcacctttgaactatgtaacacccgcattctgctgaggctcttctgtgaacaaacagtcctcaattcttgcgggccagcacttggcttctgtcacagtgatatgcttagaggttcccctgacacatggcctgaaactgtgccaggggctccaggagaagatgctgaagaagcagcttccttttgaaaaaggaaaaaagtaatcacctcagagccacagcagttagctagaggttgaggtcattttttgtgaaatgttcagtccattactcttacccacaactcacagtgatgttgaccattgaggtaaaaggatccactgtacgggatgtgtaactatgtggacattagtttctttgccaacacttgaaggtctgctaaaggactgtatcggcttgtcataattcctagatagacctattggtatacatgaagagaacaagtccaaaaaataccacttattttggacactatttgtatgcccttaatttaaaaaaaaaatacaaattataacagctgaggtcgggcacagtggctcacgcctgtaatcccagcactttgggaggccaaggcgggcagatcatgaagtcaagagatcaagaccatcctggctaacacagtgaaaccttggctctactaaaaatacaaaatactagccgtgcatggtggcgggcgcctgtagtcccagctactcgggaggctgaggcaggagaatggcgtgaacccggcaggcagaggttgcagtaagctgagattgggccactgcactccaacctggacaacagcagaagactccgactcaaaaaaacaaaaaaaattataacaactgatccagattttttttattattacactttaagttctagggtacatgtgcacaatgtgcaggttagtttcatatgtatacatgtgccatgttggtgtgctgcacccattaactcctcatttacattaggtatatctcctaatgctatccctcccccttccccccaccccacagcaggccccggtgtgtgatgttccccttcctatgtccatgtgttcgcattgttcaattcccacctatgagtgagaacatgcggtatttggttttttgtccttgtgatagtttgctgagaatgatggtttccaatttcatccatgttcctacaaaggacatgaactcatcctttttcatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagacccttgaggaatcgccacactgtcttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtcatgatgagcactgatccagattttttaaaaataaaagaactacaacaaaaagctcctaagagcaaatacttaaatctccctaaccagttccagcttctcttctcttaattcttacaaaatttcccctttgttctacggaaggaattgatactgtctacagtagatagaactggaaaaaatgatttctgtttcaccgtgtattgctttgagctagtcattcctttagtttgctacagtaaaagatttgtgtaggttaggtctaacttttgctgacttaattttttttcctctatacattttatctgatgggaaatacatgaaggctttggattctctttcaatgtgtacatgtaataggtttaagcagagtttgctagtggcaagctgctctcatctccaagtgtatttctggcatcaaattattgttttgaagtattttaaaattgtataaaatatataaaactttatttagtacttcataaagcttccaaaggaaagatgtgtgcaattttgtgacggttttctttttcttttatcttctcactaactacaattgtttttccgaatgttgcctatgcctctagtagaatttttatatgaaataaacatgaggttggctttcattgacttttagtcccaccagtaactcaacatttatttagcactgactatgtgccatgcactttattagaggctgcagaaacaagatgatgaaaagagtgtgtcccttacccagagtccagcagaggaggtaatttcagcaaacaactgtagagtgcactctcacagaaggaagcatgtgggctatgggacagtaaaagaggactatttaaatcagacagggacagaggtggagtgggaaaaggctgagtcctcaagaatgaaataaaagagagtgggaaggatttttaagagaaaagatgagcaagcacacagacctatgatgaacaagatgtctgtgtcggccaggcgtggtggctcacgcctgtaatcccagcactttgggaggccgaggtgggtggatcacctgaggtcgggagttcaagaccagcctgatccacatggagaaaccctgtctctactaaaaatacaaaattagtcgggcttggtggcacatgcctatattcccagctacttgggaggctgaggcaggagaatcgcttgaacctgggagatagaggttgcagtgagcagaggttgcgccattgcactccagcctgggcaacaagagcataaaaactctgtctcaaaaaaaaaaaaaaaaaaaaaaaagatgtgtgtgtcaaaaaagaaataaccatgagtagggccttgcttaggggaacagattctggagaaatctgagaaatcctcagccactggccatctcaaagactggccatgtcaggcatctgcaggtaggactatatcttcaagagtaggagtcacagagtgactcagagtactgtgtgacatgggatctgattttattttatatggaaaattctagtgctatgcaattaatggaatttaagaaagtaaagttgaagtcagtgcaaccattatctttgaccatattaagaataaaattaaataacttatagaccatttgcttctctgacgattattcttatctaagacaatctctgtattaaaatcctacgcagacatatgttcccacaatatgtcaggtatgaacagaaggactgcccaatgtgacttgaaagggagtggacttcttgctcttaaaaactacaaccttgtagtcactaacttattaatcatactgtaataagatggagaaaaaaacaatggaattcaccagaatttctttcacgagagtctgcctgcattaaaatgttcgataaagctatttatgacagaaggtgagactttgaagagctttggtttgggtggaactaatctgtgcctcatctacacaggaaaggggaggaatatgccagttgctagagagggaatatgtatgtgtgtgcatgtgtgtaagcgcatgagagagcgagagaatgtgtgtttgtgcacatgcatgtgtgtgtgtgtaagagaaaggagtcagcttggtctctgtgtgtgcatgtatgtaagggcatgaaagagtgagagagagagagagaatgtgtgtgtgtgtgtgtgtgtgtatgtgtgtgtaagagaaaggagtcagcttggtctaaagggtaactccaatttgtacatttttcctttctcccaatcatcaataaggttattgaagatgtgtgtgtgtgtgtgtgtgtgtgtgcatataagagaaaggagtcagcttggtctaaagggtaactccaacccgtgcattttccctttctcccaatcgtcaataaggttactgaaggtacaaaatcccgacttgttttgttttgttttattcattgaagggactgagcttgaaggccagattggcccaagcagaaatgtctctctgagctgacataagagaagagtcaaagaaagaggagaaagcttttataagaataaggaggccttttgtccaaaaaattggagtttgagctaagtttaattaggcatctaggttgggggcttcatgtgacatgtgtgcaactgtgagtgatattattctttgaaagaaactggaagagtggagaaagattccaatctctattccacttcatacaagcaattccaggcaattcagctactaatctttctagggccttatttcacctatagattggagataataacaagagccttgtaagttattttagttcaagtgagaggttgtgagttaaataatcttgcattgattgcctaatagattcttttcccttcctcctccattgtatcttcactttctcctggactcaagtctctaacttaaatgcaaacattctattaattttagtgagcctatcaactaatacctaggtataacctcggggtccagaaacttaatagttacctggaacagtttttagggtagttagaaagaaaaaagaatttcaaggaatgaacagggattcattctgaagaagttcacttagagaacacaggccattcaggaagctacaaacaggtagggatataaagtttagatcagacagtggacaaagataaagatggagaactagtcttggaggacttgtatactattctaagacaatattttcttctaaagaggccattaaaaatcttctaagtgaggaagtcacatggtcagatttgcttttcaaaaagattactctgggaatagtataaaggcagatcagaaaagtaaagaccagttaagaggttggtgaccagataaggagaaaatcctaagcagtccctgaaggggaaggagaagctgcagaaagttaggaggaaaaactctcaggagcaaagaaaaaggaaatgtcaaaggaaaatattgttatggactgaatgtttgtgtctctccaatattcatatgctgaaatctaatccccggtgtcacggtatttggagggaaagcccttcggaagtaattaggtcatgagaatggagccctcatgaattagattcgtgccattataagaagaggccagaggttgctctctttctaccatgtggatacatgctatgtgggcagtctgcaaccctgaagatgccctcaccagaacctgactatgctgacaccctgatctcagacttccagctcccagaactgtgagaaataaaagtttgttgtttaagccatcagtttatggtattttgttatagcagcttgagctaagacaaatatcaaggctttgccattgatattcagtacagaccgtatatacccacaggtttgcgctaagataattttcattccaaacacatatttcagcaacacaagactaaagagggtgttaaagaatgctactgaggaagcttttgtctgggaagttgtttgaacaaagttacaggacaatttttgcaaacaggtttaaaaaaagttacaattatgtatgctatttacgtattcttgttgtaattttaggaatcaattttatttccctggggggactgtaggagagcatctgtgtttccatcatatactatcaatcttaggatataacagtcttttgttcttcacctttgtcaattactgcatacagtattccttagagaaaacaaggagtttgaacagattatctttagcacctacccagctctaacattcatttattatctgatttctgaaattgtactatctgggttaggtgttggttttaaggttgttcattatagttagcctggatggggtcagctatgtttgtagagggaattcctaaactgaccagttacttgtcaaggatcccatccaataccatgatcctggaattctgtgagtttagctcaactgttcttcaggggtacatgttttctatttgaaattgaggtattctcagaaataaagctattaataaatagaaagttctggagtatatttacactcactctgcttatctccactcctacccctaccatattcccatccaatactttgccagttgacttaccaatttcttcttaatttctgtaactgtcaccttcagtcaaattctcatctgtgtatttctagattcatataatggtctactactggatctccttggattcactttttctcaacacagtcctatttataaagtcagaataatcttccttaaaccctggttttattgtttcattcttttaagaacctgctgcacaactctctcctacttattgtattaatgtcacacttctgttcacataggcctttttcggctgcttttcaatacctttcccttttatttacatctaagactatcccatccaagactgcccatcttagccaatctttccacctggaaataatttgctggcttctgcctgtatgacttttctaatgtcatttttatatttgtgtctaggcctttctataactgtctagaaaattcctgacatttacaggcactcagcaaatatttgtgagtgaataatcagtaagtatgcttgttttctatcagataagaatatttatttccaaacgagattcaaacagtaatactggcctgggtgtggcttcctacatgtaatcaccctcgtctatctcttgttctcagtcttttgctttcaaactctttctctttttttaaaagagtattaggaactaacattgccaaaatttggtaatggtcaagcagatcatggtgtcttactgaagtgaaatattaacattaaaataaaaatgacaagtattatggtatatcattcatatgtaatgatccttacaaaatagagtaaaattttaaaagaattcaccaatacaccagtatgatgtttgggagaaacagatgaatgcacaaaggtgcatctgatgcaaacacccccagaaaaatgagcataagttcatattatcaatatttttcactctaaaagtgttcactgacttccctgaagtcaccaaggactccaagttaagaatactttcctgagtgaagaaaagaaagcaattattttaatcaacactgccccagaatcttttattcggaatcgctatctctgctttcttcttcttcttttttttaactttctcataaatctctgtttagcatttatatctctctcactatgagatacctaagggttaagaagtaatgccaaagagacatttgtccagttgaagactgggattaagaaaaaacacacagccgggcatggtggctcatgtctgtaatcccagccttttgggaacccaaggcaggtggatcacctgaggtcaagagtttgagaccagcctggccaacatgatgaaccccatctctactaaagaaaatacaaaacattagccacgcatggtggcgggtgcctgtaatcccagctacttgggaggctgaggcaggagaatcacttgaacccgggaggcggaggttacagtgagccgagattgtgccactgcactccagcctgggcaataagagcgaaactctgtcccaaaaaaagagaaaaagaaaagaaaaaacacacaaaagatttcccgaaaagactaggcccttttaaacaggctatgaacagagtctcagaaaggtaatttcttatgtacaatttttaatctcattacttgcattacaagcaacacatatgagtgataaactattttggcctactggtaaacctacatttgttaactgtgtgtgcattatagagaacaaatttcagaactcaagagtatatcggttatatttggcttatccagttgtatatgaactggctccatacacgaataagataaattagttttataattttacaagaatatctatggagatttagatttggctaagaaagttattatacacacagaagaatccacaacctataagagctcttcatgggaaatagtgtgatagatcagaaagagcatggacttttgagtcactcagaacttgaattccagccttgccattgttctagttgtattatctgaaataagccatttaaaagacctgagcacattgtatacattgagaattacagggttattatgagaaatgcataagaaatgtaaagtaccaagggctgtatctgacatatagaaggtattcaatcaatagtaggtatactgaaccactttgcagagttgtttaaataagttaattttaaataaggtagttaatatttgagagtttccttccttttccacagattctcaatcctaaaacagttactatttttccatcatcaccatcaaccctcaaatattaaccagttctgagccaaatgtgagtgaacaacctatgatttagaatagcttttagaccaggcacagtggcttacgcctgtaatcccagcactctgggaggctgatgcgagcagatcacttgaggccaggagttcaagaccagcctagacaacatggcaaaaccgcatctctactaaaaatacaaaaagtagccaggtgtgtgtggcacatgtctgtagttccagcttcttgggaggctgaggcaggagaatcaattgaaccctggaggtggaggagatggtgccactgcactccagcctgggcaacagagtgagactctgtctcaaaaacaaacaaacaacaaaatagaatagcttttacaagaccacaccaaatcatgaaaagtcaactatgtaggaagaatatgtatttgtcattggttaatgacagagcatcacttacactgaggttactgggaagatcatttcaaacatttcccaaagaatgttccaatcaatattgtccttataagattctccttactaatgacgttttgtggtcaaacaagcttgggaaatattgtatatgtaggctttttacagtgatttctaatggacacgaacctaccaaaagctagaaggtccacagcaaaatgagatatttaattttattaacaagcattatctaaacctgtttgattttagaatgcatttttcacacaacaactatcacctcttgaagaatacctggaataggttttcctatacctatacctatatgtcaggtaactccaaaacattaacaaatacatgtgtttagtaggttcccatatggttgaaatctccactaacgacattttatttctcttcctcctgactttgtatgctatcgagaaatggtcagagagtaatcttcctccctccctttcttcttttctttctctctttttccccctgaaagagaatagtcaaaaaatccatacatatttattgagcctctctgatgtgatagttgctgtgaaatacaagaacatgaaagattcagcagcctgggcccaggaaggaaccataataacctgctgagaaaatcagacacatgatcggctgctgcctagagacagtgtaaggtagcatataaatcattcagcctgggagtgctactgtagttcgagcagggagagggaggtatggactatagctcagtgtgctgggtttcaggaagaaggtgaacttggatgtaggtcttcaaggaagactgtggttttaatggctgtgggaggagggagtccgctggcattgttttcaggtgtaggaaatgtctgcagcctgaataaaggttgtatgtgtggacagtaaatgggctgggtggagtagacacattccagggaggagaagggatatagagttgaacacttaaatgtgtggccttgagctagtggatattgtgggaattggataagtgcactggtagcctaagaggatagaatggagaagagagaaggatggagactaaggagctattgtggtagtccagatgcagtggaaagcaaagagttgtggaggtatccactttagtggtctacgatgacagttacaagcaatagaaagagtatgacttgggaacagtggttcaaatgctggctctgcaacttagcaaccatggggcaaatttgggcaaattaacttctctgtacctcagttttcttttttgtaaaatagggctaaaaatacattccctagaaggtggcctccaggccattttcccacactttatttgaatgttaaaactaactttaatctaaaaatcatatattcatatctctatcttttttggcggttcagttcaacttaaatgtgttatttgttaaaaacttgtaattatcatctattacatgtaaaatataagagctgcttttaatagtaattcatctcctccctatctttttttaaaacatggtcaaaattaacaaaacaatcttgtatttttgatactagtagtggtatcactactactagaggtacaaggactcttgtacctctctgaaaagtagcataattagcaacagtattgatggtatctgctattttagattatttaaactgtagtcactaaggtaagcaaggggaagaaggcatgtcatttatgtgtttttcatccttaagattagcgtttggaagcatatattattccacagcaatctggataggtcttgccatgccctgatcttgtaagcccaaattttattttgaatactccagctttgcacttaaatgacagctccttgataaaagaaaaacaattgcctaacaattttcttccaattgtctgaaaacataatgggtgtacatacacacacacacacacacacacacacacacacacacacacacacaatctctagggcatatttactagatagtattatgtaatgtgtagacatttttaattatgataattaagacaaaaatatgtgtagcaagtttttgatttgagacaaatttgagatttactaaaattattatatgtgtgtccttctgaagacttcatattttcattatatatcttcattcttgaagtataactcttaaattgttgaattaagttttatgaattaagttgttttgttttttgtttttttttgttgttgttttttttttttggccaggcacggtcgctcatgcctgtaatcccagcactttgggaagtcgaggtgggcagatgacttgaggccaggaatttgagaccagcctggccatcaaagcaaaaccccatctctactaaatctaatcttgtgcctcaagcgaggcacaagactcacttgaacctgggaggcagaggttgcagtgagctcagatcgtgccactgcactccagcctcagggacagagtgagattctgtctcaaaagaaaaaaatttttttccatttttaccaataccactattctcaattcatccactatttcactaggaattactaattcagtttacataatttattcaatgaataaattattcaatgaagaagcttctgggtatttaggtgctacatgctaatttcaattggcatattttgtttttcaaatttgttcttggtgacccaataattatacctgtccaccttgaaagtgtctttcttcatcaccttcaaggccaccgctaacaagacctttgaaaagaagtaaacagtagagaatttcaacttctgtgatgaccaccgtcttcttctgaatccccagactccactcatacaaggttttggggaagtttaaatgaaatgaagcagtggcttacaaagtttattgacagtaaactacagtaaaatttatattttatactataacctggtagatttgtttaaagtaagaggtgctcacttttgaaggcatgtggatgctggctttcagtaatataaaaaaaatgtacaaaaaggttttatacctatatttatttttaaaaggtagaggagagcagtggactcctatttaaagaaactcttgtgttttataaataatagtcatggcaaaatttgtttacagtctttaacaaaccatgcatttcagtataaattaaaccaataaaaagaattatatatataaaataaaaaggaaatgtatatataggaacagtatataccatacacataagagtaaatatatattcgagccaatacagagaattgaaacataatttaacatgaaataacatttatccttactatgtatgattcactctgatgttttctattttatttaattttaaagtattaattgtgaccccttaaattgattttgaaatctaccaattggtttgaaaacactgaggtaagaaattaccttgcttaataaatgttagttttgtttccctcttccctcttcctccctttttataattaaaaaactctccctctacttctctacttcacgtgagagtagaacacataaaaagatttcagttaactactgtgcatattttttgaagtaatttctccataatgtgtgagttttctcagggtactacaagtttaccaacagaacacataaagcagcggccactcactgaaatgcctataggagacagatagaccatatgaatgaatgaatgacatggttgctgggcatcctggttgcagtggctagaactgtggagggtaggagcagaccaccatatatcctaggcatttcattggcaaatgaacaggagaaggacacctttccgtttggccctcattttcctagatctttcctcccttcctctgtcaatccctcctacatagcctatgttcccaaagcaccccttgtattataataataattattatgatatctgtccttaatcaagaacttatactggatttttaatgcctttaggtcttccccaaacttcagttcatctattcgaagtccctataaaatctacctccttagacttgtctgcccccattattcccctgtggttgacctcacctccatctctatcttttgtcagcaagtttcctcagagttccctctctgcatacttgttcatgctgggttatttgtttttgccacttgatcatctagacctttttccctctttccctccttctattcaatttctgcctttcactgctgtacaaaggaggggcagggaggccctccagggtggagggaatcagtcttgagataactgagagattcagggtgatgagtcccaaagttgaagagaatccacatacttcttctgtttttgttttacctagcaaggagccttttctatagacaaagttgggaaaccagaggttatgacgtgattcatctttgcctacttaaactttagcttgattcatcacttctcaacaaatacttgttgaaccccaccagtaatacgagaagcttggtattctatgaggtgctcaacttccaaagcttagttcagaagaattctggcctcaaggcgtctaccatctagaagcaaacaactaacaaatgaacaaatgcagtgatttcaaaagaaattaaggtgtgctgtggtagaggcatgcacaggtcagaaaagttcagaggttccagacaggcttcctggggaggatatccatgccccgcctccacctggtagttcatgatcagagtttgcaagcttggctgggatagagggaatagcgtgtgaaccacagaaggagtggatctggtggctcagacacggcaagaaccagctcatggcactaggctgcaggcacaccatgcacaaaacagtcttttctttccccagttctccaaattctctaaagtggaagcctaggggtgagggtaagaaggaggtaggaagctacaaccactggagcaaaggacgaaagaaggggcttgagtgtctaaaagtgcagaaactcaaccgactggacgctgagacaatgtttaaaaaggagtttttttgtttgtttgttttcttgtgtttttttttactttaagttctgggatacatgtgcagaacgtgcaggtttattacataggtatacatgtgctatggtggtttactgcacccatcagcccaaactaggttttaagacccgcatgcattcggtatttgtactaatgttcttcctccccttgctcccccaacccccaccaggccccagtgtgtgatgttcccctccctgtgtccatgtgttctcattgttcaactcccacttatgagtgagaacatgcagtgtttcgttttctgttcctgtgttagtttgctgagaatgatggcttccagcttcattcacgtccctgcaaaggacataaactcattcttttttatggctgcatagtactccatggtgtatatgtgccacattaaaaatgactttttaaagtggcaactgtgggaggcaaaggagaaaaaacaggagctgccagataagggagtgaagagaacccagcactttgagaattccgttacattttgcagcttgaattcttcactttttgctcccattatgtgcctctttctcctctccatgaactgggccctgtggacccaggatcctgctgtctttgcagggcaaagaatggttagaaatgaattcattaaggtgagaaaccattgctggcataattctccttcacggaaacctggcacttaaatttaacctgtttggttagatccagctctgcctcccccatttttttctgcagaaacaaggctggcagatccctgttcctcttaatccttgaatggaccaaatgctgggttatgctggggcagtgagggaccttacaaacactgaaatttaagagaacagtttttggagtaaggcagtccttgtttccaaatctgagctttgccactgattgactagcttggcaccttataaaagtgaattaacctagcttgttttctaatttataaaatggagaaagcagtacctatatcacagtatgattctgaaaattatttaaataggactatgtatgtaaagcagtgcctgaaaaatagcaagtggtcctaaagtcactatgatgatgaattttatatgcaggcacctagagcatgttaggatttttgggatctttcccagctcacactgaagcttcactcttctccaacagtctgttatccaatgctggataactgagatagtcttcccagcatttatcaatgtggttaggaacagtaatcctggaaagcattctcaaattatttatctaattaaacaagcaaacctttttagcccagacatcctaaatctctgtagcttgtcttcgctgatttggtcagaatagctcagatggtaggaagggctttctgggtagaaaaaaataaattagcagtctggaaaacaaaagatctctgcttaaaagagtctctaaaacagcctgatcagcctgtgtattttgccatattatctagcattagtaggggactgggaaaaatccagggctccttgtagagatagagactggcaaatattatgtttgatgcatgagaaccaaatcagaagttaactctttaagttattaaatcactaaacagtctatcacaattatgtgtttattactagactgaatttctctggggctggaaccataatgaattcattttttgatctctggtgctaaacactggctgtcatatactaggtatccaataaatgtttgttgaatggaactgaaaaagcatgaaacacttcccctgttaaggcttcttttctataatatttccatagtttctaatgcatctgagaatcattaactggactgttagaggaatatgaatatggttgagggagctacaaacttcatgctctgagatgtcacatgattagtgtaacttttgttccaggggagagaaatccctaagagagtgactgttctccatgcccacccacccacagtgtcctatagagcctttcattctccagatgcctataatgactatcacattgatttgtttacatatctattgccttgtcttccttataggtacagagtccatacatcctaattggcctggaacttccaaggtctatgcctgttataccagtgtaattatgaatagcattgcctttcattctaaaaagtgttctggtttgaatgctaaatcatctagacaccctacttatgagagggttcactgtacatcgtttagtcccccaactcccctccccttggaaatctgggtactaccctctaccgggggctttccactatggaggcagctctctcaatcacagcattcaggaggtgtaagtccactcccaacagaacagacacctgtctacaaagagactcttggtggaagaaaaaaaaaaatcacttccgtaagtttaagtcttccttttaaacttgggtctcttttgcacatcagaaacaaagaatctctaataattacatccctaaatgtactgaagtctagaagacatgcccatttgaaaactctaatctagtaattaaagcttctcaggttaaactgcaccttaataatgtagcttattttgtcaagatcagttaaggccctgtaatgtgatttggaataaatggacagacagaaattaaaatgtgctggacaaggtaatcagaaatctcacttcatttagtcaataacaatggcaattcagcgggttccttttactactgggatgtaattgtgcttggctttaatttcttgtaatgatggaacaaattaaattacttcatacttttaggaacatttggctacatcatgttttggtgcttccataaaccccactggaaattaaatcagctctgtggttgctcattctccctctttagtgccatgtctgccttctgtcagcaaaatggtaatattgtctaccttaatccaccagatgcagttgagttaaaagaaattacctctcccacctctttcctttcaaatctccctatttgtagctatcaaattttggcatgcctgctggaacacagtcttgttagaacaagcacggtaattctctcgtgagactttaggactctctctacgacaaggtcagaatgtacctgtgattcaaatttagatgaggatatgagttggtaagaacatgaagagcatcagacagttttcaggacacccactacttttattttgtgctatcagtttttcctttcccaaattgcaggtggagatgcaatctttaacgctggaaatctcttgctatatgccattaaaattaattagtctagcacattttatctttaggcccttacctagggcaggtaaaatattctagcacaaaataacacaactttcctgaacaccatggctactaagttcatatggtaaagattatactatacattaccttgcaaatagagtgttgcagactgatattaaatatttaaaatgtatgcaggattattaataggcaacattgtggcagagactgctaaatgtcccctaatattgatgcttttcttcatcacttgttttcaaatacctgttttcatgtaagcatgtgactgcccaaaatagagaaaattcacagcctccttggttgccaggtgttgccatataactaagttttggtgaatgagttggtagtagaagcgttatgtagatattatatgatgtgctagaaacttcccttaagagaaatttgtcatctatctttttatctgcctgtatttattgttttctctttcctactggctagaatgtgaagttgatggctggagtcggagcagccatattggatggtgagttgaatttagcaacagaggctacacctcacagtgcaataagatggaaagagcacgtgtccttgaagactgtactggatagaggtgccatattaacctcggactgccaactttcagattttacatgaaggagaaatatctgtcttccttaagccacttctattttaaatctctctatttactgctgaataaaatctcaactaacgcaaacaccaataacaaaaaattcctattcactcatgatataggattataccttagtcttttttgtgtcatatatctgttcattcaccatttttgctttgatgttcaataaacatctcaaatttaacatatctataaaaattttttaaattttacgttcaggggtatatgtgcaggttagtcatataggtaaattgcatgtcatggggtgctggtgtacagattatttcacaccgaggtaataagcatagtacccctacagcttagtcttaagaagaagtatgttcacataggccaggctgagacttggatgttggatgactttcttccagcttactctgatttgaatatattgtgtggtagtagatggctaaactgcttgctccaaaactatctgacaatgctttttagaaagtctgccaaacaaaactacaagaatcaccctggagcttcccttaggcttcagatatttgtcttccctgccctacttggaaatcattccagcctggaagtcattgtgaggaaccaaaaaatggtctccctaccatgaagaataacactgcttccattgttgggaggctctccttcctacaggcactgtccctcactcattagacacttgaataataaggatgttcatatatttattggtgttggtatcagttagacagttgaatgatacaaatgttcatatatttcttcttattcaatagtctcacaagaacactattcttgtaaagtcattaaaaactggatggtcttttcataattatttccatgatttgtcatctaaagccagtgttctctcctcctgtcaatctgatagctttaaagctaagttctgggtgggtccaagtcatgcctgaaaggtttatcaaatgacatattgcagtcatatggtcggagcacaaacacctctgaatgtacaatattttaaagcaaaacagtttatgtgtaagctctatgaggttacggaccatgactatcttatttattaccaaatccccagctcctagaacagtgcccctcaatataaatctgtcaaatgaataaacgaagagtttgcctgcagtagtaaacttgttatttgcacacactcgaggcccacctctatgtgtacattgtcagtgagtcagcctcgtggatgactctgcaggactgtctgtataacatccactacagttaccaggggacccaattttcataaattgctccagcatcacaccctcctcttacagagactcttcctgtccattctaatccctgacacgttgtcatcctcactcagattccccaatagatagaaatgctgttaaatatacttgggtagagagggataggcatgctcaaactcgttttgggaaaaaaaattgcaactgtcagaaatgtgttagctatcttcacagattatgaaacataaatatcaattatctgttcacagcagtgaaagcctgcatatttttttaagatagcaagtataaaacggctataagtaccatgttgagtagagacctaccaccgaagtagagaccttcactgaaatagtgaagggatggttgtgttgcagggtcagaatgattacccactggttgacactccctccaggactaaaggcagcatcaccagcgtccactctgcttctccactgcttactgttaaggagcaaggcaatagcattatctaagtaggaactacttcattctttcaaaacctggaatcggctgatcagaagaagaaaaacagtataaaaatacagaaagacaagattctctggctgtcctaatgaatgctagctagctataatagcatggataagacatataaccaaacatataagatctattaattaaggggaatctctatttgtattaactcatctattttctctaaaaccagtatttagttatctcccatacattggcatattgtgtatatttgcagaattcaaaatgttactgatgtgacttttttccatcagacatctgagctatccctcaactaatagttgagctgttcctctatagctcagtatctgagttagaactcgaagtaaaaaggtataaataagtcatgctataaaattcaaaggcaatcagatgtttgagactatagttatacagaaaagtgtccttgttcttgggaggaatacatcgaggagtttagggatagagggctatgatgtgtgcagttttctctcaggtggttcagagaaaaaaagacaatgtgtgtgtatgtatatttgtgtgtatgtgcacatagagtgatactgcaaatgaggtggaatgtttacaatgagtgaatgcatgtggttttttttttttttttgcactacccatgaagctttccagtgtgtctgaaataacttccagataaaactttttttaaaggcaatcagaacagtggcaatgaataattcaattatttcatatttgagctgtctttcctgccacccccaccccctataacactacatacatacataggctcacataagtgacacttactatacttttttgcctatgtaatgagtgttggcgaagtacgtgagtgggaaattcagtcttttgcattcaagctctaagtaattctaagagaccttttagataatgatttgacttttaagacaacaattttgaggttataatatgatgtcatttcatataaacagaactgcccttttgtcctttcagatttgattgaaaatggcccatggagtacaaccacctgggaacatatcctcgagaaagacagttgaggcttattgcctaaaccacaggctactgaaaacttggccaaaggcgactactctagactggtgacttcaaaagtgctgatgaatacagtgaaccatgaaagatgcattatttgttttgaacattttactatgattgatgacccagatttggcaagttagttcactcccagtggagatgaaagtttcactgccttctttctttcaacattcttgttgagacagatttcacttttattggccaatgtactaacaaatcacttgcatttgcagcataatgaattcattagcaacactgtggatcaatgctatacataatattcctgagtcaacattaactcttaattaaacttccttattataatgcctctggaaattttccttcaggctactaaacttcaagccaacagtctaagtgttaatcagtaatcatgctagtaactttttgagatgggtcagggccagggccagggtcagtgatccatcatgaatggcaggtttaaaaatggatatacgtgatcaaaaatacccataagttgaccaaagcattctaacctttgggttattctaacactcagtgtatcagccttctgagcaagccaattttttattgccttaaaaagtctaaaagaaagataaaaacagagataatcagttttgtttggcaatggcaggggtgtgggaaatgaaaaagaagaaagttaaagatgagtgaaaataggatagtcttggcactttggtatgaaattgaagtacttatttaaactgatgaatattgtacagaaatatacagagagcagtgaggggctaagaacctaattccaaggtaactacaaggaaaaaattattgatctggattgtgaccagaattcaagagtttgactgttgtcattgttgctgttgttattaagttaaaaaaaatgagaaaaaaatatacttttttctagtatacttaccaggaaaggaaagagagaaggagggagggaaggagggagacatggagggggcagagggagagagagacaaagacactgacaaagtctggaaaaagacacaaattcagatttaagatcccaaaatatgctacatttctgcccccttcaaaatattaaactttgctaaaatacactggaaattttttttattgtttattttttaaatcaactagcagaccaattagccaagatgatattttcatccttggtactctttcaggtgagctctgtgggctaccaccagaaagtcctagccaaccaagctctcactgggtcactctgtgctagctagactacatagcctcctaaaaaagcacgcagccctgatgctggtcctgccaaagtgtggtttgctgtcatgtcctacaggctacccgtttcccagtgatttatcataataaaccaaatgggaatgaaatacccagaaatatgccataaatctactagtggtgaattttcaatattctgcacaccatggtgatttgttaattcagttggatctctattaaacctctctaaaatgtcattaaaccatctgttttgacttgttaatcaaacaacttttaaaaatgtatttagagtatcagtaacccttgaattaatgcatccatcagtaataatcccctctccaactttagatttatttttaagctctagcttttttccccaccattccaacaaatagcctgacttccaaaagtaagaatcaatcacttcagttgtagaaatgtccagagggtgccctactttcgaaacaggaagtaacttgatccagcagtcccacttcttggtatatatccaaaagaactgaaatctggatcttaaagagatattttcactgcagcatatttgtaatagctaagatacagaggcaacctaaatgtccatcaacagatgaatggacaaaggaaatgtgatatatatatacacacacacacacacacacacacacacacacacacacacacacacacacacacacatatacaatgaaatattattcagccctaaaaaaggaaggaaatcctgtcatttacaacaagttggatggaactggaggacatcatgctaagtggaataaaccagacacagaaggacaaatactgcatgatctcacttacatgtataatccaaaatagtcaaactgatggaagcagaaagtagaatggtagttgccagaggctgggggaagatgggaattggtagatgtggtcaagggttacaaagttttagtcttgcaaaataagttctggaaagctgctgtataacataagtatacaatcaacaatactatattgtatacttagaaatttggtaaaagggtagctgttatattaagtgtccttaccatgaaaggaaaacaaaacaaaaaaacccaaaaagatgggaggaaacttttggaggcaatgaataagtttatggcattgattgtaatggtggttttagggtgtatacctgtctccaaacatcttgcagaataaacatattaaatctaaagtttccttgggaaagaagatgagaaaataattgtcaagagactgtacaccaataaaatagtcaaggagtacaatgaaaacttaggaatcccatttcttcctttgactcacactgtttgatgatatcattcacatcggcatttggaagttattgagacatttcaacataagattgtccttatgatctatgatttgggactctcttataagaaagtccattctataccaatttgttttgttccttggtaactagaccttctttaattggatctaagaattaatattcctatctcataaagaagactaaaaggatccaagtagatggagtttcaaaggtggtccccataaaagcatttttaccttaagcaaagatgtcccaatttttcctgcttgcttttcggatgctgttctaaaaaaaatgtaccttattccttctactaaaagaaaacctatcaattcattgattcattgaacaaatatttattgaacatgtagtatgtactaaacactgggtaagattccagatatgcaaagaggaataagtccctgcccttaagaaaactcacagtgtggtcaagctaacaattctagagcaactgtgtgataagggctccaaaagcacatgcaggaacacagagagaggcactcttagtcttggaggggcttcctacagtgggcaatttttgatgtgtcacaaaaggaggagctattagggcacaagaagagcaagggtgaagtgcagaaaggagtgaatagatggggaggggacccaggcaaagagaataacatcagcaaaggtgcaacttcatgggaacacagtacatttggaagcctgcccaccatttgttacagcagaatgcatgtgtgggtggagatgaggctgcagagatgggctggagaggattatgagagatggatgactagcaaaggaagttggtcatgtccttatgtggtgggggaccatggaaagatttttatttataagacgtggtttattcttcattctgtggcaaaaagcagatactatagtctgaatgtttgtgtccctccccacattcatatgcgatgaaacctcatcaccaatgtgatggtattaggaggtggggcctttgggagataattaggtcatgagagcacagcccttataaggggattagtggcttataaaggaggcccaagagagctgccttgccccttccaccatgtgaggacaaagccagaggcactatctatgacccaggaaatgagccctcacaaaataccaagtctaccgtgccttgaccttggacattctagtctccagaactgtgagaaataaatttatgttgtttataagccacccagctcgtgatttatttatttatttatttatttatttatttatttatttatttagagagagagttttgctctgtcactcgggctggatttcagtgccatgatctcagatcactgcaccctctccttcccaggtgcaagtgattctagtgccttagcctcctgagttgctgggattacaggtgcttgtgaccacatttggctgatttttttgtatttttagtagagattaggtttcatcatgttgcccaggctggtctgaaactcctgacttcaagtgatctgcccacctcggcctcccaaagtgctgggattacaggcatgagccactgtgcctggctatgatattttgttacagcagcttgaatggactaagacagaaggaaaaataggcctttctgtagcgtgagctgaaagacagaaaatagccataggtttctaaagagagaaaaagatatatgtttgacaatatgtttcaattagtactttttttgaaatgcagtaagttacctataccttattccatttctaatctatatgatggcatttaaatattgactaggtttctgatacagtttttggagtctgaatgtcactgcatggatgaataaaccaaacagatcggattcatatgggtttgccaaatgacaaatttttttccatgtaagattagaggaaaaactgatttcacccaatttcctgccttatttatattagaactgaagtcaatgctgttatccctttgcatgttcttttgtatttaaaatctgatatagaattgtgctgttacagaagaaataatttaatgcattctgccctcttatttctcatgagttttcatttaaaagaaaacaaaaaagaaaaaggacatggacttttctttatttctagactttataaactttttagttatcaaataaacacatgtattaattaagtaggtaaaatattgcatatattaaaaggtacttggagactcatatgttgtcagtttttcatgactcaaaatttatgaaaaaccatctaagactatcgtaatgaagttcaattgtagatcttgaagtgacaaaacatgaaccacattgacttgaggtccagggcttaaaactgcctatttgagctctaggttaaaagcatgtgtgaaatgcaaagtctgacatctgcacagctgactattgtgaagtctcagtatcattgttcataagtaaagcttgtccctaagccataccacaagcattcccagaggatatagatttcatttgatttaacatgattgttgatattggtagtgtatttcacgtgaacttgtgaaatcattgtctatacagacaattgagacactaaaacttttttttaagtattttttgttaggggctagatctgaggttttttattcatttgttcttttgttcactcatttgttagttcagttatttactcaaaaatgtatattgagcaattcctatatggcagacactgacagatgctggattcagtgatgagcaaagcattcgtggtttctatgcccaaggatcctatcccgtggagtgtagagtcaagcaaagaatgtcaacaacaaatgaaaattttaatcttattaatgttatatgcaaaaatgtaacacctccaaaaaagacaatttatttcctattaaggaatgaaggcagtccactgaggaagatcaacatgtaagcacatgtaaagcaaaataatcaataggtaatgtagtttttgaaaaagaaggggctttaagcaggaagtcctgggtttggacttgggtttcaaatctagctatgtactcttgggccacatacccaagtcttgtaagtctcagtttcctcctttttaaagttagcctaaaactacctcgctcatctaatggtgtgagaattaggtaaacagccaggtagctcatcaaattgtaattattataattgttattttttgagtcatgaaagttttcacactgaagggaacatttcaacttgacctggaagagtaagtagtttatcaggcagaaagaatttgttagggtattccagagagaaggaacaaaatgtgcaaattcaagtagtcagaatcaaaatggtttcttaaaggaatgacaaacagatcagtgcagttggagcctaaagttatctaaataatccgttagaccttttctttaactgataaaataaagcaagcattccaaaaatcaatttaaatccatcttcctccttatacctctccattccccataccatggaaacacagttttacctcttttacaatgagttgtcagcatgaagagacttggttcattaagattagcaaacttcacagcattgaacaaaagataaagaaaagtttatagcaaatacgttccatgtgaaagcatctccagcaggttcagaagatgcaatgaaaagactaaaacttgatatagggatatttcagtggtgctcgtaccagcgtcctaacattttgttctaccttagtaaaatctatcccttattactcatcctatctgtagactctcttatggaacaagaagcttttttttttttttccctaatcccgtggggaagccctctccttccctgggtgattcctgagcaaccaggaaaacagcagtcacagtcaacacagctagtacttgcagaaaatctctcttctgtgatgctctgaatgactcacagttccagatggccttgtcagcctttatccgcattccactcttggcaccattaacctggtctactgtggttgcaacaaataacttttcttgttatgaggaccagtgttttgaaaaatttaaaatgttataaaattaaaatgtttatatttggaaattatttccaaatataaaaggagcctgtcttcattatagattatttggaaaaaatgcagaggggtgcaaaagaaaaatggaaacaagccatcttttttttacccataattctaccactcagagacaactactgtgaacattttgatgtatttatctccagtctttctagaaggtagatcactgtaagagatttctgaagcagaagtactaagtcagaaggaataaacatttttatacctcttaatgtgtattgccagatagtttttgagaaatattacagcaatttctacttttagaagtactgcttgagagtgatgttacatggtattctcactaacacatatacaatgttataaatatgtccaaaaataaaacttagcaactatgttatctccttgtttcaatttgaacttattacaagagtgatcaatttttaaatttaaatgttatttttagcaaagttatagatgcaaatagtttagagaactaagtagtaccacaaggattaaaaaaagagatctcctgcagtgcatcccccacccacaatacatacatgtatcttccactccccagagggtacccattttcaaatattttagctgattcatttgctatactccactctatctctaaatgatataactttacagttacttcttaatagttcatttttttgggcattgcttattgatacttcatagcggaagataaggatttacctttgcaacacttcacacttctcatcacccatccttctaatatattatagtcttacttagattgatagtcattgtgtttccatgagcagaaccaaagaaaaactataagcagctaaactatgtaacataccctgattacctttttttctttgttttccttcttgaaaattcttgtcttttgttagtttctttgttcccttagatgtccatatatacttatcactaattcaatcccaaacttttcccatattacaaaaatctaagtatggctcaaacacatcaagaattttattaaattcatcttcttgaagaaatctcatccagaggcctctttgacctggattggttattctccatgtctcttgctcagctgtcactttgggatgttctttccttattatcccaagggtaatgtttttagagtttattcccttgttttggtgagcacgttttccagtagcttcctgagtcagtatgcatcagagatacattttttaaaggctcgcacctcagaaataatctttattccatgctcactcttgatcaatagtttggttgagtatagaattcttggttgagaatcactttccttcggaatttaaaaggcatcacttcattcttttctaggtttcaaaacgaatcttcagaagtctgatgcccttttgatttttgatccttctatacgatacgataatgatccttagaacaagtcacaagtctcttttttaatactttatattgtgctaaatgctccaattaatgagttctggaaatttttcttcaattttgtcctcctgcagttttctcttttttctagaatttctgattttagatgttagatttcctgaactggtcctctgatttcccactttttcttctgtattttctacctttttgtatttttgctccatttccatagagatgtcctcaatttacctttcaacccttctattgagtttttaacttattctatcatgtttttactttccaagagctcttttcctattctctgagttgttttttttttttccatagcatctgcttttgtttcgtggaagcaatgttaatatttatgaatacaatatcaagtgtatttcttctcctctctctgatgataccttcttcctgcaacatctgtacttttttatttctcttctttttttttttttttttttttgagatggagtctcactctgtcacccaggctggagtgcagtgggaccatgttggctcactgcaacctccatctcctgggttcaagcaattctcctgcctcagcctcctgagtagctgggattacagttgcctactaccacgcccagctaatttttttatatttttagtagagacggggtttcaccatattggccaggctggtctcgaactcctgacctaaggtaatccccccgccttggcctcccgaagtgttgggattacaggcgtgagccaccgcgcccggccaacatctgtactttgaagttggtctttttccatttgttttggtttctttcacttactttttctaagtatttgataaatcttatctgtctactcatatttaaggctagagtactaaaaatcagattggaagctctgtttgcataggtaagatttgtcaactacatccactttttgatgatccaactgaacagtttcattcagaaataccttgcaccattatctttgggttttttctcttgggttggtgaattctccaaaggttatatcaatctcctgtccagaaggcttaagcatagttggaagctgactaggggaagaaggttgggactttcaaccttcggaattcattcaacaaatatttgagcatctatatttggcagcctctattctagccaccggagacacagtggtaaacagaatttaaaaagccttgtgttatcatgaacacaaatatataagtgtttatttaatccctctgttttcagaatggcactcagtcttcaacctgcctaggccccccttgtctagggacggttttacattcatcaggaagtataccccttgtatacttgtttttcagcttccaaaattttgttgctgttatctcccttcccactttctttgtccttgtcatttatgcctataaacatccattgatggttttctgaaggcagaggagttaaatggatatgttaattactatagatgtaatcagaggtcttcatgttgtttttttgttttctgttttactattctaacttggcatttatagatcttctttgtgagtagtctgaatttgtctttaatgatttaacattgaaacagtattttccttacttatttgcataagctctttctttgttagtgtattagccattgacctgcaatatcttttaggatgaccgattctgaagcctgctgactgagttgcttgtggttcctgtcatttagaatgtatgcaggtcatgaatcgcttagatggaacagatggaatgaaacttgctctaaatattttaccaaaataaatacatttaaataatgtaaagaaaaatcttcaatcactaggctttgaacttataacagaaaggtatctgcttttaactatattaattcaacaaactttattgaacagttggtaagtatgaagcatcatctctctgagaacaaaataccaaggaactgagtcccatccttacaggattctcaggagtaaatgggtcaatacatagttataaaatgatgagggctgatctatagcagaagtacaaagctgagaacaactcacttgacctgctaagctggggaattcaggaagggttcagatctaaagagcagacatttgaggtggttcttgaaatatgagcacaatgatggttttaccaggctgcaaaggtgacaaagtgcattccaggctgataaaagagggcatgcaaaatatggcaggtacaaaaatgtgtatttaaggaagaatgagaagtttctggaagttgctgaagatacagaaaataaagtggggggcggggggggcgggtggttggagatgaggaggagatggtaggcttgattcaaattatggaaatgtatttataatgcaccaacttgtaaagacactgttgttccctacccagcagccactagaatttgttcaggtgtcaggcggttggtgcttcaagggagatcaggcccctcccaggaccaggatgaaccatgattacttcccagccaatttcatagcatttctcttgccaatgaatggcttagatataagcatatgatgaatttgtttctaatacagatctgagaaagaaatctgttaaggaacttctggtaaagtttttatctttcttaaaaagtgacagaagaaaaggaagttgtataaatatacttagagctgctgtagtcatcttgagaccataagaggataaaactgagatcaaaaactactgtgctgaggatgggtgactagaaagaaggaaagaatctggattcttgatgcatgtttgtactactagaatcattctatcactaccttcttattatataattcaataaatctcttattatttaagctattttaaatgaagccttctgttatatgcagcctaaacaaatatactgattcaagctcccagcaaattctgtcacacataattcaaggaacgtttgttaataacttcatactattatatggggaataaatgattagtcaagaaagactttctgttttgaaaaattctggaaagatgataatacagtatgtagatttattgtcatggctaatatacatctacatataacatgaattaccttggagtagtaataaaagggcagagtaataacttgtgcagagccctagactagaaaagttgaaaatataaaatggaggaaaaagtgagttatgagattcagtaatatgaaagtataagaaataaaagaatccaaaagccatagaaggttgaaactgaaaagaattttagaaagcgtctaggccaggtgtggtggctcacacctgtaatcctagcactttgggaggccgaggcaggcagattgcttgaggccaggagttccagaccagcctggccaacatggtgaaacctcatctctactaaaatacgaaaacataactaggcgtggtggtgcatgcctgtaatcccagctacttaggtggctgaggtggaaggattgcttcaacctagggaggcagaggttgtagtgagccaagatcgtaccacttcattccagcctgggtgacagagtgagacactgtttcaaaaaataaaaagagagtctagcctaaaccccttaattatacagattgaaaaccagtcctggagaaattggaagtcctcaaagagtttaccattaatggtggaaccaggacttccacacaatgttctgacttcctttagagcactttttattatatcatatagttccttacttctcactattaatagagattattttactaagagtaagtataataagagctgatcagaagacctgagagacataatggagtttcaattctaatttgctgttggctccttgaaatgctttgttgagaaggagtaaaaagcttacaaaacacacacacacacacacacacacacacacacacacacacacacacacaatttcttaattatgtctaccatgggcatgggatggtaggaatgccatgtaactagtttccatggatggaaaccacctaatgggaaatagagaaaaagaaaaagaaaagaaattgtgtgtaaattttcagctcattttggcttagattacatgatgaaacttatttctttgaaaaactcatttgattttgaattagattatatggaacttctcctttgtcaattttaatttcttgtcttgttttagtttgcttttctgagcagtagatatcctcccaattggagattccgcaaaattagtacttagtcatcttggttcctttcaagtagaaaagtttcttttaaatacttcaaatcattggtatgcacatttgttgcaaaaaaaaacctcattctggaaaatgttgcttattttattatccaaaaaataggtatttattaatatactgcatttcttttaaataaaataaattacagattttcttccagcatccacttatttggaattgggtacatatgaagaaaagacttcttataatatggaattatttcaaaagctattattacttcttataaatataaagcatacaagaaattctcaccattttctaagatttacattagaaagatataagtattgtcttttagaatactgtttttatttttctaaatattccttataacttacttattaattttatcctttctttgttataaatatccattttttttaaagacccatactatcttttcctatgcaatttaacctaacatattttctgtaaatgaggttatttagttatccatttttctacctcctgttgcttggcagtcctcaaaaccattgcagatctttctagagagcagtttttaagaacagtgctttacttttcaactcttgatcaacctgatgagaattctttgaataaaccagaaggaaggctaaagagacaaaagaatactatagtttccttaaagttaatgagccagaatcctttggcccactttggcattgaacaatgtgaataaaatggccactctcacatcagtaatttacattttatacagtgtgtactttacactgatatttacaaagaggaaaaacaacagttttttacatgtaagaggagctccttggcagataaaagaaaaacttactcccattagtacaacactggagtttaaatctagagaacaagtacttcagaacctagtagaaaaagtccctgatttgtactttgtatgaacaattaggtttgagaatattgctatataatcacagaaaatactggctattatactacgtgaagtcttcagtgacaaagagagaaacagaaaaaatagttaatgccataacaatgaaaatgtggaatgtgaggaacgcccagtgaccgtaaatatctaccttaataagcctgacaatttgtatacagttcatgcaattaacaagtgtgataaatatgattattactctcaagttgaaatcaattttcttggctaaaagcaaagaattgttattgagcagatgggattacttttctttgccaatttatcttcataaaactcaatcaatgccttgccttaaaaatgtcaaataactcagatttcaggataacacatacaaactaatctcttctgcctgtctctacctgatcactccctacttcaaaagctccaacaacatagtataactgacacaaatcaaagcaaaaactatttttctcactgctacatggtcttatcaataatccagtatttcaatatctaataaaagataccacaattcaaagcagtaatgtgccccaagctaccgatccacaacatatatattgatatctaaaaatatatggatataacttgttatctactaaataagtttctttgcagtgtggtgttaatagccagaattttaaatacataaaaacttgggttcaaatcctaactctgccacttaaatgctatatgacaattggtcaagttacttaacctctctctggtctcaagtttcttgtctgtaaagctgtaatagcttttagagtgctcttctgaatattaaaaaggcattatactcttagcataatgtctacatagagtaaatatttaacaacaaaataacaaatattaggtgtgttattggagaattggagttttaaataaaggagttgtccctaaggtacattcaatttaactatgatatttaaaacttcaatttttcacattatttttccaggaaaatatttcactcttatttctccataatttgttttgaattgtaaaagagatttgcaagcggctgaagcagttacactatactgtatatctgcaggatgggcaactgattttttttttcttcttttttttttttttttgagacagagtctcactctgttgcccagactggagtgcagtggtgcgatctcgctgcaacctctgcctctcaggttctagggattctctgcatcagccccctgagtagctgggactgcaggcacacgccaccacgcctggctaatttttgtattgattttcaagatttgtcaagagctcctaatattttcttttctcaaacacatcttaggactaccatgcatatcagtcagtcagctactctggaggtctgctgcaaggatacacaccttccattcccacccatcagatacttgtctcctttctcccccactccaagacagcaaccttccagctctagataaaaagagctagtctttcttgcataagaacaacaaagacaaaaaccattttggtagtgtatactgcagattttaaccaaaacttctctgaagacctctgatttcctaaaaaacctcttcatcccagtgcagttgctctttcctaaatgagcaaccgcgcatctggtcaaatttggtgaatattctgtgctccagaaacaactgattccatcccctttaatctcttcttctcttatatccatctccctccttgttgtttctctccatgtttacaactagttcattgatttaaaaaccaatgtaatacacaaggaagtatgcacgacaatgtttagtgtagtatggtttgcaatattaaaaaaggccatcagtaagaaaatagttaaaggataaacttgatatacatactatgctgcaatttaagaaaactggtatagatttatacgtactaaaataaaataatctccaaaacatagtaagtgcaaagatcaatcacagaataacatctgtagtatatcacttttgatttttaaaaattacccctaattctaaatgttcatatatataaatattcagttaaaaattctgaaaagatactgctatggtttgaatgtttgttccatccaaaactcaggctgaagtttaattgccattgtaacagtattaagaggtaggactcttttttttttttttttggtgacagggtctcacttcaacacccaggttagagtgcagtggcatgatcatagctcactgtggcctcagcttcccaagctcaggtgattctcccacctcagcttccagagtagctggaactacaggcacatgccaccatgcccagctattttgttgtatttttttgtattgatagggtttcttcatgttgctcaggcaggttggtctcgaactccttacctcaagtgatccacccacctcagcctcccaaagtgctgagattacaggtgtgagccaccacatccagcaagagttgggacttctaagaggtgttaggtcatgtgagctttgccctgatgtaagggttaatcctgttatcactggagcaggtttgttataaaagagtgagacgtttggtcccctttcctctctctctcccaatctgtctatctctctcccttttgctttctgccatgtggtgatgcaacaaaaggacccttaacagatgccagcaccttgattttagatttcccagcctccagaactgtgagccaataaatttcagctcatgataaattacctagtctcaagtattctgttagagcagcacaaaatggattaaggcagatatacaccatattgtatccatcactaagtggatactttcaagaaagacagcaagactaaggagcatgaaaaaggactttctcatattctgaattttaaaaatattttatgacatgaatatatttatctattacctatgtaataaaactagacattaagagaaaaatctcatggtagaaatcttaggaaatagagaaaaattagagaaaattaagaaaaagcatgcataatttcacaaaccaatggtagccactgtaaaaaaatgttatttcattctaatacatttctacacacatatgcacacagtgcatttttgaaaacataactgagtcttttctaattgacctcttactctacaaaatttgaaatagccaaaacaaatttttgattcctataaagagatagcactagagctggaagagatggctcatgcctgtaatccctacactttgcatgactgaggccagagaattgcttgaggccaggagtttgagaccagcctgggcaacatagcaggacccatctctacaaaattaataataataataataataataataagctgggcataatggtgtgtgcctattgtccttgctacccagaggctgaggcaggaggactggttgagccctggaagttcaaggctgcagtaagctatgattgcattacactctacccagtgtcaaggaaaggaaaggaaaggaggggagaggaggggagaggagaggagaggagaggagaggagaggagaaggggaatgggcaggggcaggggcaaggcaaggaaaggggcaggggcagaggcaagggaaggggaaagggcactaggacctatgagccaacataggctatggcttccactagtacaacttaaaactcagctgaagacatgacacatagaaaagggttgctgtgtctgtacacacacacgtttcccatgttcccaatcccagtctgtggtcagtgaaagtgaagattgcctcagagcctgcattatctcaagctactgacctaattgctaatgctttactctggtctatttcctgcatgacctcagaatgtgtcagtgtaaattccatagtaagacagtagttgcacattttggagtgtggattctgctttgaaacacaaataagtgtgatgaacgtgaccctggcactctgtagccctcagtttcctcaacgctaaattgatcactacagttccttctagtgtaaacagtcccacgaagaatcgtgctgaatggatgactacataatggcctgctcctagagttcttaaatcaatccttaaaactggctgcaaaatgacttcactcctttaacagtgtgggacttgtctctgttctccagaatgctcaccagatggtgaagaagtatctctctacctaccaacatcgtcatattgcttcttgccactcgctactcaaaaactgtgaaaaacctgtgggagcaagtatcagctgaaaagggtggctttctccttaggcaaaagctacagggcaaaacgggggccccaaacttctatcacgtcaaagacatgaaacagatgatccctagttttgatcttctttgaagtttattaaaaacaagcttgaatctgtaccaatcctgacaggtgtgaatgtaagactcacaaatgagaaatgctaagctttcctaatgttcaatttaatcttatagaccatgaaacatgttataattaaagatctgaactattaatatgaaggagatagcatatattcttaccccaaatatgactaactaggtaaaatcttcaaaatataatcatggcctgattatcagccattgtggaggagaattttaaaaagttcttcattgacatcccaagtttatgttttagacacttctaatcaaacatgaatagattaacttcaagtaaaaattaatagtcacattattgattatcatgattggaaatgtatttgaccagaacaatgaggaaagagcatagagtcctgctatcttcaagtatgaatttacacttttaactgatgtcaagtcatccatagtatgaaaactcatttatttttatttgaaaaatttaaaaccatcaaaatggatagtgtgggagccaaataatatataagcaatattttatgagaactacaaaactattaagagcagtaactagaattcggttactgccgttccttatttcagaagagaaagtcaaatgttttctgatatttaagaagtaataacttcctgttgttcagttatgctttctataattatatatgataagcaacagaaaaataggtctggttttggctgtaatgtgtatattcaattcaatattaatttggactttaaatcattttgctatcaaatattttgaacctcatgaccaggaagtaatcaggtaaaaaaaaaaaagaaaaaaagtgggtttgttacctgacctatctcttaagttcaaactttctataggtatttttctctacctttgtccatatggttatacaattatcactagatgcttgaattactaaatggttttgtatatcttttcctcaaatttatatttgtcctattattggcttagtctctcaaagtattacttttatgatattgctataatggtcctctatagtataaagttgagcccacaccatttatcctgccacttaacaatgtccttaatgtagattatatggtttggccatgccctaaccaaaatctcatcttgaattgtaatccccataatccccatgtgttgcgggagggactgggtgaagataattgaatcatagggcagtttcccccatgctgttctcatgataatgaatgagtttcacaagatctgatggttatataagcttctggaattttccctgctggtgcttactctctcctgctgccctgtaaagaggtgcattctgccatgattataagtttcctgaggtctccccagccatgcagaactgtgagtcaattaaacctcttttctttataaattacccagtctagggtatttcttcacagcagcatgagaatggcctaatacagtagtatatcacacttattaaagagttgatagtaaaatagcactctcagtacaataagaatagaatagttccttttcatggtaatgaatagcttttcttcgacatctataattaacaatgaaatcagaaacaaaaagaagctgtctccactattactgaatgttgctcagaaaattctaacgtaagcaaccaaacaagaaaaccaaatatgctgtacaaatatttttaagagagaaggaaatcattctattttaagataaaaattctgtaactcaaaattcaggagaatcaactgaaaggtataaaaaaggtagaccattatgatttataagaaaggtcaaacattataaagcatgtatccacaacaggtttttttctatataccagttagaaaatagataaatgatcctattcataatagtaataaaacatatcaaatatgtataaataaacaacgaaaaatgtaaaactcttgtataaatattattgcaaaacatcactgaaggacatttttaaaaacttgaagaatatatctagtttcctacatgggaagagtcaatattataaagatatcaagtcttagattaatctatgagttaaatgcagttacttttgccctaaaatgttaaaaggctcttaattatgcaattcgaaatgtgatgtctactttcttcttgaaagcatttttcctggaaccttctgatgactctaacttaggctgcctgctttctaggcctactactacacagttgtcatactgggatttattttcataaacatctgggttggttccaatgctctttgtatcctaggttttctgtataggattcccgttgctttgttttgcttgaatatatcttcgagtaatacttccttttaattaggaagaatctgtaggaggtaaagttgtaaacttgagtccttccatgtttaaatacatctttagtttgtcttaacacttgatagtttgactatcaattttgggttctagttcttcttcctgagaactttgaaaccttgcctagtctgcattcacttctaatcttgctgatgagaagtttgatacctttgaaagatcctttttttttgttctctggaaggattaatttcttatacttagaattccaaaattttcatcagcatgtgtatacacatctagatatgtatccttttttccttgttcggtgttggatgaaacttttcaatctgaggacttgaattactcttcaggtcaaggattttttttctgttattttcccacatcctttcccattcctccacttctaccacattcttcatatcttttttacttttccatcatattttatatccttggctttttgctctatattctaagatatttgcttaattcaatattcaagaatgaatattacttgaattgcattttatccaatctttatatatacatatatattcagtattctgctatttatggaaatcagatcatacttaatggttatattctccccctgaatatctctgaaaatttaatattgacaaatttttcccacacttttcattgtctctgtttcttctggaaagcagaagataaattgtctcaggaaaataaatttgtcctgtttatttattagttcctttttgtttaggctactggtttttttgtttggtttggttttttgtcttttttcaaatgtctggtgatcctttcttgactgggaatatttgtaatttaagaactaggagtttcttaagtagttggcagggatatcataaggagctctgtagtacttataaactgcttataagcaacttaatgcaatttcaatcaaaatcttaatgggtttttttgggggggacttgacaagtagattgtttgtataatttagcacaacgatgtgagaataacccaggaaattctaaaaaataagattaagagggaatatgttctcccagatattaaaatgtatttcttaaaatccataataattataacatggggctttttgtctagaaataggatgtaaagattaaaaaaggaactaaccataaacagtagaagtggcatttcaagccaataaggaaataatagattatgtaatacctaggattctgacaatttagaaaatctaggaaaagaacatcagagccctgaaataaagtaaaataaattccataattattagagatataaatatatgatgtaaaatgattaaatactagaagaaaatattggtgttggaaaagaattgctaaggatttataaaatatatttatatagagactatataaacaatataaacatacaggctacatagggactatttaaacttctatttattaaaatagagtatctgtaaaagtaaaaatagaaatgaataaatggcaaaaaagtgtaaaaaacaaacataaatgaaaagttaatattcttaatctctaaagaacactctaaaatcaataagaggccaggggtggtggctcacacctgtaatcccagcacttcgagaggcagaggcagtcagatcacttgagtccaggagtttgagaccagcctgggcaacaaagtgagacacctgtctcctaaaaaataaataaaaataaaatcaacaagaaaaaacaaatcagcccacgaataaataataaaataataaaaagcaaatatgtataattgccattagacacacaaaacagattttaatattcttgaagctaaattaattcttattaaaacaaaatactatgtgattcatcaaataaagagaacaattaaaatgataaaatatagcaacggaaataatgtagaaatagagactgctgatgaagtatatataaactttctgcagggcaatatgacaataatagcaaaaataaatctttaaaatattgggcaattctttagtttgacaattctaattctagaaatatatagtaagaaaacaacccagccttgctataaagactctacacaaagatattcatcacaatagtgcttataatgtgaaatctggggagagcttcaaatatttaataatagaaaattgcttaagtgtagtatattcatgtaaggaaatgccattaaaatgttatatagagaattgtatttaatggtaagaaaagtgttcatgatgcaatatactgtgaaattttaaaagcagattataaaatattaccttcagtataatctcattgttgttagtaaaactccttctctctctacatacacactctcacacacagagacagaaaaattatctctcaatggcataattattgacagttcgttttctcccccttgcttattattattttgtaatagatatgctatagccactcaataaatatttgttactaatttcaaaaagtatgtattattatatccaggttgttcatggaatttatcatgcaaacaactaccctcttgagagagtcaaaagtggacactataaattatgaattcatataaactatatcaggacaatgggcataaactgagtgtcccaggcacggcaaaatgtgcggataccctggagatgtatcttgactttaagaagtttacaatctttcttggggatagaagattaaaaaacatgaaaccattagaaataatctcccacaattagttttgtaaaagcaagtgcttaattgtacttgacaaacattagatgttactggaggtctaagaagtaagagctgaatactcgtcagaaaagctccctggaggaagtggggactgagtgatacttttagaataggtaagaaaaagaataatgagaacttttcaaatggaggttggggttgtagaaggaaaagaatcaagtattcagaggtagctgataacgatgttgtatatataaaatcaccctgacttttgcaaggggtccgtctatacagaagagtaaaaagtaaacaatctattaacaatgtactatcactgcctccactttacacaggagaaaatcgaggctttagaaggttacataacctgccaagggtcacatagctaaaagtggagagctgagatttgaacctaaggagttggtttcagagtctatgctttccaccctatgctgtactgcccactacagtcaagctctggcttcttgtataaatctgatgtcactctttgtgggactgcttataacatttcctcacccagaatccatacctcctcctttctgctctgtcagagctctttgtctattcacacacagttcaaagaataccttctccatcaaatttttctaacaattccaatcttggaattctctcctaccttggagttgagaacaccactctcctaaatttctgcctacttctcagccactacttctcaatctctttgttggattcttctttctctatatttttgtttttttagtctactcattgcctgtgtgagtaccttcacccccaaaactacaatacctacctaccattgtgctgaaaaccccagcttacattgctcttccacattccataaatttctatctggatgtgcacagacacctcaaacttcatatttccaatactggcatttaccctatctgcagtttttactatcttatggacagcagatgccagaaatctaatcactgaaaccagaaacccatgtacaattcttgagtcctccctctctcaagcctaaaatcctggaagtcaccaagttctgtctattttactctataaataactattagattcttctttcatctgaactcccttagttcaagccctctttgtttctcatatgattattgtagtaggctctgaactggttttcctggtacctgtctttcccctgcctactccaattctacctccacatcaacatttctcaaatttgaggggtcatagacttccaaggacatttccacaatccctgagaagtatacagtttccatatgagaaatcactgtagctaaaagttaaatacttttcttcagttgattatgtatagctaaggcaataattcaagcattagtaaatacaaagccaaaatgcaggcacattacgcagaaaatgcctgttcttgggtttttaaaaaatacgttaaaaaaataaggccagatgtggtgactcccacctgtcatcccagcactttgggaggctgaggtgggatgattgcttgagaccaggagttcgagaccagccaagaaaacatagggagaccttgtctctacaaaaatttttaaaaattagccaggcacagtggtgcgtgcttatagtcccagctacttgggaggctgaggcaggaggatcgtttgagcctgggaggtcaaggctgcaatgagccatgattgccactgctctccagcctgggtgacagagcaagaccctatctcaataaataaataagaccacaaaggaaaaaaattcttacagagaattattgaagtataaattgtgtcaaaattgaagaatataataaaccctaagattaatagtcctgtccttgagaaagatcatcaagtgatgcccccatgctttaaaaaatattccaagctttttagcataatatctaacatttcttagcagttcctaataggttacttctctgtagttacctctctcactccttccccatcacctatagtgccacaatctgtaacctgtttgaggctctctcacacctttcatactgcaatatttgctcgaactattgacccccaaccttactcatctttcctttctaactaactaacttctcctcatcctcaaagccccagctcaagaattttcatttctggaagaatctctgattttcttctcttctctagtcttgaaatggtatgtgtgaacccacagcttgttgtaatgtcattgtcctttctgtttaacaccctcagttgctggtccttgaagtctgggactgtcttaatctactttaaagtcttcaagccaagtacaattcctaggcatgcaatacatgtttgttaaatagatggatgacctttatttatatttatctttcccttttctgctacaattagttaactcattcatttcttcattcactaataaccacttatctgttattttctgggaatacaaaaattcataaaacatcatccttgcctccaaaaaacactttattattgtgccatccttctctctctttctctttctctccttctctaattatctagttgtgtaggtattttcttcaaaggaataacaggtactcagaggaacacttatacactgttgatgggagtgtaaattagttcaaccattgtggaagacagtgtggcaattcctcaaagacctaaaaacagaactagcattcaacccagcaatctcatttctgggtatatgcccaaaggaatataaatcattctattataaagacacatgcatgtgtatgttcattacagcagcattaacaatagcaaagacatagaatcaacctaaatgcccaacagtagtagacaggataaagcaaatgtggtacataaacaccatggaatactatgaagccataaaaaagaatgagatagtgtcctttccaggaacactgatggagctggaggccaatatccttagcaaactaacacaggaactgcatgttctcacttgtaagtgggagctaaatgatgacaactcatggacacatagagggaaacaacagacactgtgacctatcagagggtggagggtgggaggagtgagaggatcaggaaaatcaactaatgggtattaggtgtaatatgtgggtgatgaaataatctgtactacaaaccccatgacacaagtttacctatgtaacaaatctgtacatgtacccctgaacttaaaagttaaaaagaaataaaaaataaacagaatagtagggattcattacaatatcttctctcctcctcataattcttaaacctgtgtagaagttcaatacatatttgtggaatagccttattacgcctttagggaatggagcaatgccttgcctattaatctatacttctatcagagtttcctgctgtatggaaaacctgagtgttacacttcaaacaaatgaggcaatttatacatttttgttgttgttgttgttgttgtttttggcataaatgtgctaagtgagctggagtttcagaagagaaactgaatgttatatgtgaatccaggtcagtagcttggctctgactacaatactgatttcattcaagataaggaaactaattggtatcaattttagttgacattatatgttagttttataatattcaggaatttttgaaggattatttgatttttatttttatagatgttcttgctctttaacactaaataatgaggaaagataatagggctaacatttattaagcatttatgttggacaggcactgctttaagtatttttatatgtatcaactcattgaattttcacaactcttagatctatttgatagctggggaaactgaggcacagagaacctcaagtaacttgcccaaggtaagccagctagttagcatggaccagtgattcaaaaacaggcagtctgtactccttacaactgtattatgctgcctataaaaggaccactagactaataattatgaaaccagatttttaatcttaaattagccatataatagtagagtgcatttaaggatgtcatctgagtttcattgtccttgtaccccttacagcctgtgagaaggaacctttatatagtctttcataaactgtaaagtgttataaattcaaagatttcttataatatgttaaaattacttttaagagttgagaagtccaaataaaagcagagagatgagaggaaacactagcactaaatgttcagacacccactgaccacgtcaagctgcacattttgttgctaaacctaagggagagattagatatgaggagagtgggaagcaagaaggtatgaagtctgggtatttagggactaatagaaatgattttctcgattagtttaagaacattagcaattacttacgggataagcacagttaaaggaatttctggaaggaataaaactataaaaattagtcaaattgttaaaatatcagaactgtgtaaaagcatataaagtttcatcatatctttcttttgaaaaacaaacaaacacttcatgttctagccagttgctaatagtgatcagttgatgaatacacctcatgtttcacgcatataaaattttacaccatgtctagtccataggcattagtgtaggagtcagaatacaacctgaattctgttcgcagctttgtgccttgtcgataaagcagtggacatctctccacagggagatatgtttcctcccgtgatatagaggatgttgattcacttgtctcctctctatttcgaaaagatgctctgaagattagtgagacaatggctgtaaagctctttgcactgtttacaacataaatcatacacagacatactggcatgagaaacgctatcatcatctcttttatacatgagaacaaccataaggaaaacaaacctcagagacagtcctgtattataaaaatgttgggtagagatgccaaaagttgtagggtaggaaacagcaacaacaacaacaagacggaatccaaagaatatttgcattctataatatattctacagagtctcagacgggaccttcgttgagtgctcccaagtattatcagtagccatgttttttttttctttttcttttttttttttttttttttggtaaaagggataaatagtgatgtcaggagatgctgcaaaatatattccagtgataagcatatggcaagcaattaatggatgaattcgcctctcttattgccatgttgtgacaaatactctaacttatttggcctttggctccctaaagggtgctcagaaatgctgtttagaaagtacttttcatgaagagctacaacaacaacaaaaacaaatacaattcaaatatctactaaacatatgaaggagtactcactctcattagtaatcagagaaatgcaatgatcccattatagagccctgtcatttgaaaaaaaagaaagaaaatccaagtgttttttattagaacgtggagcaacaggaattctcattaccttctcaaccactttgtcaaatgctttctgcttatctgctgaagttaaagatatgcatgacccatgaatccactcctaggtatattcccccacaaaaatgtacgcttatgtgcatcaagatacacgcacataagtgttcgaaatatctttattcataatatttccaaactggatatgttcaactgcataaagaaagaagattggacagtaaattgtggttcctttatacaacagaatgctatatatcatgatatatattatgatgtgcaatcctcagctacatacaacattgatgaattttacaactataatattgcacaaaaggagcaaaacacaggagtatctacaagatgagtccatttacataaaatgcaaaacaaactaaattgaactgttgttttggcatgcatacatacgtggtaaatcataaagaaaagtaggaaaagtaaaagtaaagtcaagatagtggtgacctatctggagaggatgaaacaggaaattatagggtctttctgaggggtgatcatagtaggtatttactttagaacaatttgttaaacttaaaatttaaattttacatactttcttaaattttgttatatttcacaatttaaaaatttataaaatgataattttacaaagcctaaaagatgaattatttgggggcttttacttctctttcatctgtacaactgctgatgaaaatcaccaggtgtgtataacatgaagcatctccttaaatgacatgcatttattgggaaaaaacacaaagtccaaatggtaaaatgttagcaaggtaaaacactgaagatttttctccccaaaactgccaaacaagtctggtttaactgaaattgacagcaaagacaacagagcacacttaattgaattttaatctcagtgatctctaagccatgtttgaaacataaacagacatgtcagagttctttatgatgttggacatgaattcattttcataattcaaaggcatactttgcttatgaatctctttaacaagctttggctgaatattcttttcttccagatgtttgctgttgtatacacacagcttccatctctttgcagatgatttaaaacatagttagaaagagtacatttatttaacaaaagagtaagagtacagaattcaaatagatcgtctgtgggtgtatataatgatgagtacataagtctcatgcagtcctcataaagacagcatctattaatctgaagaagtttctcttactaatttgcaaacctaaaagcattttacattactaagatattaataaataggtcaattaatacttttgatagagtagagagactcctaaataatggacatgaaaaatgattttgtaaaagtacggtttcattttaaatccctgcttaagcaatttgtaggaggcaagatagtgtggcagttgagaggatggtctctgaaatcagatctgaatttgaataccacctctaccatttactaacctaaacaagtcatattacttctctgtgtctcaatagctacttcctgaggtgttcttacaaaaacacaaataaataatccatgtaaagaactttgcacagtgcaaatacatagtgagcacgcattgagttttatttatcatcatcatcatcttgctgtacttttgtaaactcaccttctcccgtctttttctactctaaggtgctcttccaagctactttcctcctcagctatcgttcccctggatttccagtaagagagggtgaaatcatgcctgcttatcttctttctcttttactgatacttcactgaagtgaaagtaaaggaataaaaacacaacacacccacccacaaaggcacaaataataaaggaaacaagatcagcaaaggagagatttctactgattttttgaaatcagaaaatagctgaagtgccttagcataatcgaggaaatggttacggagagtaaattccaagagaaagtggactaatgtgttctcccgaatccagaaagacttactgcttggaggcagcagaattaaggaaggcaggagtttagcgaggggctgaaagtgtattaaaattatatggagcctttggatccaaactaactacttcccttacctactggaagcggagtctttcttttttggaggaaatcggctagagagatttgaaactgatgatactaggcactgtagcaaactaggagaggctgcaggttgcgaaataggtgcttatttgaaagcctatagagtttgcaataagaaacccaacttttttatttgtcatgctccccagacattagcagtcagttatatgccccaggcgcaaatctcgcaggcagaaagtggggtaccccctaatcatgaccttggggaaacatttcaaagaacacaccggctttgattgaacaacctatgatgcaacagtgcaaccctacagttgacgagccctatccatgatcacagaacttctgacattgtttcttgccatcattgtcattgttgctttgttttgtgtgtgtgtgcatatgcacctgtatatgtcttgcttttaactaagaatgaacagcctcttaaggaaactctccataatgaagaagagaaactagaagaagcaaacatcaactgaagaaagaaatctacaggaaagagagagacagaggaaaacctcaagaggataataatctgtgaccttagataaaacacacttctgacataagaacatataccattaaaaaggagaggatgaggctgggcatgttggctcatgcctgtaatcccagcactttgggaggctgaggtgggcggatcatgaggtcaagagatcgagatcaccctggccaacatggtgaaaccccatctctactaaaaatacaaaaattagctgggtgtggtggcatgctcctgtagtcccagttactcgggaggctgaggcaggagaattgcttgaacctgggaggcagaggttgcagtgagccaagattatgccactgcactccagcctggtgacagagcaagactccgtctcaaaaaaaaaaaaaaaaaaaaaaaaaaaaaggagagaatgagagtgctaaattatttttaaatcatgaccaaaataaacattttaatagtaaggttggaaaataaaaatgtgtgtgaacaaatcttctagaagaccaaaaaacaaaaagacaaaaaaggaagaaaacaattaagaaattaaaggatatgatctaggagatccaactaagataatgagaattcaaggaagaaagaacagagaaaatagagggcataaaattatcaatgaataagagcaaacatttcagaactgaaggactcatatctctggagtgaaaaggtctattgcgtgcccagggcaatggataaaaatgcagaccaagacaattgatcatgaaatgtgggaacttcagtaaagaaaagaaggtcacaaaaatttctacacagaaaaagatcaggatttcaccaatagaaaatactggagtgatgcctacaaaatgttcaaaaaaatacatttttaacatagaatccaattgcagttaatccatgcctgagacaaaaaaaggtttaaacaaagggctgcctctgaatagtatatagaaaagatttctgaacagaaaatcttaaaaactagcttttatccccaacttggatactaaatatagagacaggcaagaattaggggtcttcttgtcattcttctgagactctggagctcctgagacttctttttcactaacaccattgaatccgggaatcaacaagctgcacaaagttataaagattgccagacttcatgtttctggaaaaaaaaaagtactattttttcatacagctgagacctctgaaaagatggctcaatgggcaagatgccatgagaaatcaaagccaaatactcattctgaagtcagttttgctcagactttgtatactgccactcaatttttcaagtcatcagaaacataactaagaatgagtgactttttgctatcaactaatgacccaccattcaacgatcttgtatgacaaagtagaggagtatcttcttatttttaggcttattaaattacaatggaaaatattcattaacaatctcataatgaggcattctagatgcttattcttacctaaagggaatggaacaaaaaataaccaaaaactaaaaagatgaagacaaaagcctttcttggtattatagtattcttttacaaaggatatggtttatcatagtaattgattccctctgttacactagagatactattatattaaatgcctaaaggttaaacttaggtaacagtggagctatagttctttcagaaataaaataattaaatagctatgtatgccaagaaaccttactttgaacatttctattgtaccatctcattattgctggctgcctgattagcaagcagtaaacttgggtaatagctttcctctgatatcacttcaagtctactcgagttctagaattacccagactaccaggactttacttgcacaatatgctgaaatgtttataacattatgctttcccctcctaattctcaagaccattttgataactggctaagactggataatatcaacaaatatgaaataattataagaatcattctttcttaaaataagaagagtttccagaaacagaaactaaaacagaattcaggctaagctgctaaataggctatctcagggattctcagctcattcttgatgaggatagattgctttttatttcccttaagtgttccgtatttatttcacaaatattacttaactgtgtaccatgtacaaagccgtgtgctagttaagctggttactgtggaagaaataaagggagtgggagcatctagcttttttcttcaaaggagatgggggaatctgtgggagttagtggtaggggcacctacagaggaaatagctgaaaaggaggagctggggaagatgaggatgaggaactaagttgtgaataaaggaagggcagagcaatggtttttttaataatattggaatgggatttgtttttagcactgctcccctttcccttaacagtccccttgagctacaaataaatgtaactggcaaagtggataataagacttcagaatcttctagctaaccatgatcaatgtgtcatggagcccagtatacaaggagaggttctatttcatcaagaaatatgactgcacttttagtgggcaattggttgttatgaaggtccagcatttatttcttcttccttttgaaaaataacaccctgatttcctttggggaacatccccatggtcagatgggaccactgtgattgactgattggttcaggagaggggctatacccttaattatgtgggagctactagaaagagatgctctctttttttgttggacataaaaaacctggaaaggtatggcactagattgcagacattggtctgtctcatgtggatagagcagagaatgaagccaaaaatggagagttcttctgatatcaggcatcagggagaaaacaaaacaaaaaacaaacaaaagaataaaaatggagagttcagatacaggacccatagacagagaaactaaatcctcatgaagtgttctaattgaaacagtatctatggtctacctaaacctcatgggaaccacattaaatggcggataaagccattaatatactatacatagaagagatacatccacaaggacatcttaccaagtgtggacacaagtgtgtaacaaccacttattggtgtataatattataatccacaacatcagattttactctttaaattcactagggagtattctcaaaggaatggaagaaacaaagctggctatcagtgaggggcattatgtgggtaaatataagtagaaacttcaaaataaatttcttaaaagcaattttcactttctgaaagtttatatggaattggcaaatgacaaggattgtgatcattgatacatgcaagtcaacaagcaaaactaaccaaagagacaaacagacacatgaataatgaggcagttctgatgaccaaaaaacacaactttacaagactgtttgggtaatttattttgactggtaatacatcatgtcagtttattttatttaagccacagcaacgtttgtcttcctgacgatagttattgcattccagagaagtacaatacgaagtttcagactagtgctgggcttagtcacacagagaactgcagtaggttttctaagcccctgctcactgtatttcacaaaaatctcatcccttctaccctccactctctaaacacacatccaagcaaatcacaccaaggcataatcattgaagaacaccataacttgccaattaaaatttggcaaacagaaacattgaagcaaaactgaaaaaagaatcatgtaattaacttagaagaaagcttttttcttaaatattatttttcttcccattcagcatgcacaagaagcaaactttgagcactaacgtgttcctttttagcctttgcctgtttgtttcaaagacaagaggagaagagtctgcttaaaagccaaatacactgataaatgtttactgataaaatcttccagatgggactactttcaaggaaggtcaattacaagccttgtgtctctccttttaatgatatcctttaatgatccccttcctctcctagaaaattaagtcacaaaaacatcttaggctgagagtgacccagtaatcctcataatcacattgcaatgacagacaagaagatcaaagtacaggtgcagtgagaaatagggttttacatcctattataaaatgtgaacttgccattaaccaaagatcaaatgtacctttaactcccaaattcccaacttccaatattttttaaattctgtggttttctggattaataaactttctctaatataatattccccctcccaatttttgtactaaacattggtggttttttcttcacatatggtgattatgttttcatatatccaataactaaataattttagaaatttggtaaattgtgttgaaactctaatagcactaagaagttcccaagctagttggtaagctattgtctccaatactgcaaagagaaaacctagcaatggaaattacataaagataatctgatgctaatatgttagttagaaagtgaattaggcatctagtaatggcttcaataagaaagaggtttatttttatctcatattaagaaaatgtagcctgggcatgttggctcatgcctttaatcccagcactttgggaagccaaggcaagaggatcacttgagtacatgagtttgagaccagcctgggtaacatagtgagacctcatctctacaaaaaattaaaaaaaaaaaaattgctgggtatggtggcatgcacctgtggttccagctactcgtgaggctgaagtgggagaattgcttgagtgcaggaggctaaggctgcagtaagccctgatcacaccactacactccagcctgggtgacagagaaagactcaaaaaaaaaaaaaaaaaaaagaggaaaggaaaaagaaaagtaaagaaaataatctagaaacaggtcaaggttggaatggtgacaccatgtttatcagggacctaggttcctattatctttctgatccaccatccgtaacacatggcttccattctcaattctgccatttaggttacaagatggctactgatgctccagccagcaccagcaccaaatcactactacacaaacgggaggaggagtaaaagtgagtgcttctaggcaggagctccctctgctaacatgtagttggctgcatcaatctcttagaaagcctgagaaatgcaatcttttgactaggcagatgtcacccaatataattaagattcagtcagtcatctttattatattggttactaaatgaacaaatctgtaaggatattcagtcagcaccagcagtctttgtcacaccatagaatttctcaatcctggatggaatttggtctaatcccttacttacagaaagggaaatggagagcagaaagattaagaaatttcccccaaaggacacaactggttagccaaagaactaggtgcagaattcagatccttgatctatcagtaaagatccggttctttactggagcaaacttcagtgaggtcagcccaggaaattcagctaaccaacatgaacaaataacacatcttactacctgggtcagaccctgtgactcacacttcaggctttacagtcataactgctcatatgctgtaacatccaccctctttggttataaagtgagaatcaccatattcaccacaagtcatgtacatgtttacatggccactaaataaccaacaaaatgagagatgcgccgcaaaatgtgacagtacgagttactgtttgtaaaagagcagaatgttccacactcatgggtaaaaattggtacttgaacttcatgagtgactctagatcttttatggtggtggctttttaaatacagacaaacacatgattatggtatctcctgaaactgacattctcaaaataacatccactattatacaaaggaagtttgaatgttttgaggcttttttgcttttaagccattgctcttacctcttatctcttcttcgattatggccatcacttacttcctcagactccacccagctgcattctcaacaaaccacagtccaggatgagaacttctataatgcatatgcttccttcagcactttgagatacattattaggccctgctctcatgttttacttcttttatgttccaagcttcttgagggcagggccaatactttctttattttccataacacccctcatatgaaaaagattctagcattctttcacaatgtcatgcttagaacattccaatatttttccaacctatctcccaaactgcttcccatggttccactgattctcttctttcacccctactcacaacacagggtacccgagtgattgctccaaaatacagaacacagcaagccacatttctacatctttggcggtgcgccactgtctataaactttttaataaggtcgccctaacttgctttctcacatagtcttattccttgccatttcctctgtttgcgccctacatactgtaagttactccgaaacattcatctttttctacatgcctgtgactttgtacatgtagttccctttgtctgaaatgccctttcttctttcgtttatggagattccaaatggtctccaaggtatatgtcaattattatccatgaaaggttttgctatatatatccagtattttctgggggatggggaagcttaaacaaaaaaaacttgaacattactctacacacagtccattatgacatcttagtctatttggaaaactccactcgtgtagaaattgtgtttatttcagttgactgtgaatacaggttctgatgcacaggagctactcaatagtttgctgaatgaatgaatgtcagttttcctaaacagacttgaatgattttcttgagagtctaactgcttgtcatactacatcttgtctcatttgattctagatccacagaagctagcacagtacttagatgtaaaaattgttatatctcttttgtttttccagttaatcactggagaccagggctgccctttcaataggaaatctaatatctctctttttgaaaactacccctctttcaaataacccaagaacctcagggattattcagtctaaagcagagtcgtgcttctaaacttcaggtgtagagaggacggcaattggtatgaaggcttctgccactgccatgtggtatcacagtgaacaatggtcctgtccagacctgtgtccttgctggtttgggtctccatgcccagccttggactccaagagtttggctctttgatttaactcatttagtaaagatcagccctcactcaacaatctaagatgctcttcttgagcaggcagcttaggtttccccttcctctacacagatacattaatccctctagggcccgccgtatcagcattctctcccgacaatacaccatgggactgccctttttcatccattctcatgggtttcctcagtacttctaattgtgggacaaagtgagaaagtctcttttctcctggtagactcctgaattcttaggtagtttggtccacgctatcctcaaactgtaccaagaggaggggtagcttttaataagaagggggaaattttgtcacactctttctccaaagaaaaagatgacaggccttatgtttatatagctaagggaatccacttaatgatttttccaaaaataataaatacaaaaacccctagcaggttttccaatagtagagttagaagtggacagtcagatagaatttctgcctctccagtcaccctcttacataggcatggtaatatttattgaaattcactataaaggcaaaactggatgaggacaattgagaaactcttgtcctaaatatcttttcctgactggccaaggaaacagtgagtctaataatcaacttttttttttttttaagtgcatagccctaccagtccaataagacaaaaaagattcattccaaaggaaagatctggcatttcagggtcacatttaagtaggagaggatgcatacaataataagatatttcaattagacgacaaagtcagccataggacacagtaccagtagtgtcttttccactaagaattggggaagggaggcttaaaattcaccttatgtttgtttaacaaacataccagggaatccttccttcaactgtgcccatcgagttgagctacacacatacaacataatccaggggagactgccccaaactgaggctttatttactaatttgcagtacctctgaaactgttaattttttccctacttttttttttttttttttttttgagacagacttttgctcttgttgcccaggctggagtgcaatggtatgatctcggcttaccacaacctccgcctcttgggttcaagcgattctcctgcctcagcctcccaagtagctgggattacaggcatgtgccactactcctggctaattttttatttttagtagagatggggtttctccatgttggtcaggctggtctcaaactcccgacctcaggtgatctgcacgcctcggcctcccaaagtgctggggttacaggcatgagccatcgcgcctggcccctacatttttaatgcctctaaaatccagacatgtttttataatcaatggcaccttggacttgatgaaataaagtaatcaaatagttttaataaatcaaatacctttaaaaatataaacaatttaaaaattgttctaagacccaggttccaacctcaggatctggatatgaccataatgctatattagcatattaaagcagagacacagacaatagcggtaacccttcaaaggggaaaaagcctgtcagctgaagatgatagaggaacccagtgcttctcaaagggggttccccatccagcagttcatcagcatcagcatcacttgggaacttataagaaggaaaattctcaggacccaccccagaagtactgaatcagaatttgtggggcatagggctctgtaatctgtgttttaacaagggcatgggtttgagaaccactcatatggtagctaaataaagaagacacttggtcagtatatacttggcatgcctggggagggggagcataacacttaacagccgaatgttaagactaccataaaaggaggaagaatctcaaaacccaatgcaggaaagccctttaaagtctacagttcctagtttctgactccatatatgtcaaagcagcttctaattagaagtttgtttctcaaggggctgaactacaaggacagaatgaactgatctggccaatatggtatcctgtctacttgtcaatatatttctcactgtgaattccctaattcatgttcttgctcttgcataaagttcatgagttctgagtgtcagtgacagcacctgatctaattgggttctgagaaaatcaattctgaacctgaaaaactaaaggtcagtctttgaaatttgtatatattacaaagacccagtccaaaagggcccagaacatacctaatactcatttaaatggagtatttaccaggtcaagagaagtgaagaattaagggcaattaggtcaagattgcaaactggcaatcctcaggccagatctggtccacagatgtgacttgtttggcccacacacgttgttcaaaaatgggaagtttcgcattaaatattggatttcttccagtcttaaaaaagcaaaaaaaaaaaagatttgacaatagggagcccacatcctggcacttgagcactagcctggagctaggcagaagctgtctcctttaaacaggttgtagcttccaggtcaccccagtcccaggaatctttattgacttctggctggcaagcttctccctttatgtgaatatgatctgcctgacccctggtttgagacgagtttgaagacctttgagctacataatcatttttcatggaacagatcattagactgatttgaataaaatgaattgctcagaaaattagctttattttgtacctttagagctatttgtatgtgtgagcagggatgtagaggttagttacttttgaaaacagacagtgatgaaggcaaatgttgccaggcagagtataaagagaaccagcctgggctgtctagacttggatctgccacttactaaatgtaaaactatcccacagccgtggtttgcatatccactaatgggaatgataatatctactatacacagggtttatagtgataatcgaattagataatatatgttcgagactatatagaacctcaaaaatgttagctgaattaaattttgatggttttgttttctgaattttactttagaaattgttcctaacagattacaaacttttgaaaaaacaatcaaaattaaacctcaatagtcttacattgtgatcaaataatggaattaacatttattgactgtaaactatgaaccagatagtatgctgggtgctttaaatacattgtctcatggaacccataaagaattactgagttagtattatctatcttttacacattaaaatccaaggctagaaaagtttaggtaatttaccaaagtcacacagtaagcgttggataaccaaggtccatcttactccaaagcccttacatgtgtgattactgtagtgtttctcaaactaacatgattatacgaatcgcaggctagtagttaaaagcgtaagctctcctatttatttccaagcttactgaaccagaatctaaagggatacatagccttgaaatgtgccacattttaccacagccccatgtaattcacaacagcggcaaggaaactgcttaagaaagctgataagaatcaaagtaagtagaaaaagaattactttgcgttttattcaatagaagaaaggaaagaaagggggaactaggaagaaaaggagggaaggggagggaggaaagaaggaacaaaggaaagagggaaggagagaggaaaagaaagaaaggagggagggaaggagacaggcagaaaatgtcctggagctaaggcctatggcatttgaaggatgatgtgaatgcacttactagatggatgctttctttctaactgcacccagcctgtttactgcaaacataaggaatcagccaacaggaagctcagcttgccactgcagaggagtaaagcactttgaactacaggcattttgtacacccaaattacatactgtgatacacatagtatttgagctgttccgcaagacagaagccaattattcttggcacgtacttctgtcgtgctatccaaatcaccatccctcacatgtggaactgtgccacatcaaacgcaccaagtcacaaattccttaaactctttgagatgaaagtcaaattttggagaaaaaggatagtctggtatatacaccatatagccaaaaagatgtgtgcttaacttagaactgctgggtctattatgagaaaccggggcagcaaaattctgccttaggaacttttcagagttttgtaaactgaatttttccaatgtaattcagtattatcattgccttttctaatcttagttatttcatttatagtattcatcttaaaataattttccagcctctccctttaaatgtttttaagcacagtggaaaaacatagacactaaaacaaggagtagaggttgtaggtaccatcaaattctattgagaatcacagaaactatgcataagtcctgaatggtagcattatttgataatcagatcagttagttaacccactccccttaccccttacaaatcctgaggttaaaggatttaatcaaaactgtcagatgatatgaaaatagaaatcaaatgataattgttaatagtattataaagaatttaaaacataaatcctgcaagattaaaaagcagaaagtggggtattagatgcaccagctttgtgcttcttaagctttaaatatgctgtggaaactcctagaaatcttgttaaattgcagattctgatttagttccaagattctgatttctaacaagcaccgatgtgactggcccaggggtcagactcagtagcgagtgggtcaatttaagaaggcttgcattggtgaagttctagagatgtgatagagaatctccccataggagggagtgtgacctaacactagtaatacctagaaataaaatgtaaagatgaaagacagatggaagtgttcgtgtaagtgtccagttgctccagaagaaattggttacctatgaaatagaaatataatcttagttttaatgtgagaagaattctaagaaagtaaacagatttacaactaatatataattgggtttctcaaacttaagactctgatgaggatactggatcatccacccagaaaaatacagataatgtacatgcacatactgcacacacaattctttacacagtttcaggaagttcactgagcttcctttggaaaggtgtgaactacctaagggctcatatcacaatttaagactaccaatgcacatgtgtagctggtatagaggaacaacttgtagttttaagactaattgatagagagggcagattagaatctgcttatgtgtttgactgatgatgttattgcacaaaggcttatgatttctcagtcacttctgtaaaatataaactggttgaaatgtatatttttccaaggtaagacattaagtatcttcatattaggtaggaaaaaaaccaccatgttaggccgggcgtggtgactcatgcttgtaatcccagcactttgggaggccgaggcagttggatcatgaggtcaggagttcaagaccagcctgaccaacatggtgaaaccctgcctctgctaaaaatgcaaaatcagccgggcgtggtggcgcatgactgtaatcccagctactcaggaggctgaggaaggagaatcgcttgaacccgggaggcggagtttgcggtgagctgagatcgcgccattgcactccagcctggggtacaagaatgaaactccatctcaaaaacaacaacaaccaaaaaacaccacaccattttacaaagttaaatatatactactttggaaaaaacacaagacaaaaatccaggtttgaaaatgactgcacagtacaggggtttctgaagatgtaaagggcaattgttgttttatgctggtagcatacatcagctttttttctccaatagttttgaatatcccaccacctgcctttttaaactagtgagaaattataattatttagagctgtcatttaaaagtcatagaaaaccagttaatgttttttgaaaaaaacagttattgatcacccaatcttagataagcaacttaaaatctaaaagcaagctacatctgtgtgtgtgtgtgcttgtgtgtgtgtgtaaagttatatgtcaagacataatatgaaatatagacataatgctatgagagtgctgagggcatttttctttttcttttttcttttttttgtttgagctggagtcttgctctgtcatccaggctggagtgcagtggcacgatcttggctcgcaacatccgcctcccaggtgcaagtgattctcctgcctcagcctgccaagtaactaagattacaggcattcaccaccatgtctggctaatttttgcatttttagtagagacggggtttcatcatgttggccaggctggtctcgaactcccaaccttcagtgatctgcctgtctcagcctcccaaagtgctgggattacaggcatgagccactgcacctggcaggagtgattatttccaggatgagataatagagatgtatgaaggaaatcactgagttagctctgagctggattcaggatgagtaggatttcagtagaaggagaagtagaggggaggcatttcatataaaggaactcccaaaagcaaaacattatagagggtaagagtggagggaggaatatgctgtttggtctaagaagagaatgatatttcatcatacttgtaatattactacttgtgtaggctcttcttgactcggtttgctttaaccaacagaacacaaaaaattggccacatgccagttctgggcttaaacattaagaaagcctggcttttgtgttcttggcagccctgagttgccagggaagaaattctgactaccttgctggagagttcacatgaggaatccacatggagagagagaaaagccatgagactacatgaagaaagaaagaaagcaggtcatctcagctaagcccagcctccagtctactggagtgactgcagccatattggggaccatgggtaagaccagcaggactgcccggctgagcccagcacagactgcaaaatagaatggttgtgtttcaagacatcactttctggaatagtttgtttgcagcaatagaaaactgaaactgagtgtttatcaacattttaaatcactactgccttttgataaatacaaaatgcgtaaacccaactggagattcagatgtagcactgtccttctacactcactagtcaagacttattttgaattttattattttgtatcctaatcctaaattttgtttaggatacaaaactctaggtttcttctttttacaaataaaaactattataaaagtaaataaccatcaaaaaccattccctgaatcacctcttctattgctcctccttaacagtagcactttagatggattagtgtacatgtgtatgtgcacacatgtgtgtatgtgtgtgcatgtgtgcatggtaatatttggtcatagggaagattaagaaaaggattagggctaaaaggctgaacatagggtgatatcttcggttttagagggaacctaggacagtgtttctcaaaattcttaccttaaaaaatattggccaggtgcggtggctcacgcccgtagtcccagcattttgagaggccaaggcgggccgatcacttgaggtcaggagttctagaccagcctggccaacatggcaaaaccccatctctactaaaaatacaacaacgacaaaaaattagccaggcatggtggcaggtgcctgtaatctcagctactcgggagtctgaggcaggagaatcacttgaaccagggaggcagaggttgcagtagtgagtggagatcgcaccactgcactccagcctgggtgacagagtgagattccttctcaaaaaaaaaaaagaaagaaattaaaaaaaacaaattcataggaactcaatgtgtgtgtgtgtgtgtgtgtgtgtgtgtgtgtgtgtgtgtgtgtgtggtgtaggcctgcctatccatactgaaacagatttataaaagttattccctatgcgtgatacattctcatctttttctactctattccagttctttttttcttactgatagttgtgacccactatatcagtttcataatgcacatagaagttgaggcactcagatgaaaaacactatctaaaggggcattaatcattaaaaaaaattcgttaaatcctgtatgtgccatacattgttctagtcccttggataaaccagtgataaaacaaacacagttccttctttcatggacaaaatagtcattaaacagcaaccacaacaaaacatgcacaaagtatgatttgattacattcataataaatgctgagaaagaaaagtatgggtgctataagaagctctgataaggagacttcactgaatctggagcatttaagtggatcttttcatggatgccaagttaaggaaagcccaaagtaatagaggtcaatctttagaacatttctgatctgccaagggctagcagaggacaattgcaggaggtcgctgaataagccaagtggggtggaagctgggctgacactccgcccaatcctaaagctggctttaggggctggtgcatgctgtagcctattgggcccagctcatattaatcctttccaacaatttttggcttgtgggatctagagaggagaggtcaaggagcaagagtgaagtatcccccttagagtccagaagtaagagaagtaaaattatttaccatctttcaggggcaaattatgagatccatctagagttatgaaaaactgtgtccaagagactcccaggctggacgctgacagtaattacttgaaggtgttaacatatttggaaaaagaaagttcccattagaatgagggtggttggcaagtaaatcaaagacaaaggagacttgccttgtgctgcccatggagagagggagcgcctgtatgagcctcgagagtgtgcccatcctcctgtgatgatctccctactgctcacatgcatgtcctaggccctcaaaactatgaccactgagccttctgatcatatgtaaatctgtctattctaaatccatgttatgtactatttagcattctaaacctacccataagagggagaatgcgtatgttggcaaggccaaaacactttgtagcttttaaggaatcagctgatactctggctttaaggctcttgtgagcttttgagagtttgaatcagcttactcagaggctgtgacaagatcacctttctgagactgcttggttgaggacagattctggaatatagttaattctccagggaaaacactactctgtaaggacctgtctgggtaaccaactgtctttccctaggcgatacccctagtaactcctaacctccaactacacaccattttaaatttaaaatttctacaaggtagcagctccagcatgtacacagcacacagctaactgttgatgaacactgcctaggcattgtttcaagcactatgtagattatcttatttaatccttataccaagggaggtgctatcggtattcctattttaccattatgaaaactgaggttagttgagcaccgtggctcatgcctgtaatcccagcattttgggaggctgaagcaggtggatcacttgagcctaggagtttgagactagcctaagtgtcatggcgagacccgatctttacaaaagatacaaaaattagccaggcatggtggtgcatgcctgtagtcccagctacttgagaggcagaggtgggaagatcgcttgagtccaggaggcagaggctgcagtgagctgagatggtgccactacaccccagactgggcatcagagctagacccagtctcaaaaaagaaaagaaaagaaaactgaggttaggaagcacaaggtctcacagctagtaaatggcagggctgggattcagggcagcctgattccagactgcaacctttaaccaatttatgacattgctcctgtcaatgcctccacacccaggaggatttgaactatgtcaaaaagtccatttgttcctaaactgtggcttgcaaagctacttttctttaaagggagggagggaacaaatgacctctatccatatgctgtgataatctatacacttttcttggtgtctcatagaacttcaatgttttctcccttgggatattcaatgcttcatgcaaactagtgagaagtggctcgttctctaccccaaatcccaccttttcttcttctggcttttctgtggtctcactggggatagttcctgcagattttcaacttgtttcaatttgcctccttccaagctatgactatgcaagcatgatcctggaattgcagaatggtcaacaaaatgctggcttattctctggggaaattctacagttttctagggagatcatagaaagctatttaggatcccactttccaataggctcttgaggttatgattgttccctggatgctttctattgtgcaactgccctaatgtacaactggccatttatacaaattcagtttataactaagacattgttttgagaaaaaaaaagccatactttctttcttttaaaatactgataaagtgtgggatgtttgaatgtgttctccacctgcatttttctattctaaatcccaaggggaatgagacagagaccaaagccacagctttccaagaccacaaagcttgaggtctttgatgttccttatcttctgagtgaaactttcaattatttggcaaagaaaacaaggctcttaatgggaaaccaaagaagccaaatcatctgtgtaacagaactgagtacatcgataattcatttattcaagaatgtactgagcaacctagcatggctgaggcactgttgtgtatatatatctgtatcagtgaacaaaataggcgaagattgttccacatggtagtttccagtctagtacaggagagagataataaacaatagatatagtaaattatgtgttagaaggatagacatgctatgaaacaagcactcatacatacaatagagcagacattgggaatggtattaatgtgcgatgcatttaaaaaatgggatggtcatggatggcctaatggagatgaaacacaagcaaagacttaaagcaatggaattggccctaagataccgggggaaagagcacttcatgcagcaccaaggtcttaaaatggaagtgtgactgatgtgcttgaagatcagcaaggaggctaatgggctggagctgagtgaatgagagaaagaagagttaaaaagaagaccagagatgaaacaggggtcaaattgggctacacgttgtgggccacaataatcacttttaactctgagggaaatgggagccattgcaaggttatgagcagaggaatgacatgatttgcactgactgctgtcttttgaatagactgttatgcagcaagaggagatgcagggtctcctattagacagccactgcaatcatccaagccagagaagatggtggcttgcaataggatggtaaccatggagatggtgacaaggatgctgggctctgggtatattttgagagcagaggcttcaggagttctaatgtattagatacgagatgttctaaaaagagtagacacagggatattctcaagctttggcctgagcaactgagatgaagaatttatggttagagcacattgtgtgggaggcagttggggaaatctataattcaaccctccctcccttccttcctctcttctttctacccttcccttccttttttctttttctcttcctttttctttcttttttttttttttgagacagagtttcgctcttgttgcccaggctggagtgcagtggcgcgatctcagctcaccacaacctctgcctcccagatttaagcgattctcctgcctcagcctcctgagtagctgggattacaggcatgcaccaccacgcatggctaatttttgtatttttagtagcgatggggtttctccatgttggtcaggctggtctcaaactcccaacctcaggtgatccaaccgccttggcctcccaaagtgtctacccttcccttcttccctccttgttctcttccttccaccttccctcacttccttctttccttccttgcatgcacacctgcaaatgccagacattatacccagtgatacaacagatacaaggcatcttcactagcaagccaaatatgaatgataaaataggggtacagaagtagaattgatggtaggggacctactatattctattattcctttcttaaaaatttagattctgatatgagatttgaataattcacatttctgaaccataactctgaaaatacatcaacatttgcacattgattcttcttcaaaaatcatgttaaacctaaacttaggattccattattaaattgatggtatgttttttgcctactctgttatcaaaaacacatcaacaaatcaaaataatcaccgacatgaatgaaacattcattactacatcttagaaattgtgtcttttttgtttctctagacactatctatcaaaatttctgaaaacttagctaactaactgcactatttattggttttattctaagaaacataaagcgaagtggtacactctggtagaaaggatgccctagggtacaacaaaaggcagataagcattgtgttaggtgaccaatcttggaaacagactgccaaaggtggactcctggctctgtttcttactacttgtgtgaccctggcctagtatttcactcctccgggcctcagtttccacaactatgaaataagaacaataatgtatccaatctcacagatttgtggtgaggattatgcaaagtccttaaagagtgtggcacatagtaagctgtccataaatggcattacatattgagatattgagtgtaactaggccactgttactgctactaccatacactagaaaattctctcctccctttccaagagctaatttttatcactgatattatatacccttttgggggtcattttcaatagtcatttcttaagaaaaaagcaacaagagaaataaagttgcaaagatgatgtaaatgtttaacattattagttaaataactgctagaacatgagcaactacaaaaataattttgaagtatactttgatgcagaaaaattttttttttgttaaatgggaaaaatgtgttatagcagtaagtcaccaaatatgatccctttaaatatatacaagtatacaaacatttggaaggatttaaagtatatattaatggtggcaatccttacatggataaatttatagagttttgatgcttttatgacgtatttttattttattttctgaacatgatagctgggtagtgtcaccaactgagatatataaggaggcacaaatttagaggaaaagctaaatttggttttggatatgaagaattttataaacccatgggatactcagttgggaatttccaataaatattggggttccaagctttgcagaagaggttaagatggatttctatataaatttaggggctttcagcaaacaggtggtaattaaaataagaatgcacaagtcagtcttggaagacacacagagtgaggaaagcaggaatggagaatgggatcctgggaaccccaggtcaaaggaagggtggggggaaaggaaaagaaagagtgtacgacctcatgcaaagatggaaaggtttttgagagggatacactggcaattgacttagagaaacttgatgagaaatgaactgaaaaatatctacttggtttggcaattgggagagcagaggaactacagcagtagttgcaacagagtggtggggctgcaagctaacttcaagggggtagaggaataagtggggggaaaagaaaaagaaaatgataagtgtaaactttctagaagtttgggtgcgaaaatcaatagagatatgtggtaataactgatggaagatacaggatcaaagaggaagggaattttttccttaggaacttcaaccagttttgaaggagatgcagccatcaaagagtaggtcaaagaaagagggagaaggggcgatagatggagcaatgtccaggaggagacattgaaggggatggggattaaatttgggggtagtcttacttttaagtgcactaaacagaaatcttaccataatatagaagagcaatacagattgagcaaaatataattttgtattttttgatgatttggggtcatcagtttgaacaccaaaaattatactcagttgtccagacaggatgcgctcagtgtttccaaagatgggttgagcttattgcccctttcaaaaaggccccaaatagctatgtctgtggttttcaaatgattttgtagattttctttttctgttgttgttttcaggccatcagctgacatttggctaatatcagttgtgactttccctgaaatctcctacccagcctttcttaatttgcttcatccaattatagaaggtttagaaccacatgaccaagcttgtatgaatcatcactaaaatatgaacatacatttctctggctaatgacctacattatcttcagtgagtgaacattgtgaacatctattttgagtgcttagagacctcctttgcttccttccttatgctgatctatgttctagaagaaaggggacactattagggttgcaggctaagttcttaatagttaggatgtatattgttattaataattgaggtataatagatatcatgcttatcaacacataatgtacatatagagaaaaggttaatggaccactctgagcttacttatcaaagtctactgctcttccacaaaacctacatggtttgttgaacaatttcttcagtcttctgcaagccataatctatgattacataaataattaataatagttttaaaataactttgcaatgattttggttgtttagatccccaacaatgtaaatctcacaatcttctggcagatttataattattaatggaaaacacatttcttatctcagtcgatgaattagcgtttgctgtagtcctaataaatatatatagtaaatataatatacagccaaaaaatgtgtaaacgtacaggaaataaaatgggaatctttgtccaaattcattagcaacctgttttcagcatatatagtactgaaccacattataatgttttttgagcacatatattcaagaaattaaaattgtataaagcatacaattccccattatataatcagagtaaacaagaaggaatgatttccaggaagctcatcccttggattgttttctatgtatatgctacatgtaatttatattgtatgacgatgatacaaacgaattttttttgccttctgaccctgatttcccaaactttcacagctcagacctgcagagacaggttttaaaaacaacatttggcaagaacatgtgcaaacgtgatcaatgagcatcgaggtacacgtatattttactacctttcctttcttactcagagtgcttttaaaaatcagcataactgcaataaaaagaacccacaactgccctattattgaattacaaagcaatgtgtgtcggaaacacccctcagcattttaagagggtcaaaaggaagatgctctgcacgtactccacggctgcaggaattctggtgaaaggagataccaacccagagctgtttaaatgatgacgctgcagccaggcaagaagtagagaaagtgactggaaagctggattgcaggcagaacaaggaatggtgggggtggtgacaaagtggactgcgaaaggacagaaatgacagcaggaatgagaaggatttcagatgtgctactatgatagacgtcccattccaagtctccatgtttcaagcaagtttttaaaaagtttcaagaaagatgactttctgcaagatgagaggttgctttaggcacctaatttcaaataactaacaacagctggtaattattcaatacaatcattagcaacaataacagcaagactaaataccaataaaaatactttatagtacacagtggctccatgtgccagttccttcatcttaatttctctacgtttagccactaatttctttggcttcacagtggctttacccaacatcccaggatacaatttctcaccacagaagttacaaatttccaagattactgctgaattgaattactctcacttacatgaggcaggtctcttattctattctggggtctcactgctatcaataattcaactttttataaaaacaaaatcttccttaaaaattgcttttgtcaaaacattgctatgaccatctgtttttaaaaaccattaatggctgtctactaactttaatgtaacaaaatgtattagtttgacagaccaaggctttcatggcctaaattttacctggaccctccactacagacggccacacttgtcacacacatacatgatccaatatttgtgcatcacggtgggagtgtttgttcctttttatttacatttcttatctataagtcccaactcaagccttacttccccctggagcatttcctggctaagctggctctcaactctctcttcttctttgtagtacttatatgactttttggttctattatttgacattgagaactgcagaatcgctgttgcaggaatatgctggaactggatcttgttaagtgttaaagattcaagaattctgcaaaagaactgttgaaccagtggtagcttggaaccagccatgggaggagtatttgcaccatggccatagacaaacactgcagatcaggtttttaactttttttttttttttgtgaggggtggtgggatggtgagaaaaggaggaaggagaactggcttgctagcataccacacaatagattgtcaaattcttcttactacatttaaaatattttgtcaactctctactatagctttccagtataaattcaaatgcttccgggactaagtaattcatgacctctcaaggagttaaattccaacatggacatgtatctatgtacacacattaaagtgtaggctccataatagctagctattttgtattcttcatggtgcccggcacagtgtgtggtaaaaagagatccttctacctttctagcctcagtttccagggcttacattgccctttaacttctggccttattgaaccttggaattgtttcttgaacgtatcaggtatgtcttaccttggtaactttccaaaggccacttacttgccatggctggcccaggctgactgaatccctcctgccactgagtgaccctgtggctttaacaggcctttcaacacgttgtattttaattgtctatcaattcaaccacctctctgctatacaataagctgcttaagtgttattttttccacctgcgtatctcatggctgaggtccccagcatatagaaggtactccaataaatatttattcatagtgaatagagcaattcaaacaaattaatttatataaggtaggtctgctctagcacttttccacaatattgattactcaaaaaaaataggcctcatggactttatgacactgttgcaactacacagcaaccatcgaacataaatttcaaagaggagagagtttatttacaattctatgagcactttaagttttgctttcttcccaggcactgagggagtatccctgaggttgttctcctctctttgtgtttagatgtctgtacttgctggtatgcctctgtcctctttctgccctgcttccacaccaatggcagacgcaccacaattcaagtgaaacctggtttatccccaagaagtcttcacagttgttctgttggtctctgcttaataccacacaaataaaacttaggccagaggacttgggagagtgaatgaatgaaacaaggaagaatggaggaaaaaatataaaagtaaagtaaggcatgagagaattgtataaagtggggtggggaggatacaatttaaactgtttttaagaaaagatataaaagtaaagtgaggcatgagagaattgtataaactggcgtggagaagatgaaattaaaaaaagcttctgagaaccaaatgaggttgtaatactccaaaattcttaattcaaatgttcttcctgcctcctttaaggttcaaaagatagctggcgtgaccatattcacgaaagtgaatttctctttaaattgccaaaatcttattatcattattattactattatttttggtttacagatccaggaatctttctaatgatggagaagcaaaataagaataaaatgcattttataaaaatcctaattttaaataccaagagagaagaggaaatttatgctctctatatattgtataggggctaccagcatatggcctctgtccacagaagtacatttatctgggaaattgaaataattatttagtgagctcaggcaaaagtaagttctaacaccagagcagaggacatagcctaatttcatgaaagctgatttattattgtttataaaacaccaaattgtcattacattttctaccctacgtataacttgtgtttttccagtggtgctaatatgacaaaggaaataatggaagactatcataaagaaagcttaaaatatggtgacttttacatcagtaacactatttttcaatcattgagtcctgctgtgcatcttgacattagctcttcaatcatactccaaatggagtaaaaattatcagtagaggaaacattctatgatccatttcaattccactacctttcccactgttcatattcagagaaatggatatgaagtgctagagacaagagcagaacaaattaaaattctgctttttctgtgtgtcattgctttttgagatggggtcttgttctgctgcataggccagtgtgcagtggtgggatcatggctcattgtaacctcaaactcctgggctcaagggatcctccaggctcagcctcccaagtagttgggactgcagacatgcactactctgcttggctaatttttttattcttagtagagtctgttccccaggctggtctcaaactcctggccttaagtgatcctcctacatcggcctcccgaagcaccaggattacaggtgtgagccaccaagctcaatcaaaagtcctacctataaactaaagttccacagagactgatggttaaaaatgcaaattgaaatcaaatcagcaacactctaaaatctgaaaagattcattatttctccaccagaacactttttataaacaagctgaaggttactttaattttgttcaaggttgtgtcctacctttctttgatctatcccacagcatatagtcaagtggtagccccatgacgtgcacttcactaagaggaggtcagagttatccattcattcattgattaaatacatatgaatcaagtctatgtgtcaggcactttgagtatcaacaattccaaaatcaacaagacacaatgtaagctctcaagaacatcacagtttatggtagccaagaccatttttaaaaaaattgataaacatctactctgatgtacttagtgcccaattctttctccctttctctttaaaaaaaaaaattattgtactgctcaaagcaatctacagattcaatgcaatccctatcaaaaccaatgtcatttttcacagaaataaaaaaaaacttaaaatttctatggaaccaaaaaaaaagcacaactaaccaaagcaatcctgagcaaaaagaacaaagctgaatatatcacactacctgacttcaagatatgttacaacgctatagtaacaaaagcaacatggtataaaaacagacacatagaccaatggaataatacagagagcctggaaacaaatccacatttttacagagtggactgatagatttagagtagacagagagcataatgatagatacatttgattttctataaaggcaccaagaatatacattagggaaaggagatctcttcaataaatgatgctggaaaaactggacacccataagcagaagaatgaaagtagacccctatctctcaccatacaaaaatcaactcaagatggattaaagacttaaacataaaactgctagaagaaaacacagaagaaacacttcaggacattggtctaggcaaagattttatggctaaaacctcaaaagcacaggccacacgaccaaaaatagataaatggggctgtattgaactaaaaatttctgtatagcacagcaaagcaaacaatcaagagagtgaagagacaatctattaaatgggagaaaatatttgcaaactactcatctgacaagggaataatattcagaatatattaggaactcaaacgtctcaatagtaaaaaagcacacaatcccattaaaagtggacaaaggacataaataggcatttctcaaaagaagacatacaaatgtccaatatgaaaaaatgctcaacatcactaataatcaaggaaatgcaaattgataccacaatgagatatcatcttaccccagttagagggctattattaaaaatgcaaaaaataataaaaaataaaaaaaaaataacagatgctggctaggatgcagagaaaagggaactcttacatatcaccagtgggaatgtaaattagtacagccactatgaaaaccagcatggagatttctcaaaaaactaaaaatagaactaaccactatgtccggcaatctcactactgggtatttatccaaaggaaaagaaattggtgtatcaaagagatacctacatccccaagtttattgcagcactatacagaatagcaaagatggagaatcaacctaagggtccctcaacagatgaatggataaagaaaatgtggtatacggccaggcacagtggcttatgcctgcaatcccagcacttttggaggccgagacgggcggatcacgtggtcaggagatccagaccagcctggccaatatggtgaaaccccatctcttcttaaaatacaaaaattagccgggcatggtggcactcgcctgtagtcccagctacttgggaggctgaggcagaagaattgcttgaacccgggaggcggaggttgcagtgagctgagatggcaccattgcactccagcctggatgacagagcaagactctatctcaaaaaaaaaaaaaaaaaaaaaaaaagcaagaaagaaaggaagaaagaaagaaaacatggtatacacaatggaatatgattcagccataaaaaagaataaaatcgtcatttacagcaacatggatggaactggagatctttatgttaagtgaaataaactgggcacagaaagataaatatcacatgttctcacatatgcaggggctaaaaaacttgaactcatgaaggtagaccgatagataccagagcctgggaggagtgtgtaggtgggaggggaggggatgaagagattgattaatgggtgcaaacacacagatagaataagctctaatgttccatagcagattaggtgactagagttaacaacaggtattgcatatttcaaaatagctagaaagaggacacacaggcatgataaatacttgaggtgatggataccgtaaataccccgattccatcattatacatattgtgtatgtaacaaaacatcacatgaaccccataaatatatacagtaattatgcaccaacaaagataatttactgaagtgaaattcatatcacataaacttaaaaatagtaaagtcaagaattcagtggcatttagcacatttacaatgttgtgcaaccaccacctctatctagttccaaacattttcaacattccaaagtaaaaccccttacctattaagaagttcttttctcaagaccacttttaacttcaatgtatgggaagccttcatttcgaaacaggttttgaaaaaaattctatgcccacaatcacttaacttaaatattagaattgagactaatggagtcaaagagtcctgtaacatcagacacagcctcttagggtttttaaaatggcattctgcattctctgttttttttgtttttttttttctttggttttggttttttcagtctgtcaattttccagattcctatctcccaaagccggtagatgtctcctttgatccagtagctaaggcatggttgaactgatcatatttataccgaatttccaaagatcaatcaacgagaattctcgggtctatgtgcttgtttatttagccctgcctctatgcctgaacttcatctggaagtcacacatagtcttctttctgtcttcagccatgagcaatagtgtatttgcactaaaaacgtttccatggcatcttcttctttatttaattttctatcagcagacccttctttgatacttcctttttctgcccattctggtaattcagttgactaaaacacaaaactcttcccaggtaatctttgtttccctttcataatctgccgtttatacatctacttaattcataattttgctaaacatctccaattatttgttcctacattgttatcttgccatcaaaatattgattttaatacctgtgacccctccagtccatttaaaatattaattaccaagtttcctgccttggatattggagttcttaatactaacatcaaaccaaatgttttatcctcatttctaaagctctactccattgcagacaccgtgacatctaacacttagcagatagaaaaaaagtatgccattgtaaatctgaaaacttctgggcttgcatgtcagagactggaagtggtttgtttgaaaggagcttatactgaggcagcatagcataacacagtggttaaaagcaagtctgtgaaagtgagaaagactggggtccaaatcttggctctaacacttctaagctacgtgactctgggcaagttgcttaaattccctgagcaccagctttctcatctgtatgatgtaaaaaaaagagcagcactgtttagtaaacatggtcttggctttataccacttcctaatatttctacaactgtcaagtcaatcaacatgttaccttagaaactgtggaaaaggtataacctttggaaaatgtaatcaggggggaacaacttttcctagcccaagtccagcttctggttctgccctgacaggtatctgtaagttataatgttttactaggtcttcatttccttacttataaactgagggaggttgagtgaggagttctatttgtttgcattttggctctgcaattcaggggttttatttgacacgtgaggaccaaggagtagaaaggagcaatcaagtgcagtggtttggtcaagatcacataaaaagtcttgctgtaaaaccaggagctagtcctaaactgctcaccagcaagcttgatttatactcgagtagaccatattctcttgctcctccagctgcagctccactcctcatttatcttagcccaggctgactctaagctgctttcacttctacctcactgcatttcgccctgataattttgtagcttacctagcctccctctttgagatcccttcttaaaagggtcattctattaacctacccatatcagttactttactactgctgatctatcgctacctgtcaattcatgggaattacagggtgcactgggacaagagtaaaatgatccaacaaacataatgttgcatttaaaaaaataagctaaaagatactgatgactttttataactacaacatattcgtttgtgaataagaacatatatagtaaaaagatgaaaatgtgaacaggttgactatttcctaaatttatggcagaggttgttctggagaggatggaagaaaaatgaggctggcagtgatggtggggaaatgcaacctccaaaattatctatctatatatttttattaaaaacacccacagtaattatggcaaatgttaatgtttgtttgttctaggttttggatacatttaagatctcttgctttctgggtacatttcttttcttttcttttctttttttttcaaattaattccaaaagacttatatctgctacatgaagaacgaagcaagttcagctctcttgctgaaatgttcaaatgctgaggcaaggcctgtactacaaatttgtgtaaccaaaaccacagtgctctcaatgctcctagtgttgcattacagcagttagaagagattgagctattttgtttccatggctcattaagctagagttagactggtgtccataatcaaatttactgcacttacccttgcttcttccctatgaagtacagccagaccttagggaaaatctcaactattccaggtccatggtaatttggtccacgaaagaaattaacacacctgaaaaggattaaattatttttccttttcaaaatgatcctcttccttaagcttcctctgtcaattgactgccaaccttatttgctaattcccatccctcatcgggcttcctagcacttcctgctgcaaattagtgtgcagtgaacctgagcctgctctccaaaacacatccagactcttggggctttctgggcttccgctagggtgcctggtgcaaagggggcctaaatcaatcaattaaggcctgggaagattccaggcaagaggaagggatatcttgggggacaaaaggaatgtgtaggtgggaagaagggagaaagtctttcttcgtttttcactgcaggaaatgatctggacagagagcaattcgaatcatagacagggagggttgggcaggatgcgatgggggagcgaatgacagacacaagtgacaggaacaacttagggagacaggtcagaaaacatctaatctaggcacatagcagaaatagtgaagggaattgaaacagttgttctgtattttgttcacagtgttaaagtcaaagtcagtgctttttaacctcatgggatggagcgggggagggggcacaaggagccttgtgtgaaggctctggctctgcttattgatcccccaaatacaataatacatcctcacaatcataaatttgagagcaaggggctctgatcctgtgatatacaatctaggcccttattggatcctggaactgattttcagaatcctttattcttttaagtacaattgtaaaaaaaaaaaaagagagagagagagagagagagaaagcaaggaagaaaggaaaaaaggaagggaagaaggaaggaaggaaaaaaggaagaaaggaaagaagggttccatttataaacctcagacaaaacaaaaatgaaagcaaaagagaacaaaaaatagccaatacgacccaagttacaaatttacttgtatcctttcagaggataacccaaattcctgcaagacaattagccatctttctttcgattattacagtaagcaagacgggttaagagtatatagtaaatgtgctttgctaaactccttctccctttattgactctatcacaagaagcacacttaatataatttttacaattttttaaagaacaaataggaaagaggagaaggttgtactttagctacctttgtgtatttgaaaggaatgctgttcagggcttcttccttttcaaaaagaaacaggtctttgaaaacgaagaatcattactgtgcatatctctcgagggctgctcctctagtatcagtccatttgaaataggagtttcacataattcaatttattaaacccacatttcctgccagattttgctttatgtgcctatgtccttttgtttcccggctaacatttccacatctcggaaatcattctttctagtataactgaagaatatggatattaaaatcagatcagcaaaagatttttatggacttggaaagctgcccattaatgccgtaaaataaagcgtgttatacagctgatatcatcagttctactctatgttgttttcatattcctggcggtgggtggagagttagagtggaacaattaggagtgggaaagagaatgaaaggattcgatcaattgtggaatttcaaagcggagacaatttacactaaagaattcaaagacttcgtaacctccaagacattttccagtccaggtaaccgttgaattatagctggaggtgatgttcttggagctgcctgtgaaagctgaaatcacaacatgcctgcagtgttcccttcctaaaccaactttgccattttctcaggcagacacacaaacatgcaagcgtccacagtaatgtgcgtgtgtgagggatgggggaagagtgattgttgctttgtagtagctcctttgaagtgtttaattcctcccttgtaatctcttcatcaacacacatttaaagcatatcagttttacctcagcaatttgattctcagaggcttatgtggctcagggcctctgtccagcacctgggtggcacagtttgttttatgtgcatgcagaagtgttaacagaattaatttttttccttctttctctctttcttcttcccccacctcccccaatttaggttaatgagcccaggcagcagtgtgtgtgagtgagcgggcgtgtgcacaggagggccgtgagcctgcctttttaaaatacaggaaacgcatagaagaaagaagagttcagctggagccacgacttccctctttgcttctttccctccccacccccccaccccccacctcaccccccacactccagcaccggcttttaattttcaaaagcactgcaattgcttggtgtggtttcaagagctggggtgccattctccctgatgatgactctgctgacgtcaatggcattcttatcatgcctagtgcgacatcagaaaccagtcctcagaggctcctcttattcacagtgcctgggctctcagcaaaatgtggaccggattctgaaacgcaaaggactccccgttcctaatcagcgctgcaatccaccagacagtctccttctgccggcagcttgccagttaagactttgttccttagcgttctgtcctgcaaggaccccctgaaggagaagagagggctaagtggatcacagcgtgtcctccgtgtctgagctttcagagccgtgtgtgtgtgtgtgtgtgtgtgtgtgtgtgtgtgtgtccctcaaccaaggttagagactagtcaatgctgcttctgattattcttcaggttttactaaaaggcttcagtctttgatataaggctattcccccgacacagtggctaagaccctcttgtgtaagtgctcctagctcactctctggatcagaaccagcgcccaggtccccacgtgaagcccatattcaccccagatggcagcatgcacctcctctcctttttttaataaagaaaaagaaataggaggttgggaggagaaggaaaataatcatagctgaataataatagcagaataggaaaatagtatcactaagaattaaatatttcactctaaatactcatgacttgttaagaggtctgctctcaaaagctgaattcacaagggagttaatacatactaaacccagtatgcattcctacctagcagtttgggggcaattattatggggatgatgaactttctccatttacagtggagtgtattatggtccaaatctaccctaaagcatttgggaaatgtctacagttcaaattaagatgtttagagtcaaggtcatttcgcttgatgatggaatgatacatgtctagttagatttcatctgaccaatctttgacacaaacacatcagaattgtcttggtatccaccaaccaaataatgtttgtttctcttgaagattgctgagtgacccatagtaagcttattaggagattaggagcaactgttccagagagaagctgtttaacaacatatgaaatgtgcaacataattccatctagaactatttagaatcataacatggaagaacagcagcttacacctggttcaacccttctacctttaagtgaggaaactgatgcccaaaggctgcgtcatgctttactcaaggtcatccacctattaagaggcaggactgacaaactaaagctgtctctctctaaatggtatgcttttcctactacaacacatagctcctgattattcaaaacctaatgaccaaacctcaaacccacttgccaagggagtttccatttttcttttaaatctgagcaatatttcttaattttttgattaaagtgatatttcaggaatgtttagatgaattataatgagtttctcctttgttttcagtgagtttcacaactagtgtaaaggttattaagtagaatggaacaaaataatatatgttggaatgcatgaaattcagatggttttgttctttgttattttttgtagagacagcatctccctatgttgcccaggctggtctcaaactcctgggctcaagtaatcctcctgccttgcctcccaaagtgctgagattacagatgtaagccactgagcccagcaaagacgtgtttttaaaaagtgatgatgggctctgggaagaaggagcaaagatttatctgggttccaaatgtatgagctccctgagcccagccatcattctgcttcatctactacatagctctcaccatggtttgtaacattgcttgctaatatattttatttgccacctaattcaagccattaagttaatattcgattatataaatatgatctttatagttactttttccctatccccaatagttttgccttctcttcagaggactgtaactgcttctataaatcaccttttgctactctctttttggtagacgtgcatcacattctggtcgcgaatggtgaggagatggggcagatgctggttttagagtcagacaaacctgtgttggaaacctggcttaaccacttgctactatataatttcaagacataacttctctgagcctcagtttccttatctataaaatatgaccctaccttgcagggttattgaaagggttagagatgatgtttactaaagtcctatcacaatgcctagcacataggagaaactcaatcaaggataattttattaatgatttttaaaaaataaatggggaaaatcataaaattaataaagattagtaagattgaacaaaggacatatagtatttccccccttataaccagagctgttcctcagtaccactaaaattggaaggacaatatttctttaaagaatttttctagtgaaaagctaagccaaatatatgatcattggcctgcattatgaatgcatgtttcactgagtatctgattataattggatgtcaaatagctacaaaacctaattgtggtctcaaaaattgtctcttctccctgagacaaacatccaatatttcctaggtgataactaagctttgtgtacactgagataagacgccaaatcaattccttaaacttaaaggcacaaaggtttcggaaagcctcattgtccatttgagagacaagccacggcatctcgtaaagcacattttcactgtatactatgttactacaaaattgagttaatttcattaataacaaaatttatcaaaataaaaatgctttctcctttgcaggaatccataaataacataaaataataatagcattttaactcagaagcaaattacagccatgactgtttaagttggctaacccaaatttcgtaagtgaaactggagtggtctgcgtaagtcctagattgcatatgattcagggaaacccagatgtcaaaagggtgtgtgaatcaaaagaaggtattcatcttggtgatttagccctgaaccaatcaattcttcccagagcactggagaaaaagttcttgtttctaatggaatcatcctgcccttacctacctagtaaaaattttgtacccaatcaataccttagtcaactttaaattcctgaatagcccttctgcctcattcaagtgaatggaaagaaaaggtttaatcatatttaaatactccagactattgagtaaagttaaatgcaaatttggtcatgttattcccttctttaaaaccatccattcattagtgatgatccattcacctaactatgccctcagcaggcagggctgttagcctgaggaaggggtgcccttttctatttcatccagctagaagatggccctttggaatctatctgctcaatgatattgtatttctagaatataaaaaagatgccttaaatatacaaaaggcacagggggagtcctttttaggtctcagtttaaggctgatttctgagttggttatatgctctcacagcaatttgtatgttgccttcatggtgcttaaggcagttcaatcatacattttgtttttctttcccctactagagtataaggtagaaattgtgactatatttttcactttcgtatccccaactccatcccagtgcctagtacacaagtaccaggtactttattgactgatacacaagtactagtgaattaaaaaattgttatataaagttgggttgttgtcttgtccaatagtagctgtgtttcgcactgcaagtcatttttgagagcatatgaaataactctatgtcctcatgaatgactttatcataatcattcctgaacagcacgggcgtgtggtattccaaaagggagttttactggcccttggttaaatttaaagaaataataaggccaatttaaaacacacacacacacacacacacacacacacacacacacacacacacacattaatgagagatttctaagccccccatgggagatgactgccctttttgtccttgttttgcatattaaaagtatatagaatgtggaaaataaatgtcataatatgaaatcatggttccagtatatgttagtgtgttctgttgaaaatagttttgtttggcaaaaatgaagagttggtaattgtatgttgggcctcacagttttttgttttgaaattccaaagtctgggaaccattgacttagcagggttttcccatcagaacacagatttgagggtttttaaggatacatgtcttagtttctagtcgcgtatggctccaacctacaatccttccttctttcgggtcccacctttattttttacttttctgatagttcccacaactttgcccacaaagttgccaattcctaaatattattatcaaagtgcaattttgtataccccaaagctaatatataattaattttactataagagaaatcagttaaaatgtaaaaagtttaataatatacattataataatggccctggtacactcccccaccgttctttggaataagcaaaggtataacccttgaaagtaaaattaacttttctttgcacatattagacttctcaatggtgtgccaaagagtggagatgacaggtgagccaagctattgatttcccttggctcttgtcgctagtgggtgggagactgaacacaagccacatcctttatttactgcagttttcgtagaaatatagttatcagcgtatgtcatgaaggaacaaatgtggggaagtactgacctaaataacttttacgtgattcagtatacatgtaaattgaaataaagaatattaaatctcaaaactatccagaggaccttattcaatggtataatatttcaaatttaattttttattacagtatattttcaggtacagttttaaaaatggggagcatgcaattaacgaatacataaaaataacactagtttaatcttccctttaagaaaagttcctgtttgctattcctgttacatatacaggcataggacttcatggcctttaagacatgttgataatattaacatttccacttgattgtgggaagtagcattcattttcagctttgcttagagcttattaacctgatgtcaacaagatatactagaaatgtccttgtcagtccaaacccacaagtagaaatgatcatgttgttgaatgtgttcagtctgatttgacaacggtaacaagtcaacactgttctgctaaaggaaggtcaatcatcccattgcaccagggatttctttatttcttttgctaacattagcattatgaccagtgtatgtcaaagaatacattgggataaaaaattctgcttgtccatttctgtttttccattctcttatgacttagagaattgaaaaattaatctcaatttttttctgtctgtaaatatacaatatatatatacacacactcttacacaaaatctctgaaaatgctgtcacatgcatgaaacacaaaatgaaaaaggtagagattttttcataaacatgaaacagaaaaaactttcctcctcactacaattcatagctaggattcatgattttctagtaagagtagcaaaatggatgccgattctatggcatagaagaccaatggctttagacctggattcaaattttaactctgccacttcctagcttggtgaagataagcaagttaagtcttagttttctcatttgtaaattggagtccatagagtcgtgaggatttcacaaggtaatttatttgaagcatttggcacaacacctggtacaaattaggaactcaagcaacagaagacacagcattaaaatacagtgcactacatcaggacattacaaaagcttaatttaataaatctcttgtctgattcattctaattctgctagtatactgtagaaaagtacactaggtcctgtttgtggcctccccaggtcagctctgcccaccctaccccttgggcataagccactctcccagtttcccaggcatgccacagcagccccagtaaagcagcggttatcactgcaattgcctcatgttttccacctccccatccttgcgggcttagcgtgggcaatggcctctgacttgacaggaaccatccagctacacgtgagatggacaaaggctctgtattccccagggactctgggagggccaagggtaccatggagcaaactttgaccaatgagagacaaaagacctatgcacagaaaaattgctcaccctttcttctccatgtggaatgttttacgacacagcctcacaggcaatgtcccttgtaacttagcaactagttttgttgttgttgttgttgttgttgttgttgggaagctctgacaagcttagtaatgcattaccttgtacatggtttctcttcttccctactgctgttcctttcaccccctcaactccacttttgctttcttgggattgcatgactcacctccctcataaagctagcatgtaagctgtccctagggaatttgatcaaaaactgtgagatttagaaaaaaagatgaggcaactagatacagtacaagaatgaaagagaaaaagtcataatatttgacatcaatttacttatctatgattccttggattctctcagtagtggaagctcttaagaccacattaccaccttattaacaaagaataactgataaaatcaacgggacaatgggcctttgagaacaaaccatcattaattttgttccacagagtccaatttcaattataacctaagatatgtttggaaccacttaatgctattttatgagagagagacagttttctctttgaaaagtcatgttcctttgaatttaactaaaacgtaacaggatgttaaaacgaaaccctggcatttttctttccttcagaaatatgcccacattttatagagaaagctatatattgaggttctgcaaacaacaaaatgcaattttcacattaaacatggattctaacatctggcatttctcctagtgcttgcacataattatccaaaattgcagtttttccaacaggggacccacagtggtagctctgattcattccacattatatatatgaccctttctcatagtgagggtggtcttcaacaccaatgctcctgactgctatcttccttcaacttacatggaatacttttcctcatggctccaaatgtatgagctctaggttgttattcagggttctttcatcctcattttttgtaccttttatgactactttctgaaaaggcacatttgctgagttggcgcctcacaggtggtttggtttgtggcatattttaatagctatgaaaccatgagttcagctattgggttgcaatgagttacataatgcatgtgcaattcagtgcgcaccaacaagaagattttcctaagaccccaaatgacccaggaaacggacacattgaaggggttgcacctcaccaaatgtccctgacaaggatgcacttatttggaaggatgtgcccttactctgaaggctggtggtctgaggagagtagatgtggtaatcatccaactacattaaggcacatttatttctgttgctttttggttcattttattttgatttggtttgttttctgttcttagcaatcagtccattttatgagtactttggcaagtagtagcaaaagctgttttctctaggaaatttttaacctttcaaacacagcagagatgttagggacattataaattcaattaaatgtggtccctgtttctggggttgatggtcataaccatttttctttttcttaccactccagtttaatttacttggaatgaaaaaagtaaatctgagcttctgaggattatcagttgagattctgggcctttaaacacaatcctctctggtctggacttatttgcaacccagcacttccagaaatgcccatcattagctcaggaggatgaactccaaataatccacgttctatttatctcattattctctatatttatgtattcattcaatacgtatatctcccatacgccagcactatgcagatgatagggacatcattttgaacaaaacagaaaaaccactgcctgaagatactgggccatgaaattctgttcaaagatatgttttggcattcattttgcaaatctctacatagcatgaggaggaatgaaaagaataaattatatccttcacttattcatgcattcgttgtccatttatttaaaaaacatttattgagaatctattttgtgataggtactgcaccgaatgccaggaaaaacaagcataaaagatacagggtgtccagaaaccatctgaaaggatgaatttgactactcaaatattttaaaagactaaatgataaaaaaaaaaaaccctaaacaaattaaaattttttgaaaagtttacacaaatgaggagagttcattttcttaatatactcaaaacattaacatatccataaaaaataaactcctcaagataattgattcaatgagtctttggaggtaggagggaactggcccataaatgtatgaaaggtgactaattttctttgcaattaaattagatggggaaaatatgttttttgtgaatctcagggtcagtgtgtatagaaatacaagcatttcttgtgatgatggtgggattgtaacttaatatattctttttagaagacagcttggcaatatttatgaaaattttaaattcagtttcacagctaagactttattcaatgggtaaactcacaaagatgttcaggcacaaggatgcctgcagtgttatttgtattaattgtagtaaaaactggaaatgacccacaagactatcaatagagttaaatgggtttttagacataacataatgcaatactatgtgtcaaataagaatgatcattatctctagatcatgatctgtataagtccatacaaaagggccccaagatacactattaaattacaaagagcttggtgcagaatagtatttgtaatactctcttggaggatatgcaagaaactattaacactttactcccgacagtcatgaccaagcaattagagttgccccaggtaacatctatttgctatcctgctctgtcacataacatttactgtaagtagagctctctctgagaaatgtgctggtccaagctctttgaatatttgtatacagttaaaatcacgaagaactgaagatcactgcaattttcaaaggaatgaggactttaaaaggacagcagcagcaagggaaaggtagggtgaccaacttgtcctaatttgtccaagacttccccagttttagcactgaatgccccacatcccaggaaatccctcagtgccaggcaaactggaacagctgatcaccctcacctgccttggggctgctgcagaggcctaagcatgaaccgtagacacaagagaaactgagaaactttctttctgcccccatcctggcttccctgtacctctgcccagatgccaaagagtcctcctcactttcccacagccacaactcccgacttcccttgcacctctgtcctttggtacaaagatttctacgtttgcgttagtgatgtgacctcttggattaggatttccaaaactagaaatgtttttggagtttatgtagggttttacaggagaaaagaagctattgtgaaagaactgtgagggaaggaattggatataggaacaaaagttattttgggggctagaaatcataaatctaaatgggttttcaaggcaaagaaaaacttcatggtatagataggaaaggatacagtattattcattagaaaaatggaaatggtatctatgaaattaatttagatttaaacaagaatattttaagagggaaagtttcttttttttttttttttcttgagatggagtctcgctctgtcgcccaggctggagtgcagtggcgagatctcagctcgctgcaagctccgcctcccgggttcacgccattctcctgcctcagcctccctagtagctgggactacaggcgcccgccaccacgcgtggctaattttttgtatttttagtagagacagggtttcaccgtattaaccaggatggtctggatctcctgacttcttgatctgcctgcctcggcctcccaaagtgctgggattacaggcgtaagccaccacgcccagccttaagggggaaactttcaagagagaaaaacgccaaccctgagggaatatgggattaaaaaatgtatcagtaatttatatgcttctgacactttctatgtgactcagaatactctgctgggaatagctaatggcagaaaatttcaattattcccagttgcaggtgctgtgttgtgaaaggcacaatagcccctagcaaccctaacgaggttaaaggaacagtccctgaggaatctcactgttagtatccatggcaagagaaaagctaaacactggggatacatattacttcacttttgtccctgaaattgggcaaagtttcagatttgagaatggcatcagaagtatagctgtttagtgcatgtgtttctcatcatagtattgatattcatttcacatatattcccacagtaaccatttactgaaggaaagccaaagccattttagcttgattacattttctttttttggtttgttttttttagacggaatctcgctgtgttgcccaggctggagtgcagtggcacgagctcagctcactgcaacctctgcctcctgggctcaagtgattctcctgcctcagcctcctgagtagctgggactacaggtgcatgccaccacacctggctatttttgtattttgagtagagatggggtttcaccatattagtcaggctagtctcgaactcctgaccttgtgatccacccgcctcccaagattacattgtctaagacttcctacagaaagacaacttcatttgatattattcacaagccatctagtctcttgccttcaacatttttggccatgtagtgggtgggtgtgctcctttttgcactgatagatcagcagccatgccacttttctaaaaccatatttattttgccccctgtatcatccattcagtcatttaaccaatatttgctaggaaatgagtgagccattttagcttgattacattttctggggtttcatagatgactaagatgtagcgtccactctcaggagttaaggatacattaaggaagacagataaaaccaactaatattatgacattgtaggatgaaagaggtgtgtgaaagatttatgaaagtatagaggaggaatgcttaaattcgggagaaattcaggaatagctatctcaaggggcaagtaggtaccctgcagtttctataaaaggtgaaggtagggaagacttacagggagactgaacaatatacgcaaaagttacagaggtgtgggagagcttggcttgatcaggaaactatacactgcaggctagaatcaatgagtgctttggaaggaaggggatgcacatgggagaaaggaacctagaaaggtaagtcgcagacaatgagggaaaggcaaaagacaggacatttacatttactgagcttttattttgtgccaggctttttatgtttggtatctcacacaattactccagtaacttcctgacaatgtttgttactccattatgcagatgaggaaacagaagatggggaaggttatacctgggctgacccattttttgaggccaggtgtatctaataccaaagaccctggtcattttaccgcagaacattgtttctagaaggaagtttaaactttaccctgaaggcattgcagactctgatggacatcaacaggagagaggtatgatcataattggattttattttgagacagggtctcactgtcgcctaggctggagtgcagtggagcaatcacggctcactgcagtctcaacctcccaggctctgcctcccaagtagctgggactactggaacctactgccatgccaatttttttattttttttatttttatttttggtagagatggggttttgccatgttgtccaggctggtctcaaactcctgggctcaagcaatctgcccatctcagcctcccaaaatactaggattacaggtgtgagctattgcacctggacttaactccattttagaaaaaaactaaaaaactaaaaaaactaaaaaactgtcgtgtggaggaggaggaactgagaaactgggggcttttcctaggatgacagagaaacattttcctgcaacaaacttcaatgtctaccatcacatacatacaagtctaagtttcataggccttgatgttgtcattcttgcatttatgcctagaaacatgtaagtctgagatgtaaattgcagaactaaagatgatggattccagaaactctgatccacctaagagaggagtaggattgtggaaggcacataagggtaaaatagtatcacatttctaaacttgaaaaactcaattcaaatatgtgcagattcagtcccatatgaacagccatgttggctagaggacatcatacttctcaagggcaacagagatgctgggagcagattaagtagttataacttgcacctgtgtaattactatagcgagtcacacttctgtcaaatgatcctattgctttaaaagtttgagatgatgcctggtctaagagctttctttagctgcatgtctcaatgtggctataaatttcagtcaagtcatgtcctgcacattgggtctaattaaagaacacaagagtgagaagggcagggtatacactcagggatggtggagttagtttatttcttggatggaaaatttaacggtcattataatgcctctttgggttggaaatacagattcttatgtacacattcattttgcacaaatgaaaatggtaaaccaaaatcagagagtgttgaagttcttaaactaaagactaccttatagtgagctctagtaaagaaggttagaaacaatttttaagaaaatttaataacaatatttcagagaaaaatttgttactgaatattttccagaaatagtaacaagacatctgtattcaagtagatacaagtgattgtaccagagggtcaatattttgagatggcaagcacacattcttatcataaagatatggtacaggaactagaagagatgtaatattccttgacgtgattctgtcataaaaggttaacaatgttacatcttagggccaaggagacaatcctttgaaggttgcaaaggactggctagagtcaggaatcatcagcgtattcctttaaagataaaaattatatatatgcatacaagtgctacttttaaaatcaggaatgatcttctatttttaggggccaaagagaagagttaaaaactataaatggatatttgacttatgtggcagaagaaaagttcagaggtttcaggatctgcaggtgagaagaaaatgtaaactaaatggcaatctgttcagtgattttaaaattcctaacaaaatgcatttcctacaaatgttgctacctgaaaagtaacaattagacatccatttatttgtacttacataataaaaatatttcagagtaatgtataccactgtctaagtctttctgttctttatctgtagccaaacctacttgcccaaattagttgtactaagagttttcaggctgtttacaactgaaaccatcttacaaagtattttaggccacatttgttttgttgatgaggccaagagaagtgaaatagtttttccaggggcatgcagtctgttattaacaaagttaagactatggacaatttcaggatcttgttccttggtgttttggaggttctgaggaagttggtgaaaggcttctcctggaaagtaaatgtggttaagagccaaccaggtgaggctccaggcctactgcctcacttcacctaaagcagatgggctgtgttacagagacttatagaccgggctttttttgaagactatttatttgaaacatctcttctgtcaaatgaatttttaaatgctaaatgaaattttttaaattttaaatgagtggcccacgctaatgtattaggcatgtgaaagggacgatgttgtggacatcggcaggcagcctacatgttcctgaaggtcagacccgtaacccattcatcttggaattttcctcacttggtgccttttaaaaggggatttaaaggcaatagggtctggaggttcttgcagttatagcttcaggggctcccttctgatcttgcacagttttctaattattcccttgttttcttccactgacccatgggatgtggttaacttgtgtcttctaaggccagctgtgactttttccttacccacgttacttccaagttgggaacacaatcttgcaacctggccccaccctgttgtctctgcacaagcctgaaaactcaggtaaatgaatgaatgaatgaatattaggctgataataactacagggaaaaagataagaggtaagaaaaataacagtgatgaaattagcaggcaatagagcccctaaatatcaaaggaaggtaaatgagttcattctagcattccactagccctcttaggctttgtcatgattgctttctcttttttctgtttacgttaatattttgtttctgaaatgcatctcatcctttcctccctatagagtctcctaaattgctttcttttctccccaaccttcattttttcctccttcactttcccactttcaattctaatttccaattagatcacttaggtttacaataatccccaacactacgtattattcccatctcaaagcaaactttagattgtaaccttcaaattcaaagtcccttatacagttttattctggaaaagttgacttcaagcaattattgattggcttgacttcttgctaaattttgcctaaaggcgagcctttttgaaatcacacaaagggtggaaaccacacaaaagtagtggttctcaaactaggtgggaattcataatggttataaagaatgaaatgggctggtcacagtggctcatgcctgtaatcccagcactttgggaggcccaggcgggcggatcatgaggttaggagatcgagtgaaaccccatctctactaaaaatacaacaaattagccaggcgtggtggcacacgcctgtagtcccagctactcgggaggctgaggcaggagaatcgcttgaaagcaggaggcagaggtttcagtgagccgagatcgtgccactgcactccagcctgggtgacagagcgagactccatctcaaaaaaagaaatgtaagtaatggattatttgggagttaggtaaggagcactgaaaaatatgttctaaaatttatattcatgaaaaataactgtatttttatttttaaaaaataacatttattaatagagattctatagaggaatgaagttactttttatttcctttcttttcctttactgtttccttctttccttccttccttccttcccttacttcctgcctccatcccttcctccttcccttcctccctccttccctccctcccttcctccttccctccctcttttccttctttcttccttccctccctcccttctcatcttggaatgagaatacacaaatcctcagttaactctacacttttattcaaacacaaacttcagttgccttgactagttttacagtaagaatttaattttgaagaaaacaaaaattaaatgtcactatcaataaatcaacctaaagatcaagtagatgtatagcatgggcagatatatcaatttaatatagggattaagaggttgtggagtcagcctgacccagtctggacttcagctgcaccgcttactgtgcatgtccttgagcgagttaactaaaatataccacacatccatctgcaagcatagcagtgaaggttaaataataatatgtacatgaaaaacttggactgtgcatgggacatagtaagtactcaataaatattataattaatacagttttgcaaaacatagtatctcatactgctcacatcactgcaaagtgataaagcaaaggacatcccaatatcctacctaagaaaattagtgttcaggcaatatttaattcatgtgcttctagtgctatttataattatctcattcaaatgtcattttgtaacaagtatttgatgtcccagctgacttgattctagacctagaacttggaaccaataataaattggtgggctttgaacttggaaaagcttgtgatagagtctaaagttttaattccacagggttgatgttggttcactgcttgtcacgatgtgcaattgaagctggctatcaaagcagaataaggcaaaggtactttaactccttcacaatcacatgttttcactttaatccaattatagctgctagtcacatgctttaaagatcacagatccaaataaagaaaccatcgggggtttctctatggcttataaaggagcaacatcttttatgactttaattagtctaattttctattgttaaagagaaaagaattatctgtccttaactaaggcagtcagttgtgcacaaagccaaacgtgctgtgggtcaggagatgtgagttctgacctctgaccaaccatgacctctctgagtactgagactagtcactggctgtctctggtttcactttccttgtttctaaaatcaatccttgcactgatgatcagtgagatcctttctagccatcatagcctattatttcatacaaagtgatttttccagaataactaaaaagctgtaaatggtatgttcagagatgacaaaatgagacagtaaataaagggtaaacgtatgtctccagaaagcaaaaataaataaataatactcaatgagaaaaaagatgagtggtgttttgaatattaacctctatgatatttcagttattaaaattagcttcatagttaattggctgatataacaggactttgtgtttcttaagcaagtatttgttaaacactgatgaagtctgtagtttatatctaagccccatgaagtttacaacatttgagttcaacaaagtttatcttgcaggagcttgcaatcaagtagatgagtaaaaagtacggatttaatatacattgcttaaaaggttacatataaatcacatcaagccaaaatatcagcctagttaagttgcttgacccagggttataactcgaatacacaggtctctggatttcccttttagagaccgtattccctttaatagggtttaatgggggggggggggggaaccatccagaagctgattgttgttattgttttataaatgtctttgttcttttaaaggtatgtttaatatgctgtttttattacagactatgtatccatgaaaagtaagtttgaaaatgcagaacatagattttttttctcaaagaaaataaagggtgaatttaatggaatgatcattttcaactggaaaggtgtatttgttgaatgctttttgtgagcactcaataatttagcttttggagcattctccatacagtctaatttaatatttgtaatgatccatagtgttatcactatcccacatgacagtaatggaaatgaggttcctggaggtccagtgatttttctgaatttaccaagtaaatatttgggaaagtgaaattaaacccaggctggcaggctggaaaatgtgtgctcttccgaatctttcatcttcttctggttcttggtgcttctctggaattttgcatacagagagaaggggacaggttcttttcacttttgatgtacagaggttatgagaaaataatcttaagaaatttactgaacagctcggttactaaaaatgtacatctatctttccgcatgatttttaagaagtgagattcccaatgaatggatttaaaatgcaattttacattcacctagaatgaatgtgcagatctttcctaaagatataagaaatcgactgaagtaagcaagaaaaacactattccggaattgcaaagggtatccctgaagagtatgtgtgaatgccataaaagttatactatatctaatattatcgagccctaattgaaagccgctgatttcacctacataattccatgtctgcgaaatcatgtggtgtttctagtgaacataaacacatttacagttaaggaaaacttaaaatatgtatccaaagataagttcaataggtttaaaaacccaaaatctggctgggcgcagtggctcatgcctgtaatcccagcactttgtgaggctgaggtgggtggatcacccgagttcaggagtttgaaaccagcctggccaacatggtgaaaccctgtccctactaaaaatacaaaaattagctgggcgtgatgacatacgcctgtagtcccagctactcgggaggctaaggcaggagaatcgcttgaacctgggaggtggaggttgcagtgagctgagatcctgccactgcactccagcctgggtgacagagcaagattccgtctccaataaataaatagatacatatatacatacacacccaatatcttgttcttattctttttaaactaaaaaaaaatatacacataactgtaggaagctttccttttcctttctgatagacacctttgaaatattaacttggtcagattcaacccttcctatgtttttaagagtgctagccaatatgtattttgcttgtatatgcataagatttgtttacataatacacaagaagctgttaataatcgatcctttctagggcacgttttgaattttgaagcatacgaatcaattatcttttaaaatattttcaattaaaaaaagttctagggtggtactacaggcaaggtatgatggaagtgccacattctcaaagccactgaagagagccagttgaaagttagcaaatgagttagttgtttcatcaagaaatggaagtggtctgatttttttttttttccaaatcaaataatgcagtacagtgcaaattcttgaaagatacttttattttcaaattgtacttggaagttcttcttattctgattctgttgagcagtgcaataggattacattggtagtataattgaataaggctctgtacagaaaaactataaaaaacaattgcctattgctttatttcctgagaaaaaaaattaccttttgataaaataagtagaaatgctgaaaagaatgtattcaagttagaagtatactccccactgaacacctctttcacatttctggcccatatagcagggatccccaacctccaagccacagactgcttccggtccatggcctgttaggaacctggtggcacagcaggaagtgagcagcaggcaagcgagcattaccacctgagctttatctcctgtcagatcagtgggactgtgaatcctattgtgaactgtgcatgcgaggcatctaggttgtgcactccttatgagaatctaatgcctgatgatctgaggtggtttcatcccaaaaccaacccctctccccaccatccatggaaaaattgtcttccatgaagccagtccctggtgccaaaaaggttggggaccactgctgtatagctacaacactcaagaatacatggcagttccatttaaattttaaaaattgaatgtctttggtttaaaatattgaatggttttaaatattccttataatgcaagaccacatcttaagctacaatggagggtaaaggacaaaggctatatttgaaaagtagaaaggaaatacaagagttttcagttaaattggaagattttttttaaaaaaaacctcaaacattttctaaaccctcaaattattcctaagatgcattcaactttgaatacattgataaaattcattgcttgacaaagttgcctatatttttcattgaattgggcagtggtgtgattgaattggccaaatcagaacctagagtgagcattctataaactcacctttactttgatccttgaagatcacaagttttgatactgttgaaatctctactctttcaacactttaattaaatggcatttagaatttcatatacttctgttgttgtttccacaatcttaaactggatttagaaatacttataatgtaaatgcaagagctttaacttagtaactgtatttcctattttttgttgtttttcttttgccagaatttctgtttgtctacaataaagtccagcgaaatacagtatttggttaggttacttgttaacataaaattttatcatttgtagagtttttacttaaccttcctattctctagtctctataatctttcaatgaagataaccagttacgaatatctcctataccatattaggcctgccagaatgtgatttcttggtataaagtgattttcaaatgttttcctaactcagtagccacttccatcatttatatctgagttatttcctctttttcttaatagagaaatgaattgatattcaagccaataattgatattcaagtgacatagttatgtcactaatgaaggtaacccatcctcagctaggaaaaaaaaaatatgtattttccaaaactgctgacttttactttgttgtcagtgaccttggagtcctggttctatactgtataggctgtgtgaccttatttcagttgagggtagaagagaaaaattatattgcaaaagtgggaaagaaacacacttataagattttcagtggaacttgagaggacttttcatttttctttttactataactcctcaaacagtatctaaaccttcaagttgttgtttctctccttctctaagcttcagtgctctcatttgtttcatggagataataaaaaacatctgtgcctcatctcatttatagcatggagacaatgacaatagatccacacctcaaacagtgtggagagggtgaaatgatgatgtagagagaaagcgtatcccagcacctgcatggtaaccactcagcacaagttatttgttattgttttaattggttacgaattgtattttacatataacctgtcctgtctggaataaatccattaccaatgaaaacttttaaataggaactccgtagatgataggttattcaataaagatctactggaaataaaactgttttccaaaataaaatatatagcggtgtgtgtgtgtgtgtgtgtgtgtgtgtgtgtgtgtgtatctgtgtgtgtacatacacattttaaaaaattgattctgttctcaatagcagaaaaaagtctttccactaccttaaacccacatttgactcaaatacactaacgatatgtaaccactgttcaaaggaaaagctgacggacattaggctgcggaatcctgcaatgcttgtgctcagcttgggcctgggtgtcaggataggaataggagatgccagacctgtttggtagtagtggtagtagtcattgcctaacctaggcaatcatcagctcatgggatttggtgctttaagcaaaggtgttaattattcccctcctcccttttagtaccattttctcttaaactaacacccatctttgggcttaactaagcagaaaagcaaacagggaagaaccaggtggttaaggaccagtgtcttaaagtaaatactctgtatttgagtccaaaatgaatttcaaactcaggttagatgtttcttcttaatcacttaggagccagtaagactctctaagccttccttcctacgctctttcactaaaggaccaggttctttcaggtgctatcctatttggaatttaatttgccctaacatttctccaagagccattacagcacaccacattgctgtatcccatttaactcccaaaccgcagagaagctggctgcagcatcaaacactattaaaaataccacaagggaaccttagagtgggatttcaggcacaagttacagcctaaggacaaacagcggttgtaaagagcttgaatgatactggaatggagatttaggagaattttcagagtctgaaaaaacagtccttaagattttagtgttggttcctagggctggttctccgtggttatatgggttagttaaaacattagagtaactttgcctttctccctctctcctcgagttttttttttttttttttttttttcggtcaacagatttggtaccaagagtgactacaagtgagaatggcttaacaaatatttccaagaagaggttcctatcactaggccttgcaaaggaacaacagactcattagatttttttttaacctgaatatctttattgtgccatctaagcacttatttgaaagtcttcaggtgtaatcctgattcagggtgtttaaaatgcaaatgcagaaattagcccagccatggctacacaagaggccccaggcatttcaaatttgaatgaatattttggaaatggagcagaaacttaatggattagtcattatttagagtcctgtcatgtgggaggtccaaattcagagccttagagcggggaggaatatgttatagtgtggtggtggcagcctcaaaataggtagtagtggtggtgaaggtggaggaggaatatgaggataaggatggtttttctgggtggaagaacaagaggaagagaagccagtacttgcctttcaagctctgcagtagtatcactgcaaactgagcacaacaatggaagaaatggcttctggcatccacttgctcattttctcttattggccaacatacttctggaatcttctcaaaagatccattctgacagactttttattttcccataaaattccaggagcatgtgtagactggacttctgggcttccattcttatagaatgtttccttcatataaaatgcttcagtttggaattttacattcagtacagattatttcattaatacagtgcatatctcccctgtcctggaccctagattataaggagtaagaatggggataatgcttctttttggtcatcaatgtatctcaagagctttgattagggcctggcacatggaagactctcaaaaaagtattgtttaaaaaaatgtctgaattgttaaatggacctggtctgaatatctaatccaaaggcaggcaattcatgggtttaccagcagccaataatctataatatttaaccacagtggaaagttacctcattgtatttgtaaatttgtaggctcaagttgcaattataaatgggaaattgcaactaaggtaattggtgtcaagagaaaaaaaaatttttaaatctactgatggcctaaaattgggcctagagaagctatggcaagccatgtacaaactcaggcaatgagaaagcagacactatggagagtagagaactatctctagaaaacaaaaaccagaccagatatataaataaacaaagggcagagtcctgagaaagacaccatatttactacaagcaaaagaagaagtttcaggtgcctagaactgtgatggttcccaaaacttctaaaccctagtccacctgtgtccatgtgagaatgacatttattttgatctagttatttctggtaaccgagctgatccagtgaggatattgtcatatggtgatgagggacgtttgtgaattactatgtaaagaaaagatgcttactctgtgccagtagcttgggaatctggaatcccttcctgtaagcctcagagtgtttccaggaaaagtcaccaaatagctttgattcaaggaaatgaatctcttctgtcctgtactggctgcttgaaaacatagtcacctgagtaatatgagtccaaagtactacattacatctcagtgtttcttgcaattgactaacatgtagaaattgtgcttggctgggatctcacagttatctggttggtttctgtctgctgcatggagctcacttcctggtagtgaccatagaaggaggcattatctttttccagtcactaaaaactatatgaacatcaacaataacctaatttgtgagctctctggcaggaatgaaattcctctttataatcactgatggtactccctgtgtatggcagcagagtgacacacgctgtcctagtggaacataccctcactttgccttgtgtttaaagctgggcaccacttctaccttagggagagagatggtgcgaaagcagaagtgaggaatcacagatgggacagagttggactgggtgatgctgcagtgaggaatgagggagcatgatgaaggaagaatgatataattttagggagctgggaatgaatagggtgaagagggagagaaaagaggagatttagacaaagaatgggaaacaagacaaataagggaaggagtgagggaagagactggaaaaagaagaggcagatataaggaaaggaaaaaggcaagagaatagagtagagaacatgtgaaaaggagaagatcggagaaaacaaatgaactgagataaaatttgagggaggcagcagagtgttgactgcagggtgtggaatctgaaatataactgccaagttttgaagcctggctccacagctttccagaataatgaccatgggacatatccctaaattctctgagcctcagtttcttcttctgtaaaatgggaataataattttacctaccttatgtgatcatgcatgcccagtcttagcacagtgtttggcacacagaattgttattattgaggttaaaagagagaaacaaagcaaagaaaataataaaatggaggaagtaggaaagagagatgttcagacagtggaaggatggaaaagaaatgtatttctgctaataattttaaccttagtttttccacattataatcaagatttctatgcctactatattgtttctacctgctttaataacagctggaaaaacatgttgagtatgaacataccttttttaaaggtatttttgtattaaaccagcctgtaatagtttgcaaaacagatgttcacatttccttgagttgaaattattccctagaaatgagtaagacgaaggatacatgaagctaaaccggtcatccaaaaaacggtttgtttatttgccctacctctttactgtattgactaggtcgtttgatgggattaactaaattgaccggttattttgaaatgtgttaacccaactgtaggctttagggaaaataaagcccctagtgttcttggtggtgtttctttccaagtttctctccacaacacaaaccacttccttttacttgaagtcattttgcttttctcattagtctcacagtccaggggctggtgttgagtgctgaggcagctctcagttcaagaccataaaacaacacaacaaaattagcccaaaacataaaaggaaagcactgtggagttgttcttctcctctcaagaaaaggaaagtggaagttagggcagataaagtatgagaaagagatcagagatctattcttgcataggggtggggaggtagaatgaatgaaaccacagcccaagtcagagggaaagaaaatggaaggagcaaaaacaacaaaaatcccccaccacctctctcgacattcatcacaacaactctctgtgcacctggcatggtgctgcacagttgtcagatcccaggcatgactccctagtgtttccatgaggctgaataaatagtgttctcacagactctccagtagcagcgggtgaaaggccaaccttcattgaccactataaggcttttcttaaatgctactcggacacaccaaaagaaatgttgtccttttcacaaaaacatgtccttgttcaggaccatgtaagttatttaaaataatggtcaatgaaacaaatatagcaatggtatcgcttctcacattttcctcattctgctcagagggctgacagagtggagaagatcatccatcatccacttctttcaagttactcccttctgccaaagggattaagagacacattttcatcccactttctcaaataggagaaaaagttttccatgctggtttctactgttccatgttttgctcttatattgcacccaagaatcatttcaagatgttctgagaagagatgtaaaagagtcagctgatcttccctacttcaggtctattgaacacaggtaagttggcatgacagtgccccagaaccacacactagtactatgtgtggttataacaaaagaattgctatactggtgggcagggtttttttttttgttgttgttgtttttttttaataaagaggcatagaccataatttttagagcaatttcattaggttatgctagaggtaggtttgggagaagagcctgactcggcctgaggaaggggactgggcttgaattttaggtgtcctctaaaatgagataaagtgaaccaggcaattatgagagagaagcgagttttagatggtgagaagagtacaagtaaatgaagacagttgtgaaacatggtgcacgtgggtggaaaaagtttgctgctgaaagagtcagccaggggctgggctggagaggaggtacaatacatatctggataggggctttgggtaccacacgaaagagatctgattttatcatggatgatgggaaggcttgaaaaggttttaagaagagtgacatttgcagattaatttttcaactacataaatttgctggcatcatggaaggccagagctaagaagaggtgcaacagagatcgaccatttaagaaagtagttctctaattttaaaaattatagtaagaaatacattttcatggcaaaatgtctgtgtgtgtttgcatgtctgtgggtgtatcaataattttataaaaccatatttatctttgatattatagatgtggttttatactcttattttttacgcaattctgtatcatatttttaaaataaaatgctaaatgcaactgacagtttcaaaaacactatttcaggtactagtactataattcaggggagagttggtgagtgcttgaactagggaaatattagcaggttagagaagagagcatggatttgatcaatagttataaaataaaataaaaattgtattcatttggggccgagcatggtggctcacacctgtaacctcagcactttggaggccaaggcaggaggatcacttgaggccaagaattcgagaccagcctggccaacatagtgaaacgctgtctctactaaaaatacaaaaattagctgggtgtgatggtgtacacctgtaataccagctacttgggaggctgaggcacaagaattgcttgaacccaggaggtggaggttacagtgagcttaaatcttgccactgcactccatcctgggcaacagagtgagacaactctgtttcaaaaatatatatagacagacagatagatttggtagaaggattcatgatttataagtttcgatcttggctaaaagtgtttcactaactgagataggaagaacagatttgcaaagaaatatgtgagtccagctctggacatattggatttgaagagttggatatcaatggacattgggcttttgtgtgaataaatttggaaattggggaagtgcctactctgagtagagacagagttttgggacccactttcataagatggaaaatacaactatgaggtacatgaaaacatctacagagtacacagagtgagaaaaccaattaatcaaaaagaacattctagaatactcacatttaagaggtaaagtggggaggaagagagaccatgaagaatagtgaaaagaagtattcagagcagcaagaagagtgtggaaacatctggaacaaaatggctcccaacaaaaacatgttgaataaatatttactcagtaaatgaacaaagaaagagtttaagaagaagaagcctctaagaactaagaagacaattaggagttcattggcaaccaagggagggcagctggaacagaggtgttgtgagaaagtcgtactacagtggactgcagactgaatagggatgaggaggtagagcaacttgactgaaaagagaagatcaagaactagctaaaggatcaataaagagttggctgaactttgctgtggtttgctgtgtattgtttttaagattgtgagagacatgaatggggaaagagccagaataaaagtaaagattgaagatgtgagagatagaaaggaaaacagacgaagcaaggacttgtgggagctgggaggagagaggatcaagggcccagatgcaggggttgacttagagcaggagggagaagggaaacgtcatccgctgagaccagaagggaggaagggattatggatgtcagtaagagacctatggataacatctatggcaagaggatgtaggagctgaggaagttcatgccttgacacagactttcttcaaaaagcaacaagttatttgctgaaaggagatgaagagctgctggtttgggaggcttaagagagaggacaggtttggaattagcatgaagaggactgagagaggggcacagcaggaactaactgtcaagtgctctgagagtccgatgaggtgacaggtcttgactttgttggaattccagcttgaagtgatgtgggattatttttcccaggaattcaggtaaggaagtggaaaaggcagactgtaaaactgacagagctggattttcccaaagtgagtaaggaggacaggatggcaagagattcgagagagactgggcaggccagagggagaggttaggagaagactcatttgcttaaaggagattgaaatccctgaactagagacttgccagaaaaaaaaaaaatatatatatatgtgtgtgtgtgtgtgtgtgtgtgtgtgtgtgtgtgtgtgtgtgtcttattctcttttgtggcagacactaaatttgagccaaggagatgtaagtagaagcattatgtgggatttctcagaagccttttctaaaaggagtgggtgtactattccttcttttttcctccttcttgctgctggccacttagttgtgatggctagggctcttgtagtcatctcagaccatgaagacaaagcctataatctagaaatgttaaaaaaattatctgaaagaagctctgggcccttggtgattttagagcagccacagcagccctggactgctcactctgaatttctggaaaaagaaatcaacttctgtcttgattgaagcacaattttaaaaaattgaaataaaaatattttatatatttatggtatacaacatgttttggtatatacagcgaaattttcaggactcatttactaaccatattctagctaaaagagaatatatacacagcaactagagaacgaatagagatttcttggaacagaatgctatctttctaccatgtaatgcctaagcagggcacatactttatagtaagcaaaaagctttgatctttgcaggagattatagactgcttttgatttgggtagagaagaaacaaaagtcaaatcttggatttcttcattaattaaaaaaaaaaaaaggcaaaataaagccacatgtatgttgttttttcccgtaaggtcaagcaaagacttctttatactttttgtgagaaaatgtattgaaaattaatgacattaatacccaggatggtacatttccattgcttcacaatttttttttctttctgaagggttagaatttccaccagtcagcataaaatggttaaaactgaagcctagtaaatcacttgtattgcattgttttcaaagtgactaaacagctgtagttttcaaggtcagccaaatcatctgccagggtcacacgtgtttcacatgtcaagtaacgtatatgggttcaattccatccaggatcctaaggaaaaagacatttgcaaacaagtgatccgaagacatttttctaaacaggtgctgtggttactgggataagagttactattgtaaaccacttgaatttacgactaagtttccaatcatttaaaaagaatattcatttcaaattataatgtccaaaccaagaggaccagctcctgatcataatgacattcaatgaggacagaaagtaatattgtataattgttattattaccataatgacattgttcatgtacaaatgagaagaatgtatattgggtatcaaaataaaaccaaccaaacacataattaggatggaacctagttaaacagttgaagagaggagacttaaagcaacaagacttggctaatacttctccctccaattcttgctccaggaaacattgcatagaaacaaaagacatgactaccatatgccaataactgctttaacaagctggagtaattggtatcatggagccagactgatggaacaaagaaaggatgacctcaggatttaaagagtttagggacagaaaaacattttaaaaatccagtttaattcagaggatagttagagatgtctggctccaactgagagaaggaaagggtattgatttgcgtgagtggctctccattgggctcttctaactcaaaagagataattggccttgaatagtagcttttatattgaatttatattgagttctcttgatgttcttggtatgtgctcttcaaagcccaagaccactccctgatcttgtttatatttgctagtcctaatgatctttcatgtgtcagacgtgctgaatgaagacgattgccttctgatcatttaactcttctctgccagtttcaaggttggcttccatattttagcaagcaaaataataggcatctccaagtcacagtatgcagacaggaatagacaaatacccactttagctaagtatgggctgcagtcaagctggaaaaggtctctcagctctgagtcacttatacaatcgagtccctgaacatgtttctgtccctaatattttgttgctctgggcaaccatcaagtccacatgaagacttctgccaactggagaggatgactagataggagtgccagaattttcttttaactctttgttgaaaactcaaaatagcaaatggtgtcaaggatatcccctaaacatccagattggaaaaagtggaattcacacattgccttggtatcttttattcacttcttagggaaatatgactaaagaagataaaggcaattcatcagaggcatgcatttttttataataataaaatattaggaaaaagttagatgattaggtactatttaatccaatatcatcattttacagaacacaacccaggttaaattactgaccaaaaattacacagagagctaggcagagctgggattatacccctggtcttaaaaccctgaggtcattgctctttcctggactttcagaagcccagtgccagaggcaaagtgaagaaatgttaagaaatcacaagtgatcacctctcttttgtaatagcaaacggttctagttgaaaagggctgctttgctgggatactggaagcaatcctaaagctctggagtagttatcacccattaacactcccaatacagaaagtgtgactatggcacattaaactaaagcatctaaagagtgttcaaggcccaacaaaaataccatgtttgctggaagccttcattgcttattattctaatttggtctttgcctcctctgaattcttacgatactctgtggtacagtcctgagactacttaagattttttgcccaggctggagtgctgtgatcatagctcattgcagcctagacctcttgggctcaagcaaccctcctatctcaactcccccagtagctaggactacaggcatgtgccaccatgcctggctaatttttgtattttttttttgtagagaaaaggtttcatcatgttgcccaggctggtctgaaattcctaggctcaagtgatcctcctgcctcagcctcccaaagtgctgcgattagaggtgtgagccaccacacctagacagtttcttttgcacatgtacaattatattgtgtcaagtccttgggggtaggactatatcttattcatttttgttttcttgaaacccagagcacagaattaaacatattttggttgattttattttctctagaggtacagtgacgacttacttatccagattaattatccaggaatttatactattcaaaatcagtaagtaggtgaaaagaacccagaaaagtcaagtaaacacttgtaggatcttgttcactttatgcatctcatatcctaaaggtctacctcagaaatgaattgccctcaaccttcacttttattttgaattaatttacctttattttatgctcaatgcaatagcttggtaatcaggtttgccaaggaaaaagcagcagcagctcacaaaagatgccaataaagccaagcttagtaacatcatgaactgaccaccagacaatatgggacagcagatgagaaattaaagtgcagccagatttgctgctcgttactgtaggggaaaaaaaagtcctcatagatcattagctcctaagtgcatttgtgaatgacagggaagtacaaaagcagatgttcatgaggaaccagagccagcaaaaatgatttaattacattcagtgtacacctttaagaggttaagaataagcataacacctttcagagattttcatgaatattcaatatacaggacattttctcttaaatgaaatgtaggaaatctaaggatggagataaactagccttaaattcagccttagaatccaggtcttaacctatgtttatcctacatataatacgaaggattataaattttcacacattatcagaagcattttacacctactcagtaaaatcatatgattagcagttatgaaatcctatacatttatcctccttatattttttgtaactatctcttcctttttattctggctatctagctatctagtgtacaacctttattacatcttatgcttgaatatcgctgttgtctttgagttggtttcaaaacctcggatttttttttccttcattagctgcattaaaaaaaagaaatttccaggtgattattattatcttctgtagaaacaggatctcactgcgctgcccaggctagtctggaactcttggcctcaagtgatcctctggccttgacctgctaaagtgctgggattacaggtgtgaggcaccacgcctgccccccaaggtgattttaaggaacagacaaatttgtgaaccactatccctaagtgcttagcacaccattcatttcactcttaattatatccttcaatggaactaactcccttagtggcaggcgtaatatgcctgtgatttctgagcttagatgctctttaaaaatagttgtttttggccgggtgtggtggctcacgcctgtaatcccagcactttgggaggccgagatgggtggatcatgaggtcaggagttcaagaccagcctgaccaacatggtgaaaccctgtctctactaaaaatgcaaaaattagccaggcatggtgacgtgtgcctgtaatcccagctactcaggaggctgaggcaggagaatcacttgaatccaggaggtggaggttgcagtgagccgaattgcgccattgcactccagcctgggcaacagagagagactccgtcccacctcccacccccgccaacaaaaaagttttttcatattcattgtgttagcccaaaatatctgagacaggtctcaatcagtttagaaagtgtattttgccaaagttaaggatgcacgtgtgacactgcctcaggtggtcctgaagacatgtgcccaaggtggtcaggctacagcttgtttttgtacattttaggaagaaataatacatcaatcaatacatgtaagatttacactggttctatctggaaagctggaaagcgggaaaactcaaagttgggggagggcttcgaggtcacaggtagatttcaacatattctgattagcaattggttgaaagagttattatcagtagaaaggaatgtctgggttaagataaaagttgtggagaccaaaggtttattaggcagatgaagcctccaggtagcaggcttccaagaaaagagatcctaaatgtttcttatcagacttaaggtctgtggtgatgttaatactggaggggtaaaataaggcatgtctgacttcctttgcggcctaaatcagtctttcaggttaaattttaaagtgccctggccaaggaggaagtccattcaggtgagggtgcaggcgtgcttcaaattttatttttagtttacaactgttagcgaaaagtacgtcctctcaatttccgttttccccctgtatttacttaagaactattttccagttccttctatatcttgctttgcatctccagcaaagagatactaaagttttctcttggtcttcttttcagaggtgcggtttgatgattacgcacaaagagacaaagataatgagtgggggtagacctgctagcttaactttttcttttagagaagcacctaaggggatctgtcacatggatgaatctacccttctttgaaggtctgatttgaaagcagattggactacattctgcacaaaggcattttaaacatgcaggtgtgaatgccccaaataacaatactttgaacttttacagaacctttcatccagtgataccaaaacaattcagtttattaaaggcctaggaagctggggacaaaacatccaattgatctatatatggaaatttattgcattaacttggttggtgattcctttcaagtctcccaacgctggggcatataagcagagaaaactgtacggtttctgcaagctacctctccaaattgtaatattttccatttccaactcctcaagaagagctaatcctcttcttttcacatttatgcttaattagagagttaccagttcacagacagttatttatgttcagaacctaataaattcttgtttctgccttaatttgaccaaggattgccttctatgtcatgttctaaagaagcccattgaacaaataaataaaaacagacttcacctgtagtgagggagaactattatctaatcaatttttcattttaaaaattaaatacttcaaaattggctgggtgtgatggcccacacctgtaatcccagcactttgggaggccaaggcaggagaatcacttgagcccaggagtgcaagactagcctgggcaacatcgtgagatcctgtctctaaaaaaaaaaaaaaaaattaaaaattagccaggtatggtggtgcagtgctatgtgcctgtagtcccaggtagacaggaggatgaggtgggaggattgcttgagcccaggaggtcgaggctgcagtgagctgtgattgtgccaccgcaatctagcctgagcaaaaagtgagaccctgcatcaaaaaaaaaaaaaattgtaattaaatcttatttttaatctgagagcatagatttaagttgccctgaatatacactctcacttatctaattgattttttttttttcttcgaggcagagtcttgctctgtcacccaggttggagtacagtggcatgatctcacctctgcctcccgggttcaagccattttcgtgcctcagcttcccaagtagctgggattacaggcatgtgccaccatgcctccatgcctggctacttttttttttttttttcagtagagacgggggtttcaccatgttgcccaggctgatcttgaactcctggcctcaatcgatccgcctgcctcggccacccaaagtgctgtgggattacaggtgtgagccaccgtgcctggccaatcgaattgatttttaaatgaacaatctttttttttttttttttgagacagtttcactttttgcctaggctgaagtgcaatggcgcgatctcagctcaccacaacctctgcctcccaggttcaagcgattctcctgcctcagtctcccgagtagccgggattacaggcatgtgccaccacgcctggctaattttgtatttttaatagagacggggtttctccatgttggccaggctggtctcgaactcctgacctcaggtgatccgcccctccttggcctcccaaaatgctggataacaggcgtgagccaccgctcctggtccttaaatgaacaatctatcgtacaaatctgttggatacctctactttttaccatatatctttcaaaaaacttacaaatttaatcttttcctcttttccaccttctgacttccttattatatacattgcagtgaactcaggacagctaagattcagagtggcaactggggtatattcctattttcccatattttaaatctgctgtaaaggaaatagttgttatgagcaaaatgtgtctgaggaatgtttatcagactatcgtttttatttggcattgtcccagcatattagtttttaatttttttgccccatttcaatggtgactttgatgttttgttttgaccagctgctgagctttttgtggctgtccatttacatcactttaaaaaatggtacataaatgaaatttgaacaaaatgaacagtactttaacattgtttcaaaatcaaatatcttcctaaggaatctgatttgtggcagatggagaacaaaaccttccagagggagggctgttaaatgagtcttaattgcttgcacatgaaaatattgtgactaagattgtgtgcacaattaggaatttaaacatgtagaaaagaactggccatagaaacaggcagacatttttgcagtcagagctagtttcttgtgaacacagacaataaagacaagtcagtaaaggaaaataatttcaagagaaattcagttgttttctttacttcattgttgcttacattgagcttccaattctaaagatgattcatttgccttggaaactcactgatggaagtatcacagtacagtcaagaaaaaaatgtttattcaagaactagtatttcttttttagttcctactatgcgtcagatgctaggtttcgtgcttaattcacttcatttaattcttacttaatgctctgagataggtttgctattattcccgtcttctaatgagaaatcaaggctcagagaataactttcccaaagtcaaatagctaacaaatagtgcagccaggattctctgtattgatttaatgaatccaccctctgacaatgcctcactgctcccctgggaaaaagcacatatcttttttttaaaaaaatgatttaataaacttattctaagagcgcctatactttgttctgagtcaataatgccttccttctgttggatggcatgatgtaggttgctaggctggacttgttaaacgttgggtaaggaaggcatgattgcacccaggcgaagtgaatggctacgcagagggcacagataatctgaataggggttgggctgagatgacagatttagagacagaggccaggacttcctacaggggccacacgtcacggcgtcttgtatagaaccaagcataaaagaggcatcaataaatgtgtgtggatcaaatgatgagatggtcaaattatttttgtgccttcagaggaactgagttctcaggatacattaatgacaggtaccatctggatctctaaaaaaaatgagtatcataaaaagaaattcagtgagaaataaattaataaaataaatagtgcattgaaaccaatcctactagcatttatttcccctatctaagagcaccctaatttctttcaggaatatactttgtatccctattagataatcttaataatagttaaccagcaatgatcaagtgcttactgtgagccatgcattttgcttcatttttcataaatatctttttttttcctaagacagagtcttcctctgttatccaggctggagtgcagtggcacgatctcagcttactgcaacctctgcctcccaggttcaagtgattctcctacctcagcctcccaaggagctgggattacaggtgtgcaacaccatgtctggctaatttttttgtgtttttagtagagacagggtttcaccatgttggccaggctggtctcaaactcctgacctcaggtgatctgcccgcctcagcctcccaaaatgctggaattacaggcgtgagcaaccatgcccagcctttcataaatatctcctcaaataattttcatgaactccctatgagataaatattattattgtgcttacttcaaaagtgaggaatttcaggctctggaaggttaaatgaattgtttgagcacaagcatctgtaagtcgtagtgctagaatatgaacccacaaaatctggtcccatcattcagctcttactaccacattttataacatagtttggtagaactgaagccacctgcctgttctcttttagccaaggcccaggacgcaaacaagacaaattagatcccttcactgctgtttgactcttgaaataatgacaaagaaactaagaacagttgtggggatctcactcgactactcctgccatgagactttccccttgatttgtagccttctagcactgtaaagatgcactgattccttcaaacctcgtcctccagcacccccaccaccacctgtcgccccactaattctcagggaattcagaattcttcctatattcttccactaagaattttgcattaatgagcagagttggtttttttgtattgcaagcaaaggatcattgctgagacaccattttctaaggggaggtgataagccagccaaggggagaattgtatggaatccccaaagaacaagatgcagacaacactgtttagtgtgccacaataatttaatagactcactgagaaataatagcatgacaaaaggccaggttaatttcctctgctgccctttctgtggaaatgatgaaggttcttgggctcctctctgatccactggtcttagatacattggccttctcctttatttccagtaccctcaacagtttccagtaaagagaaacagcaagggagggtctgtagaaagacagactgtcttgaggttggctgaggggtaaaagaaatttcccagaaattgctccttttccttcacaaactgcctagaattcagattttgtctccttcaaagttgcatctgggaaaatgtgtttatatgcttattccacacattgccatcattgtaatgattttagggctccctgtcttggaattgccttaaaagtccatgtgatacttcttaaaaaactctttaaaatcccttgagaatggtttcatttctggagttagccccatctaagctaatttgacattctgtctggtgaatagggttggtaatcatattggaaataatatttttggtcataagtgaagtgttactataaaccagtgagattgcttattgctttttggtatgtgtgtgtcttatatggtctgtaaatggtctctaaagccacttccaaaatgctttcagcaatggcatcagggctcaaataattgcacagtttccagagatggctgttttgaggatcaacagtaattgaataatataataatatttattggtagtttataatacttttcaacatattaagcactttccacatgcttttaaataagacctgacatttactatgtcccagacaccgtgctaatttttttacacagattatctcatgtaattcctcaaaattaggaaggtataattattacccaccacattttaacagaaaagatctaacacatcggcgtgacttttctaaggtcacacgtaaagtgggtgagcaggacagccagccacgaaaccccaattttctgacccctgagtcttgttcctcctccttcacatagattttgacttgtatgtcaaaacacaaaaacaaaacctaccaatgtttgagatttttttctatgggaggataaaacctaggtctgtctctgtagaagcaatattagtcaaataacagtcagtccactgtcagtgacttcagaggtatcttacttgtcattcaactctgaggtctcggtttcacgaccagttcttttctattttccttttggctattttgaaacatgtcttcttttaccaatctcagccctccactttctcatgctgtgaagtattccctaaatttctgaattattttcccaaaccattttcagtctctaagctaacactgtaggcagcttcttagctctttagaaaaacaatctcacctgcatctgctccattcttcctctctcccttcctttctctcttctttattttacttattcatttatccattcacttataagccctctgttttctattaacttaatgctttttgtcattcaacagaacacattttagctttttaagttccacaaacctctagagtaatggtcctgaagcttactggaggtattttattcatccttgggtccttggagcctaagcatagcctttcacatactagggactaaatgagtaaaagcaaagccaggaagaggcagaaatcaagttctctatgtggacagttctgtgttcaatatgcaaacatcagaaacatatccagaaaagaatgtcataaacacccatctgttttgtgtggcatatagaatacagtcaattagaaatacttccacaggaccaacagtgctgaaaaggaaccacaaaaaaacaaaacaaaacaaaacaaaaatacagaaggaagacggcacactagaaagcactggatatttaagcatcagaaatatctcaaggaagtgcattcaggacatggtgagctaggaaacttttgcctagcaatggtagctaagagatgataatggcatgaagagacttcacccaaagagaagattaatattcccagtagttggggcctgccctttcaggccttcgtggtaagtggtcccagaagcaaggtgagtgctaacgctgaagcactgcgttaccctggttcctccgaaacaccccatctgcctgacttctcacacacacctgggcctttccttgtcaatgctctgcccctgggcactctggtgacaacgggcacttcagaagagtcaggaagagaagtgtgggaattgaagaatcctataccccctggcaggaatcctttccttagcttatataactatagagagtttttagggtttcccaaagagtttctgtgcatccacagatcttatccctcctcttgtcctaccctccactcatatacattcaggaatagatggtatagatttgttttctgttctcaaaagaaaaaagaaaaagaaagagagagagagagggagggaaggagagagaaaaaaaagaagagagatgtccctagggaataacttttgaggaccagcacatccagcagcttgtgtatgtgtgtacatgccagtacattttaggagaggacttgacattctccctctgagtcaatccgtactttgtaattttctacctatgtatcttaatcaaattattcaacttgtctagcccagttttgcatctatgaagcaggaatagcaacggtgtctacctctttggatatcataaggtttaaaaagattactcatctagagtgtttggtacatttcaaatgtcagtaaatgttaacttttattaatattagtattaataatatatccaactgatttttaaagcattttttgagagaggctttttgatataacaaaagaaacgacgctgtgagtgcactccctatttatttagagttaaataattcagtgtaacatccaactagtaaaatttgggaaatgagcctcaaaggaattttcaacattttgccccaccacagtcactgtatttctgagtatgcctagaatattttttaaggctgaaatgggtgggaagcactttgtggagaaagggagtgactgaagaatgcagtttgtgtggttcttttattttttttttttcttttattagtttaaggagacttggtactgtgtccaagaagacaaaaagaatgcaattactaaacatttcccaaattccctccctcccacatccacaaaggtagatgtgatacttgattttcttctcagagacgagcaagctgctctacttaaaatcttgtatgtattttgagagataacagatgatgaccctgacgctgatgcccaggatgacgaagtcagcacagataataatatcaccttgtatcttctttcactaatcgtggagcactttgcacatatgatcgtgcttatcctgggctgcactgtttgttagatgagggtgtgggtgtcactatatatactttccagaaagacaggtattttccaacaagctatcatcaactcaatgacaacactgtacacaggcagccctctcacctgctttcttcagtattccattattctcccaaatttggccaatcaagcccattcacctgggagtatttgttaataatttagatcctgagccttatcctagacattcagttctggaaagtctgggaatcagtcattttgtggttgttctcaggaagcccttggggattcctttgatcagagacaggtttgggaagtattgctctttttaaactcagggcagcggggaagggatgctggcaggagtggactttggtgacactgagatcttttattcatgtggtagcttttcttactctgagacagagttttgctctgtagcccaggctagagtgcagtggcatgatcatggttcactgcagcatcaacttcctgggcataaatgatcctcctgaatagctgggattacaggtgtgcaccaccatgtctagctaatttttaaaattttttgtagagatggaggtctcactgtgtttcaggcttgcctcaaactcctggcctcaagccatcttcctcccttgcctcccaaagtgctggaattacaggtgtgagccactgcacccagccctaagggtagtttttctgatcatctgaaggataatacaacatttttgtcataggctcaataatccataaaatgctgccctatgtgagagatattattattttaaaatacagttaatgctggactgtggaaccataatattgaaatattgttagggcgggtctcaccagtgccctttctaggcaaggagaggcaaactaacaactgggacctgagaaataacatgtttgtcactagattcaatgtaaaatggtaaacctatctacctttgctaactactggtcaacaactaaaagtaacttaagttcaattcaatatacataattaaagtgcattaaatgtgtgcctattgcccacatggcactttattatgtattccttaaaatacaaacatttttccatattattaaaattttctcaaaaataaattatttaaaatcattttattatgggaattttttaacccctacctaaatagaattcacacattatttagaatttggattgtttttaaccctttatgcacattcacagtgctgtaatgaacatgtgtatatatactttcactttttttttttttttttgagatgaagtttctctcttgttgcccaggctagagtgcaatggtgccatctcggctcactgtaacctctgcctcctgggttcaagcaattctcctgcctcagcctccagagtagctgggattacaagcacgtgccaccacgcctggctaatttttgtatttttagtagagatggggtttcaccatgttggccaggctggtcttgaactcctgacctcaggtgatccacccgcctcagcctcccaaactgctgggattacaggcgtgagccaccacacctggctcatactttcactttaaaattgttcatcctcagtctctgctctaatcaacccccaagtcccttcaatcctatctctgaagagttgtgaacccattccctcatctccacagccccacttccaccccagttcagagctgcattatcttgatcctgtacaaggcctgtgacagccccctgaagagtatggggctgcccctagtctttcttcttttcaatctctttctacactgcttccaattactgtcattctgaaatgtgtatttgttcctacgattggaaatgctcaatgattttccactgtccataaaataaagtccactgttatttatgtaggcctcaaatattatttccttaatctacctctggagcatcctgttcagttgctcctatacacctttaactcaatttgtcctttactgttcccagtcccctgatatggacaggcattccatgcttccataccttattcttgctggtcttttgttgtgaggtaatcctcaatcctcccctaaccacatggaaagcattatgttcttcaaatttatcagggagcatttcctaggtagagccactggctctctctctctctatatatgaatacatattcatatatattatatattaaatatataatataattatttaatatatattttatatatttattttataataaacatatatatttatatgagaaatatatttattatataataagcatatatatgagaaatacattatataataaatattatatttatttatatgagaattatatttatatattatatatttatataataaatatatattatatatataataaatatatattatatatataataaatatatattatatatataatatatatatattatatatataataaatatatattatatatataataaatatatattatatatataataaatatatattatatatataataaatatataatattatatatatttatataatatatgtatataatatataatacatatataataaatatgtatataatatataataaatatataataaatatgtatataatatataataaatatatatttatacaatttataagaaatatatatttatataagaaatatatataattttataaaatatataatatataatatattatatattatatattttgtatatattatatataatatatatttatataaatatatatatttaaagaggtttcagtccaggctctgtggctcatgcctataatcccagcactttgggaggccaaggtgggcagattgcttgagcctaggagttccagatcagcctgggcaacacggcaaaacgccgcctctacaaaaaatacaaaaaataaaataaaaaattatgcacacgtggtggtgcatgcctgtagtcccagctactcaggaggctgaggtgggaggattgctggagactgggaggcggaggttgcaatgagacaagatcgtaccacttcactccagcctgggcaacagagtgaggccctatttctaaaaattaattaattaattaaaataaaaaatataaaggcttcaatcatggcatttagctagtacttaactatttataattccttctcccttactttgtaaatttcttgaaccagtagtcacattttacctccagagcgtatgcatgccatatataaggtgcatggaaaatactgttgaccaagcagataataataataataatattatagcaataatgataagtaacatttgttgaatacattctgagtaccaagtactatgttaagcactgaattagaatttactgataaagaatacccccaaaacttggagaatttaagtacattgaccaaaattagacaactactaagaggaaagctgggtttttaacatatatgctagctcatcacctttttgctaggctaaatgaacatgagccccatttaattatttcaattaaagttataacaaagcatccaaatcagatattcagacaagagagacacaattaaattatttcccctcataattaggacatagcccttgttttcactattcttaaaacaagtctaacttcaatcaattcctggtcaaaaagccacggtgtcagatctgatctttttatatattaataggtatggctctactcattaaataaaagcataaaaggccaaaacaaattcatttgtaagaaagagaactgacttttactgctctaaaagatcataagtttaactaataaatagtaatactccatgcatttatgcaaatctttcagttcaatgtttttaccggaagattctttttcaatgaggatttttgtaaaagtaaactccttcagcttaaaagatttaggaaatccgacagtcattagatgtattagatgctttatcagttttttattaaagctattaaacacaatgtatcatcagcatttttcgatcacatttcttaaaaagcttaatgaacacatatttctggcaattattaaagtgtggccacaatctttattctattaaaggaaaaaaagaactacagcatgaagctgctgcctgctggtggttgatgaggaagtagggcttctctggcaatggctgggtctcttgtcttccctatacactgacacaacacatgttttacttcagtatctcctgaggacttacatatttctctcatgtagatcccttttgccttctttatatggttcttgctcccatctattagatctctctatatttctttttaaaaaactatatatactacttgcttttatcacacacacacagatttaaaaggcagatctaagtaagtagccagcatccttattgtcaccatgaaatagttgcttagtttctttcattcgataagctcaaagcattaagtgattagcccagataacaaaaaaataattgtcccaattaaatatcattattgtttttcccccttattaattcttagaaactgcttgtgctttagaacaacaaacatataagattaaatttcttctcattgtgttttgacagactagcattatttggatagtttactttttaattttctacgtgccaattgactaaattctatttagaatgcacttactgtttttaatgaagccatgaatcttcagggtaaaaaaatacaaaaaggaatgaagacttagaccaatttacttatttatttattttctggactaaaaccacttctgtgctgttctatgcttgtcactgcatcatgtgtctccccctacaggtaaagagcaggcagctgtactagtttcaccgctcctgtagaagaatttgtattttccaaagtcaaaatccagaagtcttttgctttagggtgctggtctctatgcctctggggtataagcagtagatataatcaaaatagctataactacagagatatgtccagtgagaggttgggatgagaaattttcaagctcatatacaaataatacaatgccacatctattactcaggagttagtattaatacttcatttactttctctaaagcatatacttccacggtgggtataaaggccacccgaatctaatggtttattttactttataaaggtgtaagaaggaccatggactcgaaaaaggaaccacatgtttattcctggcattgtcactaagcagcaccctctctcactaggtctcagttttttcatctttaaaataaagatatttaaatacgttttctttagagttgtgtccttgcatgaaaatcctctaattgaggatgattaaataaacatattggaaatatggaaattcagaagcattgaaaatggtattgtgaagatgtaacatttaatgagatggctgcagaatgcttgccttgagctaaggttgttcgaaaatgaaatgcttacaaggaaggactgtgctccaagctacatggctgtacttcaaaaatgggatcactgtcccagtgcaggtatggcttgggcatctctgactctttgccaccctctcatgttccaatgcactctttacttctggtgtgcaccacacattaaggacgtatgtaggtgagccttactctaaatgataaaaggattactaaaaatgtcatgccatgactgtgtgaaaacaaaatcataaatgaaatgtaccaaagaagctgacataccaatattctctgttacctctattctaccagtttttaaattagctttaggaacaaaaaaatgtcaggcattgggacagggttataggaagaaacacttggtgagttcctcatcacattcggaactctatccatttttctttcttttttttttttttttttttttttttttgagacggtgtctcactctgtcacccaggccgaagagcagtggcctgatctcggctcactgcaacctccgccctcagagttcaagcgatttcctgtctcagcctcccgagtagctgggattacaggcacctgccaccacgcctggctaatttttgtattttaatagagacggggtttcaccatcttggccaggctggtcttgaactcctgacctggtgatccacccgccttggcctcccaaagtgctgggattacaggcatgagccaccatgcccggcctccatttttttttttttttttttttttttactttaggagacagggtctcattacattgcccaggctggtcttgaattcctgagctcaagcagtcctcccaccttggtctcctgagtagccgggattataggggtgtgccaccatgcccaacttgaactctatccttttatataacttatctccttgaattcttgcaacagtcctaagtgttaggtactcaaatctccaaaatgaggaaatgaagcaaaaaggagagactgggttcacattcaggctccaaatgccacacatcatctttgtcatatcacactaaagagcaaaagagctatttaagtctcttttataaatgcaaacttcaaagccttacttttaaggaattgttagatcattttagacctgtatgtttacctactatatattgaaataaaaactggccagtgacctacctttaaaacctagctttaaaaccctaatgctataaaatcaaactctcggccaggtgtggtggctcatgcctgtaatcccagcattttgggaggccaaggtgggtggatcacctgaggtcaggagttcaagaccatcctggctaacacagtgaaaccctgtctctactaaaaacacaaaaagttagccgggcgtggtggtgggcatctgtaatcccagctacttgggaggctgaggcaggagaattgcttgaacccaggaggcggaggttgcagtgagcctcagatcgcgccactgcactccagcctgggcgataagagcaaaactctatctcaagaaaaaaaaaaaaaaatcaaattctcctggctttaatacatgtcaaatgcaataaccttgaaaagaggaagagggtattgtaaattctatgtgacaactccttagaaagcatggtatgtgatatgtagactgctgaagttcttaactcttcttttttaaaaattagagttggtttacagaaaagtgatagagaattaatatttctccttcaaacaactatgactcaaaagtgagttcttagacttagaaattcatcctgaacaacagtgtatcatctctatcacaaagctaccagcgtctgtgaattgtgatgagaataaaggagacagtgctgggagcaggaggagaccccattttgatgggcacaaagcaagcgcatccattttggccaatttaaggacccacaagttttcctctcatgatcttgcaagcttgcctttctctcactgttccctttccttcgtttgtgtctttgtcctattctttccattacccccttgttacggaatgagtgcttgtgtgcccctaaaattcatttcaatatcctaacccaatatgtgttggtatttggaggccgggcctgtgggaggtgattaggtcgtgagggtggagcactcaacactcacaaatgagactagtgcctttacaaagggcactgatgcaacctagaagaagactctcaccagaccccaaccatgctggcatcctgatctcagacttccagcctccagaattgtgagaaataaatttgtgttgtctataagccacccagtctatggtactttgttatggcagcctgaattgatgaagaaacccctagttctatgtatacagtgggccctagaaacaaaaccaagtaataacaacaaaatggaatttaaaaagatgtattaagtgctggttctgtgaggcactatgctaagggcatcatgcgtgttcactcattcaagccagcaacaactgcaggaagcagtgtcactattttataggtagggaaactgagcagagaaagggtatgcaacctgcccagggccacaaagctctcatgatagagcatgatttgagtgctgggtaggcagagcaaccacgtggtataattctaggggcaccatgttgtgatgttctgtggagttgccctccggaggcacttggagctgtgtgctctagcagccttttggatcagccatgaacttaactgttaggctacactgttactctagaccttattcctatgttgagggatagacaggcatacatttgcgaacctgtacctggggcctctagtgagagaagccacatggaagctggtcctcatgctgctccaggcactaggtctgacccctatcaacagggacccattcatcttaagggtgcctcactgactctttttaatacttctttgcccttcccaggactactgccacagtacagccaggttccaacttcagggggagtgagcctagagggtggggcctgagtggtcagctgcagagggaggaaaggcacaagcactgccttttctgagtgtctcaaatcttactaatgtcaaaatctcaaccatcattattattactagcactgaggttttaagggcccactttttcaaaatgggctcagaaaggggaaccttcccctgctactgccctcatccctccatccctatgccatgttcccaccttggtttgctatgcttgggcaagaaaaacgacttcccagttttagtcagttcatttcctgttgtgctttgtgaggagcccagcagcactaagtggtaacaacagttaattagtttccctttctagataaggtatttctgtgtcccccttgtccctaggcctcaggtcaggagcttgtgggtacgaatgaggccatattcaccttaatttcttaatttctgtggctcataattccctctggtattgctccaggacccccttactatgtatacatttctaggagcttctatgaggtctgtcacatatgcttaagatcaagtgtgtgccctttgagtgtagctactctctcctgttaatctgtgcctggcatctgctgggatggctgggcagctgccctgaccactgagcacccaaccatctgttgtcagccacaacaatttccactggtacctgatgctgctcttctgggagaatgctgctccacctgtgaggccagctcatatgtgacctcaagctaaaaaagcttccagggaccaaaatagcactgcattctgcccaaatagcaatgtcagttcttgcttattgcaaaattgggggttgagggtagttcctcttgataggggtcagatttagtgcctggagcagcgtgaagaccagcttccatgtggcttctctcactagaggcctcaggtacaggttcataaatgtaggcctgtccattcctcaacttaggaaagtgcatagaaacagagggatccggttccacacctccaactcagtttagactcatttatgttgaatttgaattttggcagaagaaatcagttactcaaagtatttattttagcatataggaattgttattgttcatctctctttctctttattttttggagacagtcttactctgttgcccaggctggagtgcagtggcgcgatctcggctcactgcaacctctgcctcctgggttcaagcgattctcctgcctcagattcccgagtagcttggattacaggtgctcgccaccatgctaagttttgtatttttagtagagatggggtttcgccatgttggccaggctggtcttgaactcctggcctcaagtgatccacccaccttggcctcccaaagtgctgagattacaagcgtgagccaccactcctggccctattgttcatctcttgatcaatatcaagaacaaaactggttaaccatatatgtactataaaatgataattggaagtcatcaccaataatatgttgaaagagaaacatgaagaagagatcaataatttaacattcattgaaatacaagtttcacttgatgacattcagaaaagatgacattaacaatgattccagaatcaactctaatgtggtgaccacaaacacagacagacgtctggacatgataaagttaaatttcaagcaaagtgtactcactaataacttaataagagctcctcagcacattatgggttggagctcaaggaagacacttgaatccaatgacgaattgttttagtttggagaatatgctaattttcttctggtaataattttagaaaacataggttttcttttccaggcaattattttaatgaatcaattggggtttcaagaaatagtcaaaagagttcaatttggtttcaggttcagcaaaatgagatcatgcattctgtttttggttcagctggggtcaagtcctgtgcctaaaacagactaataggaattgagataattttatttttatgcacttggctcctctcatctttcctcctatttttctttcccaaacatctatagatcccaacgttttgatctcattgaactttttctgcattgtatattaacttctctcccctcccaaactgagtttattctcagctctctcagtcctttattggactactggtacaatgttgcttcctacacacaagtgggatattgatgaaccaacacgttactccttttatttatgccttcactcttattaaactaaatgatgacatattatatcatgctaataacacatgtgtggaaccagaatgggaagtgacttgaaagtaacatcatctctcaaaatacaaatgcccagagcaatgctcaaatgagtataagcacatagttaaatggttaaaaataatgtacatcagtaaaaaacgtaaatcggtaaaaatgttccaaataacagcttagacaatttgtgagatcaatgatagaaatgataatgtagagaagaaagaatttctttaacattttcaaattgcagcatgaaattggtgttggtgttatattgactcttggcagaaatggtttcttcctagacacatgaagaataagctccagatctttcttacctgttatggtggctttgttgatggatggttggttgcacatgggtgatcttctgacaaagacagaaaaacacaaagcagtaaatatgtggggcttattgatttgatcactctctgagtcatttcagatatagcattttactttaaagaattatttttaagtttggacacgcaaatgatttctttcagactagccagacaagtccctaggcgttctttgtattatggctcagatcacacatgtccaaaaagaaaactggtaaatctcacagtgattgatttggggtaaataaagctgatgtaagtgtcactgggacatgagagaagaggaaattcttacagactttattcgctgaagccagagcttatagactctgaatttgaaaaagcagtcaatttataattgtcttccctaatacagggttaagaaatttttattgttggcctaaattctcgtgattgcctgtacattatcagaagtgaatgatttgttgtaaactatcttataattagagaagctatttgaactttttcctttcttttcttatattgaaaaacacctctgatatatttgttagagaggtatattaatgacttgtccaaatagatactatagaagctttagaaatactctaagccaaaggtacttaaataaattatatcttgtgttctctaagttttcagatgtttgccaagttccacaaaatgactataaaccccttgaagtaaaaaaaaaaagcatgctgtctgattaacttatattccctacagagcctagcacaatgcatccagtattccgtcagtgcttaataaattatgttgaaaagaatatcatttataaagtatccatcaacatttttgaaatataactttataaagttattacttgtaactgacagcttttaaaatataatgattaaaaaacacttttagatacattcaaagatgtctgatatatatatatatatatatatatatattaggtatataataattatatatatattgcctctaccaagggtgaacacttaataaacacttcttgtggatcagacattgctaaataagtactttaaatgaattatctcattgaatccttacaataagccttaaggaagtaagtttcattgttctcattttaccaatgagaaaaacaaaactttgagaatttgaagaacttgttttaagtaacgaagctgagatttgaactaaacgaatgtgatcctagggtctatgctctgctttgctgccttagtttgagatgtttttgtggaacctgcatgcacagcctcacatatgtgccaatggcatcaatctcttcaaatatgccttgctgagatgatgaatttcttagcagggtgggggaaagttggggaaagcagcctgggattttgtaaattctcactggttccactcagcctctggctccctttcattgctcctaaggttattggtatcgatttgggattaaaattttgtgtttgattgaaaatgcaccaaattttacttctgaattattttagttttttttagttataaaataaaatggttgggggaaaaatggggagaatttaaactcgataaaccaaaatattaatattttaagcagctgctctgaaatagctctggtctatataccagtaattatcttcttcttcttaaatttttttttttttaaagttttgagatagggtctcactctgttgctcaggctggagtgcagtggtgtgatcatagctcactacagcctagaactcctgagctctagtgattccccccaccacctcagcctctcaagtagctgggactacaggtgcatgccaccatgcttggctaattaatttttttttttttagagatggggtcttgctgtgtgtaacagggtgttatctgttaccttctggctaagagtttatcattcaaataattgatatcctgattactcctttttagtccttgctctgtgaaaatttagaaaccattgattttgtctgggaatggtattaaataaatattttcacactcttctacagttttggaaaaccaaatggttgactcaattctaattatctccttttactatcaatcctacaattaactggtactcaggaacttgatatctgaacaagtaatggcaagcagaaaatattaatactttgatccatggttgcctcgatacctcctctaatgacagatgagccagaactcacttctggaataaaaaatctcaagggcaaaacaaaaacaaaaaacccaaggtgacaagaagcagtaatgtgttaacaagtcagcaatgtgcatctgaatacccacccaggggctgggtttggaatgcattcttcctagactccttttctgcagcaaataaaaagggtggcttgtgcaaaggagcacatgccttccataaaatccaaggatgagcttggaaatgttctagtggctctgtgagtgcccagcaggaaaggttctgattctcccagggtcatcatgtgatgaggcagagttacagcactttgttctcactgaacagaatcgagtttagccgtgaatagattgaatcctactattctgatacccaaagaagccgatttggtttgaatcagtaatggaggcacaaatttgcattgaccaaaaggaagaccacagtggcctttacttagagtctgccagataatactgtttggttagatgtcaccctgggcattgacaaggcagagaggaagttcaggctcaagctatgattttctgttttcttctagctcctcctttccatttcaatctgttccatccctgtatgtcagctgaaaacttctgtcttgcatagaaacaggcctcagatcgtctctggagcctgactgatcaactatttacctgccacagatttaaatgctggtacccaggtgaccacatgtaaaggaagcataaagggagtttcttgttcactttttaaagacaaaaatctcagtttcctgggtaaaattcgagactaaaaagtttgggagtgacaaccagttaacttcatttcttctgcagagctgagactttctaagggggaggtgattgaccttacaagctaccaaatccccaaagcccaagggggccgctgaggtcagtatgacattgcacggccacgttacatagaaaacgtgattggtaatgaacaggtacctcaaagcatgccctcagattttacatgctgagttactactttgccctttcagcgaacaggcctttgcagactgatagactctgcattatgctaggcacagggaatacaaatgtgaaccgactacattcctactcactgggaactgacagtgttcaggagcatcccaacagacaaacaggcaacaggagcacagagagctacgtgctaacataggaatcaagtacaaggtacaatcagacagagatggaaaggcacatcactttgattagggcttgtgggtgtgtgtctatgttgggtatcatcagggacaatgctccaagagaaattttatttaagctgcaaccaaaagaatgaatgacaattatcccagtagatgaggagaggaagaagaagatgagaagtattcaggctgagagaataggactgcaaaaattcattacctggaaaaacagaacctaatgggttccattccaatagcttgcattgttacatttatattgatttttaaaaacttttttctatcacaagaagtacttgaataacggccagagctatttttgataatgaaaaacgtgaatctgggaggtcaattttattactatgaaatgtaaagttcagatttctcattgtttttaagaagtagtaactactatgaaatgttatgcacttaggtaagttatagttcctaatacacttatatttactatcctcttaatatgatttaaatgttttttttccttctggaaaattatttgaagttggcattttaatattttatttcatattaatagcagattttttttaaaaaaatggacattgaaataacagcaaaccagttttccatttaatattgaaaaattacttttatctttttagatttttttgcctttatcaagaacctgaaatgataatcctttcccatctttcaaatgctttccctgttgtcatataaaccacaattctattaattgctccatgaatgctgctgatctgaaagtcagtaacagcaggagaatcaaagatctttgctatgatatggcgcttctccaaatcatcgttgtcttgagaggatgactttcagctgatcttaaggtgtgatgagattattcacccacggttaatttatgaagtaagccgaaactataaagttaccctgagtgtaaataactgggcggaggactgatcatgccaggtgatttctgacagatggaatcaccatatttatttgtcatactgcttcatttctgatattagaaccatcaccacgaagtatttatagaaaattaacaggacatcatatgacttagtatacacagacaacatggcaacaacacagagaagtctaacatattgccttgggctcaatcaagttgagaaaacttatttaaaagttcagcaaaaaagaggggggaaaaaaggatatcttacttgctaggtgctcgatcttgcaaattagttaatgcagcaaagttgtttcgtacagttcgcagactggccaagacctacaacaagaaaggattcttgaaacttcttgagctaaggccattttaaatacacttgaaaatggtttgttaagagaaaacttgatattgcttgcaacttagtttcatataccactaaagaatctcccaacacttagtgcagtttgtaggtatccacacgaaatccagagaggccagactgcagaaattttccagaaatccctccacattgtctatgcacatggtgacagtagcagcagtttccacagtatttctgggttccttagtcaccaagacaatattccaggcaatacacagataacatgattgcatttttgcacatttcaaatagtataatataaaatgctaataaagctcactttagggataaaaaattccctactcccaaatctcttcaaaaattgatgaagaatctcataataataagttggcaagtgaagtgaattttaaactgtttttctacctttgccacatggctactctagctagtaagcagacattgttttcttttgttaaggttatctgaattgtgcattgtaagaagctctcagggatgcgtttcttatgtaaaatgctacgccctgtacatgcacaatgcttggcacacagaagatactcaataaaaatttgttgactaaatgaatacatagacacaacatgcccacacacataacaaggcaggaccaataggtgtcactatctctaacagtcgctttttctaattccagttggaactagaaagtagccaacggactggaagtgagcctaggagaaggttcctagagccttatctccttcttccctcctctctttctcctgaaatgggcaagtttccccagggtcaaacccatattagatgggattataggtgatttgggtgacagctagagtgctaagtttatgtaaaacacagattccaaatgtctgagtaggtattacctaacaacccagactgtctggctctgttatgtagtaaatgtgtgaacttggactagatatgcaacctctttgtacctcagcttcctaacctggaaaactgggatagtgatacctacctcgtagaattgttgtgaggagtatatggaatgacaggtttggtgccaagaacagtgcctggcaaatagaaagcattcagccaatattagcccatgatggcagcgttacctttgacttaatgacttggcatgcacttgggaaatttacttaatgcctagcattggtaattcaagagtctccaaagttttaattgcttcaaagtttccagagttgttttcagaaatgtttcatctggcacagacctagactaaaatcagtctaattttttttctaagacaaaaatgtcccagactctgttttgttgttgctgtttatgaaattgacattcatttgtgtaagtcaatggagagctgtgtacgccttgggacagtgacttagagaattttcccctaaaggagttaatgctgcttcctaagaagccaaccgtgattaactcagtcactggaaaaacctggctcattatctcatataaacaacccacggctctgaaaggtcacgctgcctatgatggagtattcaaatggccgactgctgacatcagaccacgatgtctttcattaggcatgaaatcttgaatgatgcagaagtaaatcggataaatgatccactgtcgttaaatcatgcaggcttaatttatgttttaagaagtgaatatcaaacatactaatggaaactttaagataaaatcattgcaccagctaattgatccccttcctaggcaaaatttttaaccctagaattctgagatttttattccaatacataatagttaagttcattgcagttgacagctgggtaaatagacatagaaatgcaggcaacttattttctatgatcatttgaagggaaacatcagtcatgaaaagaaaaattagttcatcaaagaaaaaatttctgtagaggagtttttgcctctattataataaacttctaatttaataagtaatctaatttaatattattttgtctttgtttttagtttaaaatttatgtatttttgtataatttatatcttcacatgcttcagaatttaaacaaaagagtataaagcaaaaagtctccccttcaatgattaagataaaaatcaaaattattattacttctgaaaagacgcaatagaaacagattaacctggggagggacactcaggggacattaaaatactgataactgttctatttcttaaactgttcattttagtattattctttatattttacataattacaagctatattcccttatatatatgaaatacttcaaaataaaaagtgaaaaaaggaatctgtcttccggtctctccttcagacaatcagctgcctggccactagcaatcaacttttaggttttctatcttaaagttgtttttgtacaaacactgttgcaataaataatcttgtagagaaattatttcctaggcatgccagtattagattatttattgtgtgtgtgtgggtttttttttcttttgcagcaggacaaactattttataaattttatgtttggtgttaactattatcttctacagtatgacatgtatgctattggcagaagtgtaaataacatttctagacaaatcttataagggggtgttgtcttgggcctcgctgactgactcttggtgtcgtcatcactgttatcactgtgttagtcttttaagctttcactttgcattgcagggcacaaagagggagcatctgttactgcaggctgtggggagaactataaacagttttactgaagcccctaagttaaagttccattgttctttgcttttgttcagggcagccctcacttcccctgaattcgactctttaagaactgtagtcaaagctttaaggctccttttacagttgtccttactccttaatgcttgctaaccaaaaagatccctgacgtttcttccacagagctcaatggttagaaaattaaggtcatttctttctcttctgccccaccaagcagaagtatagccagtcaatgtcaaaattacattgggaatgatgagaaatatatattccttaggaaggaaatactggtagttttacagaaaaattttagacaaagatggttcatgtattagcccatggggaaggattcaatgttatttacgtacactactctcggatcttcttaggtgcttctaaacatttattaaacaataagaatcactgaaaatagcaggaaaatacggttatcatttaacacttaaacagctgaacatcatagcctaaaaaaaaagaggaaaataaatggtttcgaggattgtttttcataaccatatacacttgttaccactagatggcggtaaaacacagaccatgaggttgaggtgccactggcggcggaggaagcggcgacccgcactgggagagattcattacttcggttttacctccggaaaaagctggagtcaagttatgcttatttacaaaatagaaaggtcatttttatgaaaagaaaacctctttccaggttatgttttgtttaaaccctatgaaattgctggtttgtacaccagaaaaggttgatagacaattttatatggttcgctcttaaaaagaacttagatgtccagaagatagtagttgtaatttaaattaattaaggctaaagaaaagctaaaaatttagcaccgactgaaacgaggtgactatcttctttcatagcctggcagggagggcctagcacagtctgcaagcttgaggatggtgatgaggccacaagatcgttgctgctgggtgaagtggctgagggacaggcaggaatatgagaatattggttatattttattaccaactaaatggtaatattctatagtattaataactactgcatttttatcctagaagtatcccaggtgctgtattttggttagagtaaaggtaaagagatgtagttgttcctaccccgtttttttttttgttttttttgtttttttttttttgagacggagttttgctcttgttgcccaggatggagtgcaatggcgcgatctcggctcactgcaacctctgcctcctgggttcaagttattctcccgcctctgtattttcaaatcagggatatctccttagtctgaatgaagtgagggtttctccagggatccagcataatgcttgggttttcctgttttctctttctttcatcagagtctacttcatttaacattacacacttccacatgaaaattctagtcaacttagagttttactacagggtagttgtgtcacaaatcctgggatcactgagcccggaggcagctgacagcagagaagagtttcctacagtttatcagcattgtgcctccttagtgctccttggcccccaagaactctggccaagaaaaaaaggtcagttgccgcgtgcactccagtgggattcctctctagccttcgtgctaaggaaacacccacaccaaaagatttcaacacaaacacaagagaatactttaacaattgaaataagaaaaatatttaaagctgtcactttttctgaggaccaaagggattctgagcttacaggggaaagcataagaaatcagaggtggaaaagagtttaggttaaacaccagcaagaatttctagccctgacagtgttttagacaatgggataaactatggagagatactataggatcctttctgaaaattactatccaagatgtttcaggctttagcctggccaaaaaagtgcaatctatctttgcacggcttcctaaattctcctctaatttaggattttgctcttttcacgtcaaaggaaaccatgatttggaaaccatgattcgtgttttggagatggactcaggcataaagaaatgagttctcaagaagaggcagaagatgagatggatttgggaggggatctttgaacaccttagacaggggaaggccatttttaggagccatgggacagaaaatatgcacagaaaaataaatctgaagggatataaaataaaatgtcagtagcagttattttggggtttggaattttagaaaattttccttttctttttcttattatttttctaaacttttatgcaaaaagtttttgttttgttttgtctttttgagaagcatagctttttcactggaatttagtgtgaaattccaattttcaaagcatgctgagaaaagagggtaattctttggcctacttggctaaatatttttctgagtgacttttctaaaatccattgttttctgtcctttggtgaaagcaattatggtatatcaggacaaattagattggtatcacttcaagtgacataagtatcttatatttttagttttaaatagttaatgctaaaatagcacttaccattaagtggtaagtgctttactttgtattaaagaaaatttgagaagttagtgattgggtcagcaaaacatgccaatcatgtccaacagggtttaagagaaggccactcaaacatactcactgggacttctctcttaacccctccccacagatgctctatgaagagtggtgaaactcttcagggcttaacagttttttgttttgttttgtttttaattctagtggggctttccaggtcttatactccagtaaaaggccatttgtgaaaaccatgatgaagccccttaaaaaaaatcggcagcctctcaagtaatgaccactctctacaaggtgttatgagtcacttagctaatcataagcaaagacttaatatactatgggattatttttaggcatcagatatgcctataaattatacagctgatttatattccaagttctaatttcaagtatattaagtacacatcttttttatttaaatagcttactaacatggactaaattacatatatgtgtgtatttcccaatatcttgaaattccattagttttttttccttggagattataggtacactacagaaaatatctaatcaggtaaaagactagatttccttggaatttaagagcactgatggcagggttcaagtccaatttactaatctatttgttgcagcttaataaatattacttgatgtaaaagaccatatatcatacacagaccttttttcatttgttattaaatatttatatatattttttcttataataatacctagatcatttggttagaaacaagaatagctacttgaatgaactcaaattggaatgattggttctatgtttgatgatgttacttacattgttatgccatattttgtctgttcacctctctctgaggtcttagatatagaattataagttttctttctttcctttttttttcttgacagagtcttgctctgtcacccaggctggagtgcagtggcatgatcttggctcactgcaacctccacctcccgggttcaagcaattatcctgcctcagcctcccaagtagctgggattacaggcacccgtcaccatgcctggctaatttttttgtatttttagtagagacagggtttcatcaagttggccaggctggtctcgaactcctgacctcaggtgatccacccacctcagcttcccaaagtgctgggattacaggtacgagccaccgcacccggccataagttttcaatagtaatcaattaaaaaccctcagctttataagattttgctatcacatcatattattaaatcatacaagtgtaaattttttggacacagaaatacaggtactagaaagaattcataatctccagcaaaaccttcagcaaacaagatattaaccatctgaaaaggatggtgattgtattttatttttaattgcctgcattaatttaaaaagttactattatacattatgttacttatgaattgattatattataggtctaagttacagtaataaaagtttggaaagttttaaaaagtagaactatacataatcctactatctaaaccctattatccatttaaaaaataatacttatgacattttagaaatgaaagaacattttcagctctatacatttaaaccaatcacaaagtttttataatattatattttcaagcaattgtgcctagcattttataagcgtggtattatttcagtgtcttagcaatcttatgaggtgggtactcttggaactgttatttaacagaggaagagaccaggcttggaaaagttcagtgactcgctcaagtccattgagttggcaagaggcggtgaaagggttttaactagatctgactgtctttcatccagctcagtcccctaactctaccagttgaaaaaaaagaggacccagaaaatttaagtgagttgtccaaggtgcaagagcaccttgatgtatgatataggcctgattataatttttacaacctctcaggattacttgcattttaatatttaacatttcttactcatcagtgttggttttaaacctgcttcatgccccaggttaaatcagttttatctcattccgcccttagttgtctataccagagactctcaacttctcctgcacactagaaaaatactaaggcctttaacaaatacagatgcttgtaacagatctccaaatttttggatttaattgaccagggctgcagcctgggcactgggataagaggtctctaggttaatctaacgtgcaggtagggttgagaagtattggtctatacatagaacatctggtcatcaactctttcatatttatattcccaaacattttagatcatgttatcacctgcttgcacatatgtcatgtggttaaagtattttcatgatttgtatgcctagaaggaagaagtaaacatcaacacatcactcagctaaatctctgcacaaatggcatatgtaaaaaagagataaataaggtattgggttgaattggaatattgaatttcaagcactgatcatgtacctaattatactaaacataacttaagccatgatatagccttctgcttctagtgcttatgtcagtatgagcccaattaagtatatcccttagctaatttattatttgaagcaaagacactctttggtactatgggtttataggaaacagattaatatagccaaagtcactttctctagcattgcttttgaattgcttgaatgaaccaagaatttgtatttgtacttgtgcttgatttaaaattaaattaaattaataacccgaactaattccccaaattaaatttttacatctgtgagaaacctgcccattcaccaagctgtgcttacctgagcaaatggagtcacaatcaagtcatctccgtgtctgaaaaataaaccaaatcccgcattagaaatcatcaataactctgtgctcagtgtcgttcaatattaaacggcaagttccactttcatgagttcccatagagaattacagtgattccatccttatacttcagcacatgttcttcccagcaactgggttaaaaatatgtcttctgggatgttaacaattgtccaactccctgggtaaaaagaggggcttcttgatcatcagccagggtcactgttgctttttaggcacacaggatatgcaatagtagaaatggtgttccagcagtggggcctgagttttacttttggcctcttactgtagatattagtaaggggtgctgtggaaggaaccagcaatgcagtgacttcagtgagagaacccttgaccatctaatatttgaaggtgattagcatggagtgttccacatcatcccgtgtaagtcttggacaggctaggaactgtagatgacatgggactgcatcatacactaataaaaacccagtgaaatgttcaactgactcatcccagccactgtagtcactgggaaatgttactccttgtgtgctgttgctgcagcaaccccagctacaccgtgcctggggtatgggagcaaggtgtcagcatgacgtgtcttggagggacagggaagggcaaggaaagttgtgcaacattccagttagaggaaagtgagaaactggggcccagggttcttttgtggtatttcttagcatgaataatttgagacaaggatttccagagtcaccatcagctatttcttgatctagctagataaaattcttaaatcaaaagtgaatgctgttattcaacacagacagctccctggacatggccctgagaacagtgcaaataaacttttcgctcactcatgaacaatctgaaaacaacctgagtgacccaaaacaacacccatgaaacatgctggggcacagggagcatatggatgatgttactcaataaattgttaccaatagctagaataggtgctgtggtcgtcatcaaaccatgtggagatcttgaaaataaaaatgtgggaaataaaagcagaagaaggaaaaaacaatgtaaaggaagcatgtgttattttacacccccttagttccagaatcatgtttttcaaggggcacctgctctttgtagagattattcatagaactctagaactctaagaaggtaggacattgggttttatgatcattttatagaagaggcaactgaggttcagagagggcataaggtctaaaaactaataagtggtagaggcaggatgtcaattgaaaaaggtattttcccatgttgatgtttaattgccattgcaacagtattaagaggtgggggcctgtgagaagtaattaggtcaggagggcttcacactcatgaatgaattaatgctgttatggtgggagggggttagttatcataagagtgggttgttataaagtgagcccagcccctcatgttttctcttttgcatgtgctcacttgcccttccatttttccattgtttgggatgatgcatcccaaatatcctaatcagatgctgatgccatgtccttgaactacccagcctctagaactgtaagatataaacttcttttctatataaattaccctgtctatgctattctgttatagcaacagaaactggactaagatagtgttcttctgtcatcaataaataatttacataatttaccttgactctcaaaaaaaaaaggtcttctgaggtcaagcccagaaaggctctttcctagaacaatggcccagggtaggagcaggcctggtgcactgaagtggcaaggaggccattgagcccgtgggagccagcagagagggatgaagccaaggaggcagagcagctgcctagatgagaaagaagcagatacagagctgcaacgagaagctcggtgattctagagaatgccatggaaggcaggaaattcagaatcatgggtggtaacgagccaggcagcagatcacagagcccttgtatgaaatgtacaagaacttggattttactctctgatggaagtttgggttggaatttcagctctgccacatactaggtgtgtgaaattgtgcaagttattaaacttcactttcccttggcctcttcatctgtaaaatggagataacagcacatacatagagtgatgttttgggattcaataaattaataatgttaagtgctgaaaaatgtgcttaccacacagtaaatgttcaataaacatttctataataataattagcagcagtagtaaaaccttttaaatcataatgatttttgctttcctatgcagtcaggaaattgcaaagactcagaaaactgatacttcgctaagaaggactcttgagaccctgtgacaggtctataaaagattgagggctttaaaggggcaaaaatggaagcagggagaccagtgtagagaaaagaagagatgaggacctaaactaaatcagtggtagttgagagagagagagagagggacgatgacagcattaaaagctctgggggaaagaaaaagttctggggaaaaaaagatatgaaaatttcaagcatttacaaaagtaaaaagaatgttatcacagcaagtgtattttatatacaatcatcagctgttacaacaatgttgcaaggtaggtgacattactcccatttttcagatgagaaaattgtagctcaaattgattaagagatttaacacaaagacacgcaggtagtaagctgcacagccatacctggaatggtccccttttgtgatatgcattggctgattcctatggaacagcttaaaaagattaaaaataaagctctaggaaaatggcccaataaatgcaaattacaaagtgatgccagggttggccagctacatttcttccttggcccatcattctgactttcccttctggctgtgtcatataggtaaatatagggctgcaatttctcttatgtacttattttgaaacagtagcctaactctcacaaaacaactgagaaatatttacagatacaccagtgtttaaaaagcatgaagacaaaatccagagctaaacacttcagcatttgacaaatttctacacacataaaggcacctttagagttcatttgaagccaaacattcttgggagtggtggacaaatcagtaaactgtgtagtgtgttagaagtccgaagacaaaaaacattttcaataggtgtatatactacatatattgcattcaagatagttcaatggtttctgacattaaaaaatgttattaaaaattccataatgggaggtatattacacaaggagaaaagacatgccacctatgccgacttgatttgccagtctgataaactattcatctgcttcagtgcatggccaagctgaagacattgtattgtaaaatggatgagaggcagttcagataaccaaaattaaaataatatgacatcttcttattgtcccaagctatagtctcttctttcattttattctttataattgacctactataaagtttatttttttcaggactaagtcatcttgacaaggcacatcatcaatctgaaatgaatccatggaaatatgtctcctaattttttatatagattgcagtggatttgaatctttcaaaactcaaaagggttgcatatttattaaaacatttaattttctctttggttgtatctcctttataagtattataagtaatacactttacaatatttatgataatttaccagccttttttccctatgaaagcataaagacagttatcattttagtgaaggaaatatattactttttaataaattgcccagaaattgtttctgccaaatatctcaagatggtctcattttagtaacagtaaaatgatacctagcatttcagtggcagatgtcctcgataaacggcaggttatagcctatccatttattttcaaaagtatgtcatgcttaaattatctttgaatatatacctaacatataattttaaaatctttgtctaagtcctcaactcaatattaaaacagatcttttcagacatactgtcactaggagaataaggcaagtaaaacctatttttatttgtggttagaagaaaataaatataatacaaacatatctttgaattgtgtcttacactttgcttataatcatttaaaaacagatctggtagttaagatcaacagaagattcactttgtgaatatgatttggtttaaagtatgtgtgggttttaatgaactgaataatcacatatgctcaaaaaaatcctatgaaataaaataattctgaaatcttgcacctgaacaactttacccacagaagctttttaaagcgccttgccacgtaaagtggggctgggagggattacaatacaatgtaataaattggggcttcctaggcctacttggctaaatatttttctgagtctcttctgagatgggaagagactattagggtctctataaagtgactgaaaagctagattcaaagtcacacagtgaatatcgcctggacattttgaaattgtaccgcctggtaatgtgaattttgggtgaggatgatgcaatactgtctttcatttaaataaaaacaattataacaacaacaacccttaacaaaaaacagctgtgatctgttttaaggaaaatacagctcttttaaaaaaaagaactggagtgttcatggaggacaggcggagaatgaatgagggataggaaggctcagaaaaaaagtcattttgacactgcgtgtctatatgtatgtatgtatgcacacatgtatacatgtatgtatgtatgcacatatgtatgtatgtgagagatgagattggtaccaaggtaacagtcacagcagaatgcaagtgcagaaacttctagaacagccaggatgagccactgtaggtcactgtgggagtcagtgtcacattggttttaaatttcatgatgtccaaggaggtgccacatgctctgtcaccttccctggttaccaggaagtgaaccagagtcatcttcactagtcctggcgagccttgtctctcccaaagagaaagacttgctgagtcctgagccagcgctgttgaaagcaggagaatacagggctcaacagtatactattgtctttttttttctcacaagagaaatgacagtagagtcaggaacttctattctctattccccctcccatccttcttctacttctgtattatttatcacgttattttctaccctttttctttctgtaataaggaaacagaaacaagcaagaaactaaaagcaagaaatccaaatgcccacactcttatggtgactttgttgagatccatatatggttcaagtacttaaaaatgaaaaagcctgttgtcatcttaaaaaaataagttcaaccaacatcagcacctgaaaatataatttcctatagaagttcatttcatgattggttgaaatcttaaacacactaggtggcaatctttatctgttttactattacgaaatcataaggaaaaggagatacagttaattagaagaaagtttttactttatggagcaaagacccctaatcctactatatttaaagcattagtggccatgtaagacccactgcttttgaatatcacacattgcaaattttagcatgacaaatgaatgcatgaactagcactgtgaaggagtcacaggctggggcttacgtttgaatctaatcctttttttttttttttcaatggcatggaggtttgctatgttgcccagactggccttgaactcctgggctgaagtgatcttcctgtctcagtctatggggtgcctaggattacaggtgtgcaccaccgcgctggccgaatggaatcttgtgcaaacttttttcatcttctgtgcttcactcactcttactagaaagatattctcctctgaagtttgtcaataggattaggaaattgataaacatatagaaaattaaaataatatttttgaaatatattttaaagtccaagattttgataattttgaaatcttagtatctttctttcctcagcctaaaaactatcatccatctatcaattcacccttgacaacttcttttagaattatagagaaacaagtatgttctaattttaaaatgaatataaaaatatttctgggagcctagactatttgacaacacccaaggattagctataggaggaccacgtctactcacaactctctagacccatcttcatagaagtatggacatataaaacaaacatataatgtaacctacttgatctttatgtgtgtgtatgtgtatatgtatatatacatacatgtacatatatacatacatctatatacacatgtacatatatacatatatgcatgtatatatacacacaggcacatatatacatatatacatacatgtatacatacaggcacatacatacatatatacacatgcatacatgcatgcaacatacatacatgcacatatacatacatgcacacacacgtatgtacacacatgcatgtacacacacgtatgcacacatacatgtatgtagacatacatgtatgcacacacatacatgcatgtagacatacatgtatgtacacgtatatgtatatataagtatacacgtgtatgtatatatgtatacatacacgtgtatgtatagatacacgtgtatgtatacatacatatgtgtatgtacagctacacgtatacatacatatgtgtatgtacagctacaagtatacatacatatgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagatacacgtatacatacacgtgtatgtacagatacacgtatacatacatatgtgtatgtatagatacacgtatacatacatatgtgtatgtatagatacacgtatacatacatatgtgtatgtatatatatacatacacacatatgaagtacatgcatacatatacatactttgggagatatagaacaacttaaagaaccattcaaagataactattgataacattttcccactgcatgtatgtgagcacatgtatgcaatatagtatgtgactattatggactacatacttccttatagaattagagtcatagtgtatattcaactgtatatcttgcttttagcattaaacattaatgaaccataaaaattatacatgcctttattcttttaaaatattgttaatgattccaatctatattcggtaatctctaaaatttttcaagttatgtgaatccaaatgtattaaaatgtaagcattgattctatttttaaataaattaaaaaataatcatatgggtttttcagacgaatttcagttcatttatcattcattcatttttaaaaagctacttattaaaggaaacatgcttattttaattaaatatacataagacaaaggtaaatattaaaatgctacatgagaaactgggctgcacaggtaattcatgggaatgttaagtattttatattgctacctgcttaaattaaaatcatgaaactctaatttcagacaacaaaaattctgtaaaatgtgactaccaagaaaattttgcaaaaccaaattattttttccatatagcgtttaaaagagatgatttgtttttccaaaaataatgttcactctgacaaattataaatttaagaatataatgaatgatttaaaattacttataaaggaggcattagatttttttataaactctaagtaatctatatagtaaataaaacaataccaaaaatacataaaaactgtttccttggtattagacatacttgaggatatggatcctctgtattgcttggccttttaatttgaaactagctccatttaagtcaaaataaattaagcagtacatctatttatgaaaccctagggaataaagttcctaatataataaagccaacttcagttacaagtgaatgtgcttttcctctttgaagctattgccacttagaattaaaataatctatttaacacaaaaacttgtattaaaaatcacaactaccaaaactttcaatttggcaagaatgtccagcaaccttttactgagaatcaaagaaaatgtaaattaatatatgagtaacattaaagctgtctagtattgtgtgaggtaacatcttccaaattgaaacttttcaacgccaaactcaggccacctgtttgtatatctgtgtatgcagcttttctggtgttttgatcatttttttttttttttttttttctgagatggagtctcactctgtcgcccaggctggaatgcagtggctgcaatctcggctcactgcaagctccgcctcccgggttcacgccattctcctgcctcagcctctggagtagctgggactacaggcgcctgccaccatgcccagctaatttttttgtatttttagtagagacaggatttcaccgtgttagccaggatggtctcgatctcctgacgtcgtgatccacctgcctcggcctcccaaagtgctgggattacaggcatgatccacagcgcctcgcccgttttgatcattttaaatattttgaaaaaattttaaagagatgtggggtctcactctgttgcccaggctagagtgcagtggcacaattcacagctgactgcagcctcaagctcctggactcaagtgatcctctcacttcagcctcccaagcagttggaattacaagtgcaaaccactatttttatttcttaaagcaggttagaattttttttttttgagatggggttctcatcttgaattttaactccgacaacttccacatgtcctgagaggagcctggtgggagatgactgaattagggggtctggtctttcctgcgttgttctcatagtagtgaatgagtcttatgagatctaattttttaaaaagaggaggtcccctgctcaagctctctctctttgcctgttgccatccacataagatgtgaattgctcctcctcgccttccaccatgattgtgaggcctccccagccacgtggaactctgagtccagttaaacctcttccttttgtaaattgcccagtctcagatatgtctttatcagcagcatgagaacagactagtacagtgaccttcaaagatatttagttttctgaaatttaaactgtttgctcacatcttattaatattttaagaattaagaaacaactcaatggcaaaaaaacaaataacctgattttaaaatgggcaaaaaacctgaataggtctttctcaaaacaatggcctgacacagtggcttacacctgtaatcccagcaccttaggaggctgaggtagcaggatagcttaagcccaggagtttgaaaccagcttgggcaacatcgtgagacaccttctctacaaaaaaattaaaatcaaaacaagacctacaaaaaaaggtcaacaggtatatgtaaaagtgctcaacatcactaatcttaagtgaaatgcaaattaaaaccatgatgagatatcacctgacacctataatagtttttttttaatcaaaaaaaggtaacaaatgttggtgaagacatggagaaaaggaagcctttttacactgttggtgggaatgtaaactagtacagtcactatggaaaacagtatgaagggtcttcaaaaaattaaggataaaactaccatatgatccagcaattctacttctgggtatatatccaaagaaaatgaaatcagtatgtcaaagagatacctgcactcccatgtttggtgcagcattaatcacaatagccaaaatatggaatcaacttaagtgtctaacaacagatgaataaagaaaatgttatatacacacacacacacacacactagaatcctactcaggcttaaaaaggggatatccttccatttatgacaatatggatgttcctagaatacattatgcttagtgaaataagccaggcaagaaagataaataccatgtgatctcacacatatgtggaatctaaaaacaaaatcaaacttatagaagcagagagtagaacagttgttcccagggactggagcagggcctgggggagaatgggaggatgtggaatgggagatgttggtgaaagggtacaaagtttcagttagaaggagaaacaatttcaagagatctactgtacaggctggtgactataattaataatcatgcatagtatacctgaaaattgctgagagtagattttaaatgtactcatcacaaaaaatgataaattgttaggtgatggacctgttaattgcttgatttaatcattccacaatgtatacatatatcaaaatattaccttgtatataataaatgcatataatttgttatttgttgatgaaaaataaatttaaaacaagaattagagcccggccccatctttgaccaaaaaaaaaaaaaaaatctttcaaccaaaaatccttaatttttggctcatgtgtgctcatatcacttgtggaggacaggcactgatgataaagcagatgggactgaagtttacgcaacataagcaaaaaataatctagtctaaaatggaatctctttatttgtcatgagaaaacaatttaggactcattagagaaaatacatgatgccaatgaatgccttcaaatttgttagttatatgatggcacaaagactatctctgttagaaatgatacaccaaaattttccaagttaaataattaaacaaatgtttagcacatgtgtgtagacatattcactaagcatattaggttattttgtttaataaaaaccaatacaatagagagacttttctaggacggctgatgtcccaaattatcaccagaaggtttgagtacaaagctgagagtctgacttccatggagggaagaaagacagcgaaagagttgagtacatgggcagggattcacaagtgctctcactttgtgttctaggaacgggatcttctttcacagtttatcttattggcaggcttgttcttaatgccagtggccctgcccttttggtttttcaccagaatgggatcctagggaaaagatttttggtcaactagtgcaacaattttaaaggtctgcatgtggtgaaaagattcaatagattaaaaggaagcccttgatcaaacagagaggagagcaatgtgttttatgaatgcctactaggcaccagacacggtgttctaccaacatgctgaatttaatcctgacaactctgcattaaatggatgctcatattcccattctaacataaggaactaggccctgacaacttaagttactcattggcagtcatgcccttgacaagctgacagaactcagtggtttccaaatgccactctaagatctggtacttgcccaacagaatgctcagtggtccttgtcaaagtcagagtgtacatggaccatgcagtgagattttttttttaaactatacgtattcctttggaaaattcttttattctgagattatgctctttctttttcactgaagtgaaaatgtctttaaaaaataaaattaacatatatattgatgggtaattccttgttaatgttctttacctggcaaaataaggagttagtaaccctaggtcagtgtcccagaaattttactgggtcataaaatcccaaggcatggaaatgttcagtgtagctggatttgagcccaggccttcaaatactgttttgtttttaccatgccgctttctgtatgctcaaatggatttagactattctgaaggcacatagaagtaaatgttttagactctagaacagcactgtccaatagaatatttctgcaacattctatttctgcaacagaatattctgcaagactctcggtgctgtctaatatgctatccactagctaaacacacacacacacacacacacacacacacacacacacacacacaccaatccacaaaaacaaaactgatcttggtggttataacaaattcaatttgaagttctgtaagcaccaaagaaaaaatgaattttgaaacatggaaatatgagatctgcatgtagctttgttctcccttgggagtgaaacaatgagttaaaaaattttggacttgggatcattcatgacatttattgggagacaacatcatttactgaactggtgaaatgatttcttgtcacatcacaaccttccacatttgttgaggggtgagcagttattctttttctttctgctctgaagttccctgcgtcttaaagagagggttgcaggaattgacacattatatatgtttagatacaactttccagtattcaatgtcagcaaatttttcttgacccaaggttaggaaaaaccataaagtctcaaggcaattaaccgtaggtggacacaaagcctaggagatgctgcagtaggcagacggaataattggggttgtttcctctgtgaacctggtgtgaatcataccacagattaccaggaatctgaaagcaaagcccagtggttgatattccttacttggttttctaaagaaaaaccatgggtctgcttgatgctttctttctgtttatttatagaagcacatctttagatgattcatattgcaagggcttagacagtatgatttagtaatactccctggaatatcttatctcaagaaacacatcacataaatgttccagcagtgtgactgtttttccttatatggctcagaaaacagtaaaggagacattgagaacaattcattaagaagctaagactgacaagcaaaagtaaatatttaaaatgattgatgtgtaagtgaaaacaagtattcatatgggaatctcagtgttggctggaaacatctccttttgtatcaagaatttttaaaaattaaataaagacaagaatgcatgctccaaacaatttttttgtcttactttcatggatctatggtgtcttcaaatgataccctggcatggagtaggtgctactgttattttccaaacgagtaaaacagtgatactcattcaaaaatgcacatcaattaatacacacctttatttagaatgtggtggaaaacacgtattggtcatctccaatagaagtcaactttcttcttcttcccagcctgccaccatatgccccaccgtcaagacttaaagttcaggctgtgcatagtggctcttgcctgtaatttcagcactttgggaagccaaagcaggagtattgcttgagctcaggaattcgagaccaacctgggcaacatagcaagacctcatttctgctaaaaattaaaaaaaattagccgggtgtggtagcatacccctgtgtttgggctactagggagactgaggtgggagaatcacttgagcccaagagctcaaggctgcagtgagctgtgattacactgctgcactccagcctgggcaataatagagtgagactctgtctcaaaagaaaagaaaaaaaaattaaagttcaaaatatttctattttacaatacactggagcatggttttgattttagtcttctttaatatacagagggaagagggttgagataaagtgagagtacactagtgtacctctaggtacaatatccacaactgggtgaaccaatatctctcctgtaatggccatttgcctcttggaatttcaagaggcaggaagaatcagtaattttcaactatgggtccttcatctaggggccgtgtttcattgagagcactatccaggttactggactagtttttttctttcaaaatgttcttcaaactttccttattttagtttatttcacacataatgtgctcttagagattgcattcttttggtatgcactgaaaaataggctaatcttccttgactgaggccaattctgagtttactttcttctggcaggaattcagtgtctcataggattgtggaataattgctcttgttattaaactaccacttctccctgcatttttttttaaagaaagtagatattatcctttgaaatgtattaaatctgatgtataagcataattatataatcattatttataagtttaaataattcaccttcacactctttctcttttatacaggagtgagaaaaactcacatgatttttagagttttttttttcacatttaaaagatttaaaagtgagttcagtctgtaatcccagcactttgggaggccaaggtgggaggatcacttgaggtcaggagttcgagcccagcctggtcaacatggtgaaaccccatctctactaaaagtaaaaaaaaaaacacaatcagccaggcacggtggcaggtacctgtaatcccagctactcaggaggctgaggcaggagaatcgcttgaacctgggaggcggaggatgcagtgagctgagattgtgccactgcactccaacctgcgcaacagagtgagactctatctcaaaacaaacaaacaaaagaagtgagtgcaaatactgaggaacatagtgagtataaaggaaatctagaaaataaaatggtatgctaaatattagcacaaagtcctagagttcgaattgcagcaggcttgtcatagaaacaatgaattacgtatatgtttggtcagttttcacttctttttccctctgctttaacaactttttataactaacatttatccctctatctctcctaagacttcagtatatatctattactttggcagtaatagccaagatatattactacatataactcaattaattcgttattttaaaggttagagcactggcaatgatacttagaggtgctggcaccatctcactgtagcagtgcattaaaatcaatgctttatttttatactgtggcattaaaaacattaccatttaaaatgtctaaacatcaggatttcatttttatgatttttttgaaagtatgagattaggaatataaaatgcctattcagctaatattttaaatcccccagttcaaggattgaagaaacttgtttagctaatttataagacttattttacaattcatgaaactcccatttttttaaatcagaaataaaatgacttaagtgattgaataaatggcaccaaataaagcagaatttttaaacaaaaagatagtaaaaaggtattctagtagcagatgaccttagcatattttgccaataaacttcttgagatttaatagctagtattaatgcctgcatcaacactccgaataatactagtaacagtggccagcacacagcaatggaagaaaaagcctggtctatctaggtcattaccaaaataatatcacattttataaaaaaagattttggctacctgggatcctaacagaattaagaaaaagataaattctctactctagagcacatcagatacttcacagcttggaaactgttatttttttaactcctaacaaaattctctcaaatagtctcacatagagatctgatttatctttaatcatttttttttgtcttgaggcagggtctcactctgtcatccaggctggagtgcagtggctcaatcgtggctcactacaacctcaacatcctgggttcaagtgatcctcctgcttcagcctcccaagtagctgagactacaggcgcccaccaccatgcccagcaaatttttgtattttttgtagagacagggtttcaccatgttgcccaagttggtctcaaactcctcagctcaagccatctgcctgccttggcctcccaaattgccaggattacagatgtgagccaccatgcctagcctgatttagctctaattcttcagatatgaataaacaactaatccaaatattttcagactttctcagtacatggtgcccttaatatctcaattttttaataacagcaacacattggccaaaataaataatagttccaattattaaatagttaagtccaaataacttaataaggttttgttctaacaatttagcacccactgagcactatgtcaatttctcattttggaatgagattggacattgcctcccttattttttgttgcacattgatttctgctcagcacttcatttttatccagcaactgctgaaaacccaattttgcaaagatatggtgtcacagaaaggaatatcatggtcttaattggaaactgggaactattccaagctattagttttccaggtggttgacagatgttttcgtgtttttcttgaacatttaaaataacgcttgcacccatgtacattccctctgttgcctcaggacacattttgagaactctggccctagtcccatcactcctacaccacagggtgaggggtgaggatacctccccagctgggaaaaacccagaactggggaagagatgatttggccatggtagctttctttctgtggttaatggaagaaagctttcaagataacaaattgatatgcttttgaaatgttcattagtgtaatattatcttgcaatctaggtaagagatgactacaaacttttcatgtagatccagtgagaattagaacctttgtaatgcaacgtgtctttttatttatattcttcctagtgagaccagggaagattaataatctggaataaaagatacaaattgacataaagggaattcttcttcctttttcaaactcaggactggaagcaatactactcttatacttagcaggcaaaagtagtagagaggagtggctgtgactgaaaacacacattagaggcccaagaagtggtgagggacttgttaattgctaaagaaaggacagtagtttgacatgggaggtagggagagtattatctactagctgagaaaatgccccaatggggcaccccgaaggcctgatcagtgaggtctgagatatctgtatagtgcctggggataacttagctagattcccaaatatgccccagctttttatggtatatcaaatctactcacttcctcgtcactggccctctgaatgcattcaccccaccccatattctgtgtgtagaagcaatgtatatgaatgtgagtgaagagccgattggatcatctttgcattctatgtgttggtgttaatttaacagaggatggggaatagaggattagttatccaggtgaattgagtatttcttaaaacttaagtagtttgacaggtaacttatacttaataaattcatagttttgtgacttaattctacttatcttgtcattgctaattctcctcttaatctttgcaatgtatcataactttatgtgtttccaaatacagatactatattactggatgatgtgaaaacacagaagtgattgttattcagatgctgaaatattaagatgacaaaaatattgtctatttacgctgtaattttcttcatgttacttcatgacaccacttgggcaaccagccttttgttatctagttgtttctactgttataaaaaatttttactattaatggtaatgcaagtttattttcatgtatttatttactagactcatgctaatacttaacatttttctttttcttacttttcttaagaattaagttgctactgcatcatctatatttaacaaattgtgtgacggtctctgagcagaagtggtcaggaacttctcttctgccttatatgagctaattttttagattctgaatttagcctagtgctatatacttgtatacattctctaagagttggctgcatatttactttgtacctccttgagcttttattttattcttaatcaaattttgatactgctatgtatttcattggtttaatgaatttggtcaacaattacttctgtttctcagcagtttttgctgtagtagtataaagtactttgtttacaatggcattatcaaattatgtgctcctagaaataatcaaaatgcttgcttttttttcaaaagattaagctcattggactttggctttctaacctgtaaaatggcataacaatgtccctatcaaaaggactgtgagtatatcaaataagatagctggtgtgaaaatacttgggaaagttgatgatatacacacaccatgtatgttatgattattattactaccatctttatctgttttgttcttcagctatttcattggtttctatttatagaggataagatgacgatatcctatctactaggaagggattatcttccttcttctcactttcccaatagagtaaatagttatatttaaacttaaagagtatttaaaggttttccaaaacagttcaattaaatagataaccacaaaccttcattttaaatacccttcattaggtacctatcctcattaggtactgtttgtatttgaaatttctaagaaaatttctcaataggaaagcttaactagaactattaataagaaatcatcaagtaattaaatatataacatcattctctataaagcgcagttgaattatacacatcagacagtcttcatagcattattgtgaactaggtaaggtgagaaaattaaagtttacacatggccatatgagaattcaaattaagagaaggcacagtcctttatggtggaagatatgtgtcgtgtcagattaaatgttgaaatagttattatttattctatttccttttccttccacagaaacttaatctccttggtagaaagaatgctttctaggagttggtatcaaaggaatatcttactgctccaatgtaaatatccaaggagaatggaaagctaaacatatcaacacattacttttcagcaaaatatagtgttgactcatggtctgattaaactcatcattcctacctgagtctgatcagataaagaactcttgaggcacacagcaaaatgaggtatccttgcaagtttgattttgaaataaaagcatttcatatttaaatatgaaatgctataagcttttcataaaatatatgtatatatttaatatttactaactggagtagaatgtatgaaagaaacaatctatcccaaactcagtttactacaatttaaaaaggtagaacacataactacataaatggactccactaactcactgtgagttttcctctttcttttgtcaataccaagcctgactcacctttgatgaagttgcattagatgactttcaattctgtcattcgcctatttaacattgtttattgttatctatggggctggtcagtattctactcacctttaccctgttcccttttttgatctgcatagtggcttttttaagcctttccctttcttctcaagctgccccatccctctctcctctggctattgatggctgtaccttctacttttacattcattcatctggagatggaggagtaaaatgtttagagaactcatggctaatatctcttaacattttactcctccatctctaaatttacatttcccttcttttactcttcttctccttctccttcttctcttctctcttattcttctccttctcctccttcttctttttttctttttttccagacacagtcttgtcttcctctgtcacccaggctggactgcagtggcatgatcgtagctcactgcaaccctgaactcccaggctcaaccaatcctcctacctctccagagtagctgggactaaaggcatgtgccaccatgcccagctatttttttggatttttagtaaggacaaggtctcactatgttgccaaggcaggtcttctttgtccttcctaaagaatacagttctggtatttactacttttccaaggatagcctccttactttggctcatgatcatgtttttgtcagcaactacagctccatctttaaaccctctttccccttgaatttttagtctctttctatctcctggagccttccctcagctcaagtaacctgaattcaaaaaaattccgcttgaacctaattctctgtcaggcagccttagttctttcttcctactccacccatcagccttttaaagagatgcctgcatttgctcacatttccactttcaattcactccttaacccaggggctcctaatgctattacctgaatacaacgcaccactcaactgtcattcaaaaacctagtaattatagaaggtaactgttctatttctcctggtcctctggactgttatttctgtttgctgtcccagtactttaactgttgtcttgtttcccctagccttatcatgtacaaaccaattcatcacctgttatctgtcatgttttctactctctgccctttgttcctcatcaccatgtacgtacatcaccatgtacgtactcattcatggacaaaaatcagcactctctttgattctccttctccactggctgtcccccaacatacatacatacttcacacacacacacacacacacacacacacacacacacacacacacaaccattctataagcctcttgcatctaaaccagctctttgctccactgccatcactcccttgacttaggtcttcatcatatttagcctgccttacttctgtgaatttcgacatgaaatacttccctgtagtgacttcgctatgcaatcattcaacaatagagtaatcaagatgcaataaaaacaagaatatgatcatgccaaaactcagctaaaaacctctgtggctctcaggtcccatagactgtatttgaaattttcttctctcttgccaggtttcgctattcacatcaagcagattgtcattccttagttcagccataattttccatgcctcacatttagtaaatgttgttcccttagcccggtattttctgtatctttcccttgggtggaaaactctccatctcctctctctgttcctgcagtacatgataaatgcctcaaggattgtgctcaccatattttattacaatggtctaaaatgccagacctcactgctccacagattcagagctttaaatacaccatatttgctcaagaagcattctcattatgtgtgaatgaataagtaagtgtcatgaatttcaaatctaaggaagtgagataaaaataatgtaaaaatagggccactaggaatagaaagttgtttagagatgaagaagggtagacgtcaataatacaactgctaaaatagcaaccatagtttgtaaaaatgagtgaaatataatttcatttctagaaccccatgtagacctattgcaatacaactgatgctctgttagaatggcaagaataacactagacactcaggggttccatacagactaattcttataagataaattgcagcctgttatgagtttttgagatgggtgtcatgaaaagatggtgaatgttattggacaaatgtatagaccaagagagaaagatgaagatcgattctatacagaggcagatgtgccacgaatgatagtataggtattgagtgagaataaagacctatgtagaaaaacatgcacactaccacaagaatgaaatgcactgagaaaatgagctagtgatggtacaggatctgcaaacctgcttgtcagttttcattgtttttcaagctgtactatatcttaaatgatattcaagtctgtctaatgttttctgtgcttgcctctcatgatccttaaaagttggtttaattttggcaaagtcccacaaagatttcttaaatgatctggcaaaccagtgctaacatctgtacatacattaattgaaatatattcaaaatgctatacagtctattatcacaggacttttcaatggagttgaaagcttttcaaaatattagaaaatatccatgtagttaggtagctaaaactcaggctctacataaatataagctaatgatttaagtgttagtttccattaaaaatttaattctcagttttcctataaagtattttctgggaaaataaatacatgcgtgtgtgtgtgtgtgtgtgtgtgtgtgtgtgtgtgttaatcaagagtgacagtgcactcaggttaaatctaccattcatttctagcttgtataattttattcatattctttctacattggaggagagtgatacagttgaacaaaagtcattagttttattatgtcatcagctctagatataaatttactcggttttctctctctttgcctgcccttgtacttacatatcactggcaatggaggagttccgggacatagactttggagagaggtcataatcgctgtcggatcgatacaggaaggactcccgtcgttgactgtggacaaaatttgcttggagaattagcccggatcctgggctggtcatgggatccaagggactccgtcccgcagatgtgccattgtccacatcaaaactgtaaaggaaggagaaggaattatgttgctgtgaacattcacatgttcatattttcaaaaagcatttagcgtcagctgaggaactgacagtggaattagcaggaatgaaaattacagctaatttctgccataaaaatatgataatattgaaatacataaaagaaaaacacattgacttcacattcttgttctcctggatactgttgttaactgaccagatacaagatacaggtttttccaaactctacttcagttaaaagggaaacactctgcaaaacataatcttctaagtacaaaattcctttcggaaaataacaaatacacagtaattcatcaaatatttgaattcgattcaacaaatacccattttgtgcctaatgctgttctcccaaacctgggcttctccctccacactcctaccctataacatccatccaagcattaatttctattgtacccacttccttccatccctactaccaatattttaaattcaggtctccatcaaatttcacctatattattataacaacctttatattagtgtcttgaatccattttccagtgtcattcttcagtttaaaacccttcagtaacttaccattgctctcaggatgaagtcaaaatttctttgccagactgccagtctaaccatctgctctcaattgcaattagttgcccccagcctcaacttgccatcctcagctattgggtacttcttgctcaactcatattgaggcactatctccttctcacaggccatcaccacctcacctcctgctcccctaaataatcaaatcccctttcccctgcctaactgtcactcatccttgagacttagcctgcacctgaaaggctaccctggtacatcagagctttatgaaaggccctttctctacgctcccaagacactttcccactccctaatgacagaatttacaatgaattgaaaatgtttttcacccggtctccattcctagattgtgagctctctacaaatggagactcagcgtattcttggcacattgaaaactgtgcccaagtgtcttgagtaaatgattaaatgaataaaaggcactgtgctcagcaatacatattttagagctgggaaaaaatctacacacacagttcttaacgtcatagtccttataatctagataaactttccacaaagaacctttctagtgaaacatcaaccagtattaaaataaagtcaactttcatgtgttcttaggagaggagggtgatagcttatgatagcccagcaggtgtgtggttttaaagaaaaacttgttgaaagaataaataaacatgtgaattcaagttttgctgtcattaatattttccccattagaatctttattcaaactattaactagctcattttaaaacattcctttattttctttatcggagtcattaataaatagagttatgactctaagattggaagatgtttcatggatcacttttgaatctgtgatcaaataacagtggctccgaaataatccatcaaataaacagaagagggaaaactcattatcttgagcagctgtaaatatgtttttccaacttaaaattttcttagaattgtgtctctttatagatatatttatttggttcaggaaggacaatgagagattgtcaagtcgaacagactcactttacagacgaggataccaggtcctagaaaagttaattgaccagtcactgagctaactgcattgaatcatcgattgttcctaaagtccttccagctctactgcatgattatataaaccacaaatatatgtggcacccaaacaggggacatctgtttcaccagaataggataggcacatatgtatgtgaaaccttgtcaattcccaggaaggctggaaggggaggatggtctctaatcattcaatagacatacattagggatctttggcaaactctccttggatatgcttaaataggcatttattaagcacttaatatgagtgcattaagatacaaaaataaaggatgaatgactaactcaggctgggatatctgagaagttttcatgaagagtagtatttaagaaggtttttgaaggtatttagtacacaactggaagacattaaaaacttctaaatagtgggggtttggcaaagtagatttctcttctaagaagatagtcatggcagcttttcagcatgaggaggacctagtaatgtgaatgcctgtagaaatgtttatgtttatttccctttaatatcaagatattcttattgctacactttaaaaaagaaaataccccctccttcctgtgcatgaacagaaatgtaagagatacagaagtgtgagttttggtttagtttttttcagttcaactgagtaaacaccaaatttgtataaatcagtaattttttctttaattataatttttccaattaaatcaagcaagtcttaacactccactataagttttgaaacaaatattgctaaataccttaagtcatttagatagttatgatatttttaaatcttacaacttttaagccataatattagcactaaaaccaaaacatttattaataggtcaggaagtgcttgatatgagatattctaggggctttaatatttttctttgtatactgtaatataaaaatttgtccactagatggagatcattttcttaaacaaggaaactattttctactgaagggttaaataaccttaaaggcctaaattatttcttaggaactcatgaaaataaccctttaaatgacatccaaaaaacaaagttcacaatgtatactaagtaattatcaatattgataaaattacattaatctaatattagtattagctttacaaacattgagaatgaagatctaaaaatagtgactgatattttattggactttttcttaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcactgggagatatacctaatgctagatgacgagttagtgggtgcagtgcaccagcatggcacatgtatacatatgtatctaacctgcacaatgtgcacatgtaccctaaaacttaaagtataattaaaaaaaaaaaagaaaagaaaaaaaatacttgagaagacttaattgaatttccgtaacaaatcactgagtacttattgtgttggagtaaagtaacttgagcatcattaatagtctggggtttcactctaaattttggcaccacaagtattctcagaatacggtttgttctgggaagtgaacctagggtctgagttcatttgcataatttatttccatgatattaaatcctcttataatcaaaattaattatcaagaaaaagtaatattaccgagaatctccagtctgaagtatcagccaatgtcagtattagtgaatgactttatacaaagagagactttgtattttgaaatagtcattgaataaacttttacattacatcctatgtccttagatcagcacttgaataagtacagatatactacacattgtccttttctagaaagcactaaagtctagttaaggtaatagaacatcaagcaaccagagaaaataaaagcagcaaaacaggtggcatctgtattaaatagcatataaatactaaaacacgaaattgtattatataggcaatcagactatgtgatgtagacaatgaatgtaaagggaatttaagaagttgcaggatgtacacctttgaaggagagttaaaaaatgtccagccagagtagagctggggttgggggtggaggccatccagcaaaagtgaagccacaaaaacaaaaccaagaaggaatgaataaggcgtgtatataaaacaggacatttagtgtctggctaaatttgaggcttggtattaaagaatagtggggacctataaaaatggcaattttgtacagttcaacctaataggtagggatggatgtgtttatggaaagctgggccaaggagtgtcagcagaagcttgttataaagacttacgtggaaacacacaaatcaacttttaacattgaaatctcaggggagtaagatgaggaagaccagtatttgttaaaataaacatgttgcttttgcaacaaataaaaggtagaaaacagagtagaggctgagcacagtagctcatgcctgtaatcccgacactttagaggcacacgtgggaggatcgcttcagaccaggagttcaaggttacagtgactgatcgtgtcactgcactccaatctaggcgacagagcatgactctgtctcaaaaaaaaaaaaaaaaaaaaaaaaagaaagacaaaaaacagagttaaaaaaaaaaaggagaaaaataaatgttttaactacaagaggacccccaaaaaggcttgttcattaaatacttcaaatattagaactagggggtttgccttgagtagggaggttagttgtggattttaaaaggcagcacatttttactcagtaggtagtaagttaactgagaattagacacttacttaactttctgaaagttagcctaattagtcagtttgggctgaaattatagatggcttcaaataagctagttatctttgaaacataattttatcaatagtccacatcgtggtgttatgaataaaacaagaaggtgatgaaggataaggtagccctaaccttagatgctggtatcaaaatgatcagttgtgaattttccaaagacattctttagaaaacacttggatgtggtgaattctcttttgactcacagccaattagatggagcccaagcaaaaaactagaagtttgaaaaagtaactaaaggattggggagagtaaaaattaccaagtttaatgatgatggtggcaataataataatgttaataacaataaaacttctggagcactttccatgttccaggcgctgtgctttgcatatattatctcatttaatcctcacaataacactttgaagtaggcactgtattttccattcgaccatggggactctgaggcatagacaagtgactctatgttcagtagtatgctcaagctcataagtgggttttaaactcaagctgtctgattctaaggctggggagaatggactctgtttacacctctattatgaagtttcatttaaaaaaatacaagaataccttttagcttcctcacctgcagggaacttttgaaagtaacattctgattaacttacaggtgacgcatgcaaaggctaattctgagactaaattttcgtatggggctgggtgtggtggctcatgcctataatcccagcactttaggaagccaaggctggtgaactgcttgagcccaggagttcagggccagcctgggcaacatggtgaaacaccatctttacaaaaaattttaaaattacctgggtgtggtggtgcttatctgtagtcccagctaccccagaggtggaggcaggaggatcacctgaactaaggaggtcgaggctgaagtgagccatgattacgtcactgcactccagcttgggcgacagagcgagactctgtctcaaaaaaaaaagttttcatatgacccaacattttggaatttgccaaatccccagctttttccaattctgaacataacagtagggtgtaaaaaagtctttgctgtaacccatttggcgggtttctttatagcatttgagatttcatttggaattaaggaagggtcagtgggtctgcaaaagggcttagcaaatggaactaagtgaggtgctttcttgttccatatgtttgcttcccttaatgcaatttaagaatgcacacaattcttaaaagagataacttttgccagaaggcagttttggaggaggaatgatatagctatatttggtctcccatgagggggcagtaacagtaatgaccagctggcctgctgcattcagaagtgttaaagaatgtgtgtggctagcactactcatgaccatttactccacagacccatccttttctatggaaccagccccctacaagaaacaaagagaagtcggacaaactgacgaatgaactaattactcccagttctccacactgttccatttcagtggaattactggatggtaatacagttccaatctacctttcatccacgctctcaactgctcgcatactttgtgtctactgaccttgtaattgtttgtctgctgaaggtcatttctcatctttttggccttttgctagacactgcttccctagtttaaacttttcccaatttatttttgaccatgatatgggccctctcctgagccagagtcctgctactgtgctgagtaaatagctttcctcatctatcctagccatcaggaccttatacttagcactgacccccagtatgaagcccaaagtgggtggggcaatgagggcctcagtggagcagctgctaaggaacctctatcaatagcagcctccattaccgaagcatctatgaaggccactcacagggaagatcttgctgaatgtcgctgggaatcctgggagccatcactgaagccaggaccatctgaaagctgcctttttcactacatagtaagaacaatggcacatagaaaatattgacctaccaaaaatgttcctgttaagatgtttatttaagagttagaaaacacaggttaaatttgaaatcttggttcagccacttcctatttgggtgctctagggcaagttgctgtattttctaggctttcactgctgataaagataattacaatacctagctctagggccattataaggattagaagagaaaatgtttggaaagcattcaccacattgcctggcagctagtacactcccattatttagcagctattgtttttcatttttattactctttttctcccagggagatcttcatctaggtcattctctttaactttatttgaacacatggctttgggaagaacctaaagggagagatgaaagaggaagagaactgagggccaaatcacctgaatcagcccttgcaatcaatgaggtgacagatgctggagccagattgctctaaaagtttcagctgcttttatgtctccacccaactccataattccagtgtgataacatctggggagggtggagactgctgatttttttctagatattactcactgaggagaaagaataatttcctaccaggaagtgtggaaggcttggaggtcccaacaacctaggtggggctccagctgaatataatgagcagaaacagtccttcagacctcaggtctccagacacagggtgtagcttggggacctcaggtcacaattatactgatgtttatattcctgtactccactctcccctgtgtattgtagctcatgctgttagccaacacattggaactcattttgatgctttgccctcaaggggaggggaggcttacccttgagcttaaggggagagtaactgtaactggatgactacatacatttttccctctttataatactaaatattttacccattgttatcaatatcacaaggttatgaagctcgtttctaatcaatgccactgatacttctctattgaaaatttccctgcaggtcaaatagcttctctgaagtaaacaaaataatgatttgcaaaattcaccattttaatatttacttttctctgattatctatggagatgagactgtagaaactagcattttacagtgatatgcacagatggcaatctttcccaatcaatcataaaactgcatattaaatttaagtaggatacccggagaaggcatgatatttagctactttacaagattacacagctaaattatactacacatgttagcttgtataatatatatatttgcacagagttaagatatttaacagacacgttttaccctttgttttcacagatgatttttataaacaaaagcccagggctgggcatggtggctcacacttgtaatcccagaactttgggaggctaaggggagtggattgcttgagctcaggagttcaagaccagcctgggcaacatgatgaaaccctgtttctacaaaaaaaaaaaaaaaaaaaaaaaaaagtcaggcacgatgatggcacaagcctgtggtgctgaggcaggagaatcacttgagcccaggaggctgaggcttcagtgagtctaaatcatgccactgcgctccagtctgggtaacacagtgagatcctgtcatacacacacacatacacacacacacacacacacacacacacacacacactggtacaaagatgaagggtatatgcttacttatgagtaaaacattaggtggtactggaaatatacaacatatgtttctggcttgtcagtgacactcccaagtaacacagggcaataaagagattcaagatggaaatgatagcatgagtttgatgtctggactataaatgaaagaggataagctggacttgcttagcacacttttgacacaatgatatgataaaaggccaatttttctgaaaagtatttattaggccagtgttatggactgaatcttgtttcccctataattcatatgttgaagccttaatcaccaatggttacatgaggttgaggttgaggttaaatctatcttgtttcccctagaattcatatgttaaacgaggccatatggatgaggccctaatccaatagtgctggtgttcttataagaacagagagagacacaagagcattctctcttcaccatgtgaggacagagtgagaaagcagccatctgtatgtaggaagagagccctcaacaggaaccaaatcagccaatcttggtcttggacttctcagcatccagaattgtgagaacatttctgtttaggccaccagtctagggtactttgttatgcggcctgagttgactaaggcaaccagaaagccccaaccaaaaattgttttacttgaagtttatacattactttttaatgactgttaagaaaaattttcttaactgaaactctctctaagaaagcatctcaaattattgccaagaccaatgccatgaaattttccccctaaattttcttctaggtttacagcttcaggtgttataattaagtcttgagtggattttttgtgtatgatttaagataaaggtttagtttcattcttttgcatgtgaatatctagtttccccaataccattttccaataccattcaagacttttcttcattgtatattctggacatccttgtcaaagatcagttgactgtgtatgtgtgagtttatttcttggctctattctgttctattggttttatgtctgtctttatgccagtaccacattgttttgattactgtcacttagtaatatgttttgaaatcaggaagtgtgagatctccagatattttgttctttttcaagattgttttgactattcagccttttgtggtttcttatgaagactgcttttctatttctataaaaaataccattgggattttgatggagattacattggacattgtggacattttaacaatattaagtttcctaatccacagcagcatcaaagcataagcaaaaaaagcaaaaataggcaagtgggactacatcaaaataaaatgtttctgcacagcaagggagaaaacacagtgaaaatacaacctacagattaggagaaaacatttgcaaaccatatatctgatatggtattaatatctacaatacataggagctcctacaactcaatagcaaaacccccccaaaacccaattgaaacccctcaaaattaaaaaaacccaatgaaagaaatggacgtttctccaaagaagacaaaaaatggcaaacagggatatgaaaagatgctcaacctcactaatcattaaggaaatgcaaaggaaaaccacaatgagatattgcttcactcctgttaggatggccattattaaaaaaaaaaacctgttggcaaggacatacagaaattggaatccttatgtactgatggtgggactgtaaagtgatgccactactataaaaaacagtatggaagttcctcaaaaaattaaaaacagaactaccatatgatctaccaattcaacttctgggtatttatccaaaaaattgagatcagcatgtcaaagagatatttatattcccatattcatttatgtatattcacaataccaagatgtggaaacaatctaaatatccatcaatgaacgaatggattaaaaaatgtggtatatacatacaatggaatattatttagccttaaaagaaggatatcctgtcatatgctacaacatggatgaattttgaggacattatgccaagtgaaataagtcagtcacagaaagataaatattgcatgatccctcttatatgagggatttaaagtagttgaactcatagaagcaggaagtagcatggtggttgctgggcctgggtggagggagaaatggagagttgttgttcaatgtgtatcatttaatcatgcaagatgaataaattctagagatatgctgtacaacattgtgctaacagctaataataatgtactatacacttaaaatgtaagagggtagatctcatattatgtgtctttgtttttagcacaataaagcaactttttcaaaaaggatctcaaatggccctaacatgaggccatggtatttggactcttgaggcaaagcctgcagtagcagtatgaggtccatatttgcagtaattacctagaaatcatgagaacttcaagtagtaaacatatacattcaatcagaatacgtgctgacaatgggaagcggaaagtgtctttttttttggtagtcattgggaggccttaatttctctggcaatttcatgcaggtgtcactgtgattgagaataaaacaagtagagatttatttcttcccttacatcctattatcatgtgctgaccactaactaagagtatggagggaagagcagaaaagcacatgctctccaggccaggctggacctgagagtcagctgtagtcccacaggaataactcagttttattttccttgtactgctcacagcaggttactaccaatctttcactttctaagatcacttctaagatgctatatttccaaaatgcactctttctcaaaatgtggcttcatcaagctaaagtccaaagaggaatagcgtcttgttaacaaagtggggctcaagatggattaaagacctaaatgtaaaagctaaaggtataaaaaccctggaagataaccaaataaataccactttgaacataggaactggcaaagatttcatgataaaaatgccaaaagcaattgcaacaaaagcaaaaattgacaaatggaacttaattaaactaaagagcttctgcacaggaaaaaaaaacacaactattaacagagagtaaacagataacctacagaatgggagaaaatgtttgtaaattgtattacctgacaaaagtctaatacccagaatctacaacgaaattaaacgaacattcaagcaaaaaccaaaccgccccattaaaaagtgggcaaaggacatgaacatttttcaaaagaaggcatacatatggccaataagtgtatgaaaaaatgctcaatatcactaatcattaaagaaatacaaatcaaaaccacagtgagataccatttcataccagtcagaatggctattactaaaaagtcaaaaaataacagatgctggcaaggttgcagagaaaaggaaacgcttatatactactggttagaatgtaaattattaatagttcaaccattgtggaaagcagtgtggtgattcctgaaagaactaaaaacagaactaccattcaactcagcaatcaaactacagggtatataccaaaaggaatataaatcattctaccataaagatacgtgcatgcatgtgttaattacagccctattcacaatcacaaagacatggaatcaaactaaatgtccatgaatgatagattggataaagaaaaatctggtacatatataccatggaaaactatgcagccataaaaaggaatgagatcatgttctttgtaggaacatggatggagctacaggctattatttttagcaaactaatgcaggaaaagaaaaccaaatactgcatgttttcacttataagtggtaaccaaataatgagaacacacagacagaaagagaggaacaatagacactggggccaacttgaggatggagggtgggaggagagaagaggatcagaaaaaaaatactaactgtcaggtactatgcttagcacctgggtgacaaaataatatgtataccaaacccccggggtcacaagtttacctatataacaaacctgcacatgtaaccctaaacctaaaataaaagttaaaatattaacaacaacaacaaaaaaaaaaaacaagcaagcaaagaaaaatacccaaggtagtgttgcggggtgtttctgtctttatttattgtttctatgacatagagcaagtaaaattgatttaataagccgactttgaaacattgatattttaatgatgtgccctgctacttctccagccacccacccacatttattctttatattgcagacagagcgatcctcctaaaatgtaagcccattctcggcaagttcctactcattatcccataatggtgtcctattttattcagagaaaatactacgttctcccaatggtttaaggccctcagtgacctggtccctggtgcctctctaatctcatctttacctacatctctccctcttgttcactctgctcagcctcttggtccctagctgtccttgaagcactgtgcatactccctccccagggcctttggatttgcagttctctttgcctggcatattctttctagagatatcagctcaatgttaccttcatgagatattcccatactggcctatttaaaactggcacccctaacctcctaaccttttttttttttgaacaaacaaacaaaaaaccttccttactcttaatttttctccatcgcatttaacagcttctgatgaactttgttttttacttattttatcatcttactcaccccattagaatataagctccacaagtgcagagatttttttttaaaaatctactttgttcgttaatgtgtcccccagcaggtacaacagtgcctcacacgtacgagttgctcaataaatatttgtatcgtgaatacatgggtatctttagacgcagcggtactttttctataccggttatcatttaccatggttatctgtgtagttctactttaaataaacttcataactattttttaatttagctaggagttggtcacttatttaaagaaataggttaatgagattgattagcacatttgaagaaataatctggaacatctctaagaaggcattttaacgggggttattttgaatatccttctgtttgaacagcagtcagccatgcaatcaggggtgggatcaaggttttgtggtacacgaagattatacaattataagggtctgctttcagaaaaataatacaaaaaaatcttagttttttgaattttacaaaacctaaaactacgtgcagctgctagtaccacttcttacaacttgaaagggaaccaggccagtgagaagctcttagcttgatcttcattagtttcacctcagatctgcatctgaggtaattacatatcaggaaagaataagaaaagaaactggatgggtgaaaataaaaatttagcaccttatatcattacttaattaattatgtgttttctgagatggagttttgctcttgttgtgcaggctggagtgcaatggtgcgatctcggctcactgcaacctccgcctcccgcgttcaagtgattctcctgcctcaggcccccgagtagctgggattacaggcaggcgccaccatgcctggctaattttgtatttggggtttctccatgttggtcaggctggtctcgaactcccgacctcaggcgatccgcctgcctcggcctcccaaagtgctgggattataggcgtgagccaccgtacccagctgcaccttctattttcttaagagataaattgttattagttttttcttcattcctttttattctttccctccctccctatcacctccctctctccctccctctctattttcagtacccaaattttcaaagcttactcataattctcaaaatttctcttgttagttgcacgtgtttatttttcccagatcagtgagtgtcacctagtcctggggaatggggagtgattccattaggtcagatattgaactcactttgaagaggggtgatcttcaaaccatacctgtctctcaagatattacaattttctttttgagggatgggttttaaaaatgtgatcctcaatcacattcctggctatttgggtatttaggcttactaaaaattaatctccaaaagattttattgactaaataagaatgattgaatgataaatcctttgtagaaatacttagccttaaaatattatgtgttaagtatgttaaataagtctaggtaagattataacagaaaacaaaaaagtaatagttctactataattgcctttaaaatataaccgaattctgattcttttagactaatggatacgaaaactcatataccatgtttttcctctgggtttgcactctgcatcaaacaggtcaggaaaccattcaccagccctactattaaatctattttggagaagtgatattattcagtttccaacctcaacaatccaaacagatgggttttctgccttaatggggcttgaatgaatggcgaagggcttcagagggttgtgtggcctgaattacagacaattttttcaatcttactgggcaaagcaatgataagaatattatcttacgatggccataaacaatcacttgcctcttcaattcttttaaaatatatagtggagaataaaaaaagatatgtctcattatgtgtctcattgtataataagtacactgagattagctttctctcatgatttcttatattgggtgaattatgtatggttacaaattatcttttaaaagttttaagatgttggatgggctaccacagaggtagcaggatctacttcaacaatgattttatagagtgaagaaacattttcatgtttccttgaaatggaatctggctgaagacaaaatgaccttgggaaagcatagaagtcaataatcaggactgtgagtataggaaattctgcttgttgtctgccatattccattctctgcctgttcctgggcataaaagaagttctcgttcccttgcaattagatttggccaagtgactagatgtgagcagaaatattgcatgccactttcaggactggctcatagctcctcccacatgcctatcttgatgttctttttctgccagctggatgctaaagatgctgatgcgtgaaggatggtagaaacagaaggtgggagaatcctggtccgtgactgagagcaaggagagctgccacatcctcctaaacaccatcctagaacgctacttgatgaagaatgagtttattttttaagtcatttaatttgggggcttatttgtcagcacaataacattcaacacagtgcgttccatcaaagtaaactggaaagtacgtactgaaagtacattagactttcaaatgtctcacattcaatctatctctggcccaagtgaaaccatctatgtctttacttctaccaccttcacacttcatttaggttttttgttttgttcccttgatcttcctcggttaacagatattttcattatgacatttctcattacctaagtgcttaagagatgttagagaataagtctataatcattacacacagttgtgattgttgtgtaaagtgaaagccagtctggttctgttctgtcttaacaacaatcagcaaagttacagaggatcagctcaagtgtgaacctgacacatgaatttgtctctggattacagaagacacacagaaccgagattaacaaacactcaggatttacacccgtgcttcacttgagccaatgagatttcagaagtaccagatcgaaataggcttcccttaagacgtcaaagcattgcaacaaaaacaaaaacaggcaaatgggactatattaaaaccaaaaatctctacatagcaaagaaaataatcaacagagtgaaaagacaacatgttaaatgggagaaaatatttgcaaaatatatatctgacaacggactaatatccagaatatgccaagaactcaagttaacagcaaaaacaaaaccaaaccaaacccaaataatcccatcaaaaagtggacaaaggacatgaagacatttctcaaaagaagatgtaaaatgaccaacaggtatgtaaaaagtactcaacattactaatcatcagggaactataaatcaaaaccacagtgaggtatcttaccttagaatggctattattaaaagaccaaaaaaaaaaaaaatagatgctggtgaggaagtggagaaaagggaattcttagttggtgggaatataaattaatatggccattatggaaaacagcatagagatttcccagaaaactaaaagtagaactattatacaatccagcaatccccctactgggtgtttatctaaaggaaaggaaaggaaatctgtatatcaaagggatacctgaacccctatgtttattgcagtactatctacaatagctaagatatggaatcaaccaaagtatccaccaacaaacaaaccgatagagaaaatacatatatatatatatatacacacacacatacacatacaatggaatactatgcagtcataaaaagagcaaaatcctgccatttgcagcaacatgaattgacctgaatgttaagtgaaataagccaggcatagaaacacaaatatggcatgttctcactcataagtgggtgctaaaaaaagttgatatcatgaaggtaatagaatgatagctaccaggaggaggggaatgaagagaggttggctaacgtatgcaaacatacagctggatagaagaaataagttacaatgtgtgatagcagaatagggagattatagttaagaataatgtatcatatatttcaaaatagccagaagaaagaaattgaaattattccactacatagaaatgataaatgcccaaggtgctggataccctaaataatttgtctcggtcattatacatcctatttatgtaacaaaatatcccattatcctatgtacaaatattgtgaattaattattttaaaattctgttaaaaaacaaaaattaggcttgccttattcaaaatgttattctgaagcaaaatgacattttgaatgtgcacacttctggggaaatggttcagagtctatagaaaaattctagaaatatttcacaatttatccaaacccagactagaaccactcttcactgttgcctagctcatttgcagtgggatcaggatgagttggttcagactggcaatgtcgtaggttgaatcagatgcctaagaccattcctgttctgaactcataggctaaatgcctttctagagccaaatgttcctctctagaagaaggaaaggatattacctggggcatcctcttgccagtatagcactctcctcaaatttgagccctctttctctgagtttcagtgtatttctggtgtaagaaatatttcattgccaccttagagatcaaactcaaaggattaatagatcctgagggtgatagagtaggtcatagaaaagagatacctatccattccacaaatgctcatcaactacctactctagccactctgggaggaataatgaagctcattgagaagacgtaaggatggtagtagttacactgatcttctgctccaaaattaatttggggttttccttcccctcaggatgaccaaattcatggtgaggctattcataaatcctgttgacttgccaggtccacagccaagataaatgcacagctgttttctaaaggcatttgacctcttctctaatcacctcaagttgagaagcaatgttcattgctgactttctttgttttgacattaactatgttctcaaataaaaaatcaagttttacttctccagccattaaaatttctctcatttttatgaagtaatatttctcaaacatttgaatatattcatccatttttgtgccacttcatctattttctagatagattatgatattcaattatgtgtattttgtctttcttttttctttttttgtagaatttattcgatataatcttggctcccattttatttcccacttatcctcttttaaaaaatgacttatgcttttttaatgaggagtccaaaatggcacacagaactctaagtacagtgtaaacaaggccatctgtaatgagaaagccattcaattcagcaaagatttttctaaccagctatacatagtcatgacagaatcctcagatttagtgtttcctagtagcaattgtaattcttttgattgctggcctgtaaaatacttagtactatactgtaccatgacagtggaaatatgtaaatagaacctccatctccagcctgcttatataaaatgaataccactggtaaataatttaatgttaaatgtagttacttttacagaaaaatatatgctgtaaaataacttctactcttttttcatacattcagatagcctaaaaaaaggatagatgtcagttttttaaacttgggggaaaaaagaacccaaacatgattatatactttgctgacctttgaaatttaatttgaccaaattttgaaaatagtctttgagaattacagagtgagcaaatgccagtacttcatgaaactcaaatcgagtttttttttaaataagcagtgtaggtatcgtctttgctttttccatgtctttaagacttttaaaaatcttaaaatatgactgtttcaccactctttttctttttttatagaattcagaacttaagttaaatttgacaagaggaaaaataaaatccaaaccacatctatgcttattctgctcttggcttcttcctacagagctgtcctttaaatttgcaatgtaattatgagtttccataccacatatgccactaatcccacgaaagtatgtggcccttcagaccacatgaaaaaaatctctcagggcaccttgggtgctttacccacttgccatgtccaaaaagagttccatctgtgcccctgatggtcagataacctgtcctgggtgagacaaaagaattattcccaaaggccttttcctcctgtgcttcttatgccctcacaagcaggttgtttctgagcaccttcacaggcattgttcagtggaattcacacagtgaccctgggcaataagtgatgggattgggagtgtagatttttatccttatttgctgaagaaaaatctgaggctcaggaaggagggcaatgatgtgcctagagtctcatagatttaaatggctggattacgactcaatcccaaatcttctgttctttggactaaagatttaaatgaaggattgaacaattggattacttttaatccttcataaagcttgaatgaaagacaaatgcttattttaatgtctcttatgagcactcactagaaatattctctagccgagcacaatgttcaaaacctttgtgtggaatgttacattttgctgaaatgaatggatgtgcttacatgtctgtaaatagtagaatgaaaaagctggaaaaggattttagcaagagtccttcattttggtactcttgttaatcatcctaacaatattgtaatgctttatagtgtatggtaaatgtttgttaatacttagagggagatacagaaaacaactatctggttaaatttacttaaacatatcagaccagctttgcaaaacaaagggattcccacttgatattctgaagaatatttcagaaaaatatgaatgtatttcttttgtattatttattgatttttaaattttagatccaggggtccatgcacagttttgttacatggctatattgcaggaagctgaggtttgggcttctaattatcttgtcacccaagtagagaacataggacctgatagctattttttgacccttgccaccctctcttcctccctgcttttgcaatccactgttgatgggcaggaatgtatttataacgcaaagataagaactgatgctgggcaatactactgggttgagaattgggagccttgagtttgagttctgaccccgctactacctcgttgtgattttggcaagcctcttgacttctctgggacttagctatttcatcaatgaagtaaagagattgtccttttcaattactgctacatatcactttggagaggcttttaaaaatacagattcttaggcctccttttggatactctgagtcggtaaagctgaagctggatccaggaatctctattttcaaaaggctgtcatagctatttgatgtgttgtcaggttgagaacaccggacttgctgaccttctagctttaacattcccaattccaactggacagcactgaactcagctcatattcctctatgctgtgcttactcgggagcgggagtggtgagaagagccaaagctgtcgtcaccaggctatattacaccaccttccttggtggtgtccctgcccacatgcccagctcttcaacaccactttctacgctgctgttgggattttgtgtgtggttaaacgggatggagaaagaagggaaaaaaggagagagggagagaaggaaggaaggaaagaaaggcaggaagaaaggaagaaggaatgaaggaagaaaaggaaggaaaaagagatagcttgcagtggctagaaaatgtaattattttacttccttgaataactacttttgcctataaaagtggattctttatcacggcacttaggttactttaaaatcttgtcctaattcccttcaaatcttgtctctagcccctccaaagatacttctggtcatactgttctcactctctggagtatgtgttacagataatgaagttttagacccaaccaatttctgcctcatgaaatcattctcacttttcaaagctcaacatgtagtaagaaatgtgtaatatgacctccagttcttccttccacaattccaaacatcttattcacactgtcaataaagcattatctcagggttaaaataataaagcaactggctttaaacacatttctccccttatcaactaccccttcccagctatttgaggttgggggtctccataccatttactttaatcatcataaaattaacattcatgttttgcttgaccatttgccaatttctttacatccattattttatttgcatttcataacatttctgttaaataaattttttgtcaacccattttattgataatgaaactgcaaacagggaggtttactggtttgctggttaatgatgaagctgagatatgaacctagatgctgtgatttcaaatcttatgattttcctgcactgatttacaagacatcgacaggtgctcagcaaatgcatattaagtgattaatattaagtgaatgaataactggtgagaaaaggcctcatggtctcaaataatggtctctggtctatgcttgcatcttgaatctgcttcttgctatctgaacaatgtcagacaatatatctaatctgtctgagcttccctttccttctttatcacatggggaaatcatactgccctcatataggtgtgtgtgtgtgtgtgtgtgtgtgtgtgtgtgtgtgtgaactcagtgatatgaaatgtgtaacgtgtcctcaccagtgtgtgcacagagtaagtcctcattatatgtttgcttcttaattttgtgggaggcagtcattttgttattcattgcatctgaattttatgcataagcctacctgtggaggttacatttattcctgagattttaatcctctctcatcttcagtgagaaacagtaagagagacactatatgatgatagttaagaacacagggtctaggcagccctgagttcaaaacctgattctctgcctttgtagccttgtgagtttggccaagttactcactctctccatgcctcagtctcttcttccataacatggagaacatgccatttagaattatgcctggtgtgtgataagtgccatgtatttggggctattacttatgttatgggggcacaaaactaataataggcatggttagcacaataatgagatatttgtcctttgtgtttctcaaccaaaattgatgactcttgtaatataggatcaacagtaaactgggaccttgtcatttgcatttggaatagtaggtaacagtaattagatgagcatttgaagaatacatgagaactcacatataggaaaacaaagtaggagtgtgcattttgtatttaaacataatgaagcatcagctcttatgtatttatgaatggagaaggaaaaaaggtcattcgacttttgttgagcaccgtggattactatctttgatgctgtcatttgaaataacaaaaactgcctctgcctttccccagccctactattgaacagaaagaactggaaggagaaagagtgccatcttttagaaatggttcctctgagtcatagttatcccttttgagtaccacatcaaaggctctatttcacctgagaaatctcatacgcatttcaaaagtcaaactgtaataacaaaacctacactacctataatgtcaaaacatcaagcaagatgtaacaatctctctcatatcctagtctcatacatattggtgtgagttaaggacaaaggtacttttgactttaagacagtaagaaatgtgaggtcagtgtccttgggaataactagaaaccagagatatttattgcctagagacaacgttaagatgatctcagaaaggttttctttggaatggtggagattaagtggcaaggccaggtattcttgttaccaaaataaatactgcttaagcaacagcaaacatgggagagggatgacagaagaagggtttctctatccctttgctggagctaaagtaaaacaggcaaatgattttgaaggctcagcatttaaatctaccatatagggtttaactattggtgctgtactgctgtctgttgatagaactatgccttctcctgaagcttcaaactttagttgatatctcaggtagaaagtgtgttcttcaacatctttcatagctttggcaacactgatcacgttgctgaaatgcctcctcaccggagatcttaccacctgtgaaattctcctcaaccctgctctctgcctctgaattcctggacagaattagagctgatatacaagaactcccaaaggcaagcctgcccagacagtttttaggttggtagttcactgtccaggggacccagctgccactattctacaggcctttttccaagggtaacacaataatcacaatagataataacaacagagaatgtactatttttagcatttcatatccattgtctcatttgatttttattactatgccggataaagcaatggtgctaagagaagtaacttgcctgaaatttgtatttttatccattataattcgttgcctctctaggatccaatggccccttagtaaaaaatactgatgctttaactctaggttcccaaatgccatttagctccccaagcatcgtactgtggcaaaaactacatgcactttgaaatcagatctgaatttgaataggttctgttacttgccagctaggggaccttaagcaaagcttcttaccctctctgagcctgcaacactcaaaaaggattacaaagcactcacatattaaaatgagttaatgaatgtgaaagcacctagaacagagttttgaaaatagtacatgctccgtaaatatgaaattcctttttcttctttcccctttgaatacatgggagtttcctatacaatgctttggtattttaataagatggtcttaattttactcattgcatgcatcttgaggccagtgaagcactaacgcaattatctctgtcaagccttccagttattaaaactaacagccatgacacaaccttctcagttcaggcagcccacctatatttttaatgggagtattggtatatttacagtctccatcagaacaaagttctgttattattttgactctaggaccattattttatgtgacagtgactttgtcagaggagagaaaggatgtgactttaaccctggtttttaaaaaagagcaattttcctattataaactagttaaaaactcttgttgaatagcatattgcaattgatgtttggggtaatatgccagttttagcaagaaataacacgaaatagaatgctccaaatttattatttatttgcacctgtgctcacccacttattttccttcagccttcatagttcttcagatatttgatgagtggtgtaggtgatgaatgaatggcacatgtctgtaaaacactaagctcagctcaagacctgcagatcttcctagtgaactaaccaagtggttcagttgataacacaagtatagtatcccaataggtttagaccctgctctggactctggagaacattgtatctgtttatgtcattctaaaacatagccaccctgttgcaaagagtttcaaattttggagaccagagacccctttgagaacgacatgacttataaatctttggaaatgtgagtcttcggaaaaattcacaaacacacacacacacacacacacacacacatcccttttggatgtaattccataaagttcagtatagcctagtgattaagctaagggctttggagttagataacctggcctaaaataatgaccctactgctatttagttttgtgaccttcttcaagtcatttagtctctttaaatttcattttaaaaatgggaatgaaaacagtacctatgtgatgagtctttatgagatttaaaggagataaagcatgtgaagtgctcagcacactgtatgacacttactaaatgctttgtacatttttgttattttaagggagttacagatctccaaagcttatttgtgggcagcagattaagaatttctgctatgaaaagaggacaaagttcaaaccaattaaggaccatctgcctaccataaaaacaagatcctattgaagttaaataactatcaataaaagggcattcaacaactaggtctgctaccctgcctggccctgagcaagtaggacaatgggtccagccatgtccctgttctttctgaggagtggcaactgtgcctcctactgcacccgcctgtaccagccatggctgagaacttggcagtcatggatgctctctacacttgactgaaaaagaaaacagcttcttggctgtctgagccttaaaaggtgattgtcctattcctgacatattctttacaaagttctaggtgtaagaaaaggctgtttcaggttttaatgagagaatatttgttagagagaatatttgttaagcgcccagcttaaggacacacacaaaactatcaacaaatgccatctctttccaaaggtcaagagagagggtaactttacttgacgaagtcacagctctgggagaaattccactgacactcaggggactaagttatgtagtttaactaaatttgacttgaaataagtaggcatttaagagggcttttctctggggattttacacatattttgctgatgttgtattttaaggtatcctattttggtcaaagtagattctttagccaaatcagtacattttgaaatgactaaaatatctagcagccagcaagttcagatacactgatctttaggaggaaatagccacaaattgaatagtacttaaagaattctgtatcattttgctttgtttcagaaagattatcacagggaaaagcttagttaagtgactttaatattaatatattcatttctgtatttccaatatctagcataattctcacaccaggtataggaaagtgataactatttattgaatgaattttctatatatgtatgtcaatatccatttttaagaactccatggtcaggcatggtggcccacacatgtagtcccagctactcaagaagctgacattggaggatcacttgagcccaggagtttgagtctgtagtgtgctatgatcagacctatgaataaactaggtgaggggaaatttactgtgcaaatacctgctatggctgatacaaggtgcagattatagctctatggtggcctggagaacctcacacttcttaatgggttctctaagcaggtgaccaggagaatcactattctatttttgataaagtttcactgatcttttttcaactagtcttaccaaattctctgagcaacacctgctgcatttgatctcaactcaatttcaactccactggggtgcatgggtgggaacaagagaaaaataagggaaatatttaagtaaatgaaatttagcaatgtcagaagagacagcaggacaaattgcaatcaataatccaccagcaatgctaatcacttaaaattgtacatttacattttccaatgcaggaataatgatatcaatatgaataccaatgacaacagtaacgataatgagttcacatttattgagtatttactgtgtgctgtagactgtgttaaatcatttgcatggcttatttcatttaatctcacaagaatcccaggtggaagagactggcatttcctttcctcctttatagataaggaaactgaggcagagaggagttaaataaattatggacagatgtagagccagtgtcagagcatcaacataagaattctccatcgttatactggcttttctcacaatatggccttagaattacctgggatgcttgctaaaaatgattagctctcagtgttatctaaagcaaatgaatcagggtcttagggatgaagatcaggactctacatttaagagacagcaggcacagtatttcttacgtacatcacagttggagaaccagtgtctgagcagtatgaatttcacagcctgatactgctacatgaaccagattgagtaaaatgattctcgtttttactatagagtcgtataagagagaaaatatatcacaacattaaagagaaacagtaaaatcacctcaactattgaaatcatttcaacagaggactcaacttctgaattgatcatagagatataactgcttttgaccagctttagaaggcagatttttgtatttgtctctcatatggaactggggcctcaatttcccatttgtaaaacaagagtgtcggactagacaaaattttataaaactgcaggtttaaatattaataaatatataaatgttttcccttttttaaaaaagagaattcactatacaatttcttaaaataaccttttttttttttttttttttttttttttgagacggagtttctctcttgttgcccaggctggagtgcagtggagtgatcttggctcactgcaacctctgcttcccaggttcaagtgattctcctgcctcagtctcctgagtagctgggattacaggtgcccaccgccatgcccagctgatttttgtatttttagtagagatggggtttctccatattggccaggctggtctcgaactcctgacctcaggtgatctgcctgcctcagcctcccaaagtgctggaattacaggcgtgagccaccggaactgtttttttatatgtaggcttaaaatttgttgtaaaaactatctggaagtatatttagtatgtcttgacaagtttagacaccatttaaactctttgacccagtaatagcatttccaaaaattttgccaaagtaattaaccagagatacagattaacatttcttctacaaagatgcttagtgaaccactacaataaagaaaaaagaggaaaatttaaaatgcccaacaatgaaagaatggctaaatattgaataaatcattttattacatgtaaaatggattcctatgtcaccattagaatatcagatttttctagaatcctaaatgacacgagaaaatacttcttaaaaatgtcaagcgaagaatgcagaataaaaaattatatatatatacaggctgggcatgttggctcatgcttgtaatcccagcacttcaggagttcaagaccaccctgggcaacatggtgacaccctgtctccactaaaaattcaaaaattagttgggtgtggtggggcaaaactaaaatcccagctactcaggaggctgaggtacaagaatcacttgaacccaggagacgtaggtttcagtgagccaagattgtgccactgcactccagcctgggcgatagggcgacttcatctcaaaaaataataaataaaaattttcaaaatttggaaataatatatgtatacacacacatatatatatatacatatacatacattttaatggtcatatatatcctattatgtgccagatgaatatcaggtaggtctctctctctatatacacacatatatgtatacgtgtacacacatatgtatacacatatatatatacatatatacacatatatacacatacatgtatgtacatttacatatatacatatatatgtatagatatatgtatgtatgtgtgtgtgtctgtgtgtgtgtgtgtgtgtgtgtgtgtgtgtgtgtgtgtgtgtatagagagaccgacctgatttcatctggcacataataggatatatatgaccataaaaatgtatatatatatatatatgtgtgtgtgtgagcatgtttgtggggtatgtgtgtatatgctttaaaggtttattcaggaaataaaccaacacgttttaatgatggctatccctggaagctgcaatgacaggttatgtgtattttataaaatattaataaatattggaatatttattgggaattttctgaagttcccaatttgtccacaatgaacatgtgtttattttgtagttagaaaaacatgttattacaaaataattcaataggaaactacttttagaaatgcatttatgatgcaaggtgaagcatatctgcaacatgcttcttgctgacaaagaggcctctgaagcaggcctcaccaatgttcccaacgatggtaaatttggcaataattgtgttgttaggggagctccaagcttaaatgctgcaattatgagctagggtacacaaggacatgttggaagtgacaggcaatatcagcttcctccaaaataatggtcaagcgaatatgtgcttttgcccaaaaaggaaagtagcacagctgtaactggatattgtaaataagtggtcaaaggttccctaaataagcaatatcatataagcctccttgaggcatattttttccttctgggagccgtgttaggctcacagacatgaaggcagccaggaaactgttatctgtttacttctaatttatttttataactgtccatgccagcaacaacaacaacaaaaatgtttctaggagaaaaataaatttggcaataaactctctgagttttcgaaaaatcttaccaaatcaaaaacttctacttatcatgttgctgtcaaacccagcctcataaaaactttacttataattgagtgtatgtatgtctatctgtactgtaaccttgatacttggcctcaaatcctggttctgccaggagcttcgtgcctttgggaagatttcctagcctctccacatcttgcttttctcatcttaaatgtagacaatattataccatgcagggctctgtgaggttgaatcagaaaatgccactaaactgcaaagcacaatcccaggcacattgtaaaaatggaaaaatcagcttgattccattcccctcttgccatacaaggatatttcaggtctctcaaaagcgtttcaaggaatagaggaagtagtcaaacaagtgtgtgtgtgtgtctgtggatgttggtgtgtgatgaaatatacatataaatattatatataaatgtatatattatatataaaatatttgtaaggatggaataactagtatctgcttaaacaacaactacacttcgaaaatcctttatttttcctgatgagttttgttcaggtgaagatgttcactggtaaaaagacaaggcaatccatttcttttctacagtgtcagctttgtttgaaggacacaatgacatctattcagaaaggtaccaaccattttgcttttaaaatactgaggcaaacctctctgaggtttcttcaaagccaatggcaacaaacatatttcagcatctgttttgcttcactgtaggtctgtgtgtgggtaggttataaaataaaaatgagcttgccattacagatactacttaaaaaccaaaaaaactatgatcatgatgttgataattctgtattcattatcctaataaaaacacataaatgtctagaaagaaatagacaattatgtattaggccttccgtctcttatttaataatagcagtgtcattgctctagttaaaacccgctctgatcttaataaatctgatgtaaaaacatatcaccagatggggactctgttaatcttatgcgatactttcaactatgatgactaatagttctataatttttatatggttgctcttattgaggaaagagtaaccatttaagggaatcttccaccactgttctttgttgaaaggaaggctggatctacatgcatgccaacatactactgaaaagtaaatatgcaatccaactattcaacaatttggaatcattgcaatttttatagttccagatggtgatctttatccagatgaagtgagactattttactactttgtcagaactctacaactaaatatttataaccctcaaatacacagatacattatcacagtgtgtgtgtgtatatgcacatgtgtgtacacacttttatagaatgagaatgaactaggttttgtaaaagtttcagttacaagccacatgcctatgttacacattctgtctgtaaactacctacacccacacacatatacattcatgcaccaatataatatggttttcaaaatcatgtcacatagttgatctcattttatctcaacaggaaccacagtctaattgaaataaatgcctctgccatgaaactaagtcagttagtaactgtaaaggagttgatttacaggaatatctattccatggcctagctaactgaactcattaatgacacatgttatgtaatgcttgttaaattagtgaatgctcttacattgaaagacacatagtaaagtgctgaatttcaggaggtgagctagtagtttcaatgtttgtgggcaccatttaatgcataggaagcctgcatttattgagtaaaatttagagaaaaaaagaggccctgcccattgtaactcaagattaagggcaacttcaatttcccagagcctccgtaatgggcactttaggagaggtgaatatggtttgactggatagagtacaatggctttttacattgataaaatttgctgtacaattgtttactggtgaactttttaaaaatggaaatagaatgtaggcttcatatgttactaaggatacccttgattatgtaataggcacttgcattacaaaaaatgaaaatggctgaataggtagcctgagccatagtttctgcaacctgttctcctttccagtgttattaatcacttgaacctcacctgctgctctggctcctcctccttgatctttacagatatgactttaggcagaaacagattcaggagcccagcaccacaccatcctgctgcagttaacttgaacatacgtcttatctctgattactactggcttctgctttaattccctgtgcttatcttccgtccctgagactccagtccacctggccttccaacataggcttaagatactctcttcctgtcccatccatgaactgcaagctggtgtatagagcttcctgaagtcacatgatccagacaagtgattaccaattttattggataccgtatctattagtaaaaaaaaaaaaaaaaaaaaaaaaaaaagtgcaagcacctccattacgtatatttattttcaataagttatgttcttgcactattatgtcaaaatattatctattttacaaaatacaagaaaaagaaaatttgtgagcggataagaaaaaatataagattttatttccatacctcaataagttgtcctgttcacgcctgggcatatgtctaggaattacctgttctgagccactttttaggagactgttatgttttgcccccaaagactagtcagggcacactattgccaatatgcctggctagatggagcttttcctagtgcctggtgagtggttcctgctcttgcatctatctgccaccttacccacctaccacccagtcccatcagcctctgcttcatcccagtgaaagggctcattgcggattccaatccttatcattttgtcttatgctactgtaattaaataatcaactccctgggacaagaaaaggtaaaagtttcttcaggagttagcaaatggctacaagcaataaaaaggtttagaaggcaaatagaaatttagttacatcattgttatagttgtaatgtagtatgtttctctcaatgggttgcaccagagttcttttttttctacttgtttctattgagatgttatttgtaaaatgtaatttatatctgaggtgtctacacatgatagatgatacataaaattttatctgtgacacaaagcaataagcaaagtagggcacatgtaacaaatggtcctgagacgtatagtgggaaaaaataaacttgtatccctaccttatattaagataaattccaaacagattaagagctaggttaaaaaatcacaaatacggaaaatgtagctaaacatttatctactcttaagataaaagccctcaaattattaaagcaaagaaagaagttacaaaagaaaaaaaatcaataaatttgactgtataaaacaccatgaacaaaagtaaaaaggggactaaaaattggaatatataattacaataaatgtgagctggagaaggttcatctatctaatacataaagaactcttgcaaaaagtaaaaaactatgcaaccccaatagaaaataagcgaagagacaaacagaaaattaacagaagataaatggctaataaaaatattaaaaccatttttattcacaccagtagtccaaaagtgttaagtaaaacaacactgaaataccactttaacctaatatgtggataaagattttttttaatgaaaaacatttcctgcagcagcacagtaagatgagaactctcaagcagtgtggcttggagtgtaacctggtataacctttagagaagtattttttgcaacatatattaatagtcttaaaatagtcatattctttgacatagttattttactaaggaaatattcagagataagccaatgtttcagttcaaagatgttccttgctgataattttaataattgggaaaagctagaaacagcctgaatatccaataattggcaaatacataagttacaaaatctttttagggtgaaacattttgtatccatataagtaatgtttgaaataatgttaagtgatatggaaaaatgctcatgataaaatgctaaattaaaaaaagaaattaaaactgtacaatccaggtaattgctattagtatcatacttgcttggaaaaagaatagaagaaaataactaagaattagcagtgattatttgggagtgtgttgaggttatgagaaatttatatttgtatttttattttttctatacgtgtgtcgtattgtgtgtgtgtgtatatgtgtgtgtgtatgtttaagagtcttgttccatcacccagggtggagtgcagtggtgcaatcatggctcactgcaccctgaacacaatcctcccacctcagcctcttgagagctggtactacagggacacaccataaaaaaataatttttattttttattttttgtagagacagggccttgctttgttgccaggctggtctctatttctaggcttcaagcagtcctctcactttggcctcccaaagtgctgggatttctggcattccaccatgcctggcctcttgctaggtttttaaagaaacctagaatgcacataaattgcctttataataaaaactattttaagggctgggcatggtggttcatacctgtaatccaagcactttgggaggctgaggcaggcagattgtttgaatccagcttgggcaacatagggagacactgtctctacaaaaaaaaaaacaaaaaaaattaaaaaaaacaagccaggagtggtggggcacgcctgttgttgcagctactcatgaggttgaggtgggagtatcgcttaagcatgggaggtcaaagctgcaatgagctgtgattgagctactgcactccagcttgggtaacagagcaagatcctgcctcgaaaaaaaaaaaaagaaagaaagaaaagaaaaaaagaatatgtaagggtcattgtgccttgaatataaatattttgtagattatatgacaagaattttaaattaatgttttcctatttggataaaatataaagatgtccaacaatagaatgtagttagaagctgtgaaatacagaactagaaaaaactttttaaaattcatatggaaccaaaaagagcccgaatagccaaggcaattctaataaaaaataacaaagctggaggcatcaccttgcccaacttcaaactataatacaaggatacagtaaccataacagcatggtactggtacaagaacagccagatagaccaatggatcagaatagagagctcagaaataaaactgcacacctaggaccatctgatcttcgacaaagctaaagaaaagcaatggagaaaacactccctattcaataaatggtgctgggataactggctacccatatgcagaagattgaagctggaccccttcctttcaccatacacacaaaaaaattcaagatggattaaagacttaaatataaaacccaaaactatagaaaccctggaagatgacctaggcaatcccatcctgaacatagcagcaggcaaagattcatgacaaagacaccaaaagcaatcacaataaaagcaaaaattgacaagtgggatctaaataaacttaaaagcttctgcacagccaaagaaactatcaacagagttaaacagacaacctacagaatgggagaaaatatttgcaaactatatatctggcaaaggtcaaatatcctgcatctataaggaacttaaacaaatttagaagaggaaaacaaacaaccccattaaaaggtgggcaaaagacatgaacagacacttttcaaaagaagacatacatgcggccaacaagcatatgaaaaaacccttaataacactgattattagagaaatgcaaatcaaaaccacaagataccatctcataccagtcataatggctattattaaaaagacaaaaaataacagatgctagcaaggttgtagagaaaagggaacacttacaaacttttggtgggagtgtaaattagttcaaccattgtggaaagcagtgtggcaattcctcaaagagctaagagcagaactaccgtttgaccatgcaatcctattactgggcatattcccagaggaatataaatcattctaccataaagatacaggcaaacgaatgttcattccagcactattaacaatagtaacgacatggaatcaacctagatacccatcagtcacagattagacaaagagaatgaggtaaatttacaccaaggaataccatgcagccataaaaaagaatgagatcatgtcttttaacatggatagacctggaggctattatccttagcaaattaacacagaaacagaaaaccaaatactgcatgttctcacttataagtgggagctaaatgatgagaactcaggcacacaaagaaggaaacaacagacattggggtctacttgatcagggagggtgggaagaaggagaggagcagaaaagataactattaggctttgggcttaatacccgggtgatgaaataatatgtacaaccaacccctgtgacatgagtctacccatataacaaaccttcacatgtacccccaaacctaaaataaaaattaaaaaaagaacctgtgaaatgtttacatatttcatatttgactgtggacaaactgctactctgctatactttatttttaaagttgtattgtaaagttgtactacgttccccataaagcaaactatccaagatacagtccagcagagtgcttaatggccataggctttggtgtccggaagtctaggttggagcactggctctgcaacagtgtgcaggtgattttatctctgcaagcctcagcccaactaaccaggtgtgtaattgttttcccctccatggatgccttgtaaatcttattttctaataactgaataatgactgaatatggttaaccatatcatctgggttttttttttccccgagatggggtcttgctgtcacccaggctggagtgtagtggcacaatcacagctcactgcagccttgacctcccagtctcaagcaatcctcccacctcagcctctcgagtaggtgggactacaggtgtgtgcaaccacgcctggagaatttttaaaaatatttttttgtagagacagggtcttcctatgttgcccaggctggtcttacattcctggactcaagtgatcctcccacctcggcctcccagagtgttaggattataggtgtgagctactgcacccacccagccatcatctagattttaaatgccaaagtgataatatggagcagatagaataagatccagaaataaacaaatacccaagtgatactttcattattgctttctttcctaggtacccttgctccccagcataacaacgtgcacacacagtcgtagcccagccatggttcttagcattgcaattagatcatcatcatcactgaagtcacattctctagtcacattatacataaaaatgtcaaagaatcttgccccctctttttttgatgagggagtaaactaggcaactgtgaggtttttacaacataaaattctttgttaactctgttgacatttggaaaaatggctttatgctggctttacagcagcataatctctatttgtttctttaaaaatgctgtgattagttactgtcttttcctttaaaataaacaatagtgctgccaaaggaaaaatgtataactgtttgaaaggaatacattttatgattaacatatctttatatataaacaaaataaaatatgacttctctctagttaaaatcatcttcataaacaaatacttcaggaatagattgttaattggcaagctaattggatgcggtacttgttctgggagcatctttattacttccattactcaaactccctccacctgcaaacacagtcactacacacagcgtactcctcattatcacgatgggatatagatgatgattgaagaaaatgtatgcatttttttcattaatgattttactcctctcaaagggacttttaactctaagtaaagtctgtttatgaatttctgataaaaccaaattattttacattattaaatttcattttcatagaatctcttttctatatctttcttaatgtacttttaggcaaagtcaagttatttttcaaaattgggtttggttagaattttgatcattaaaaaggatattaaattattcttcctccagctggaaatcaagccctctatggcaccctagaaggaatcatcactcagtgaggagtgatgtcataggagtgttgaataaataaatgcttaatgaatacatgagtgaatataagaatgaacaaatctataaggcaaacgaattttgattctttcctatcatttaataaggcaaactaatttaaccaaaggcagaaatcaaatctactggtgtgtttcatgtataaccactataggtaggttttgtcttaaaaaatagaaaagcccaaaataagacagctgattctcaagcaaagatgagaacaaacacaaagcccttccagagctacatgatggaaactgtgcggaaagtaaagactccctcttccagtcaccaacacatgatacttggagaagaatgtacaaaaaactgggaagcacttcagacagactgcccagctctatttgctaataccattaatgattagttcacataccaccctcctatttctcaatcccaaggttcactcagatgtctaccctagttttccctcctattttgcttttgatgtggattgatttgaataaaacatttaagaaacactaatttagagtaagagctaaatgtctgttttttaaatggtgtcttggcttaaagatagaaaagcagtcattaattttttgtcctaataactaaaaatgatgtcaagcagagcagatggcaagaagagtgcttgtacagcactaagcacctcatggtgccggatgactcaaacaaagcacaggtcaagaagcccctggcctgaccaacattggtcagaggagtccaggaaaatacatttcttcttcttcttcttttttattttttacatttcttcttctttacattaatgaatcaaattttcaattgaaaaattaattagcacacatagtaaaatttccccaagtttaaaatggtgagtactcagcccccttctacctcagattccaaacgtgtagccacctcttcctcaaagctagcaacttctaccatcaccttaagtgcatacgcagaaagatgcttttgagtgaaacatatttatgtatgtacagtcttagcatatttttccataactgggaacattgtgccttaacttttccacttaaaaatacaccttgactacatcaataatgatgcagccattcaagagaataactttctgctgtaagaaacatgagaatgcagatacactggaaaataaccaaaaggttaaacttagagctaccatttgtcccagcaattccactactaggaatatacccagaagaaaggaaaatatatgcacacacaaaatcttttgcataaatgttcattgcagcacatttcaaaatagccaaaaagtgaaacaacgcaagtgtctatcaactgatgaataaataagcaaaatgtggtatattcatataatggaatattattcggtcctaaaaaatgaaatctgatatatgctacaacatgaatgagacttgaaaacattatgctaagtgaaagaagcaagtcacaaaagacctcatattatataattccatttatatgaaacattcagagtaggcaaattatagaggaaaaaaacgtagattagccgttgcctagagctgtggggtggaagggaggcaggtgatatggagcaggtaatgggggagatggagggtgataactataaggtaaggggtttcttatagtggtagtaaaatgttctacattgattttggtgacggttgcaaaagtgtgtgaatatactaaaaatcacgaaattatacaccctgtattgatgaagagtagggtatgtgagttatatctcaacaaaggtcttccagaacaacacaagaagcttctctatgtattgacacactgtcaagtgcaaaatacaaactgcagaacaatgaatgtgcagattatacttctttttgtttaaaaagggaggaagagaatagaatttatgttttcattgcacttacataaactctaagagtatatacaaagaaaactagtgaaaatggatacatgggagtgtgcatatcttcttttcaaagtataaaaataatacaatagtaaatgtcatctggagatagtgtcatactagagaggtcttcctcatagatgcacagtattgtcttatagttgtgcatcagttgttcaatcagccatataccgattgacatttaggctttctccagtgttctgttacaaaaactccagcagaacatttttgtacatatattttttgcacctttacacaagtacatagagtaaatgttaaaaaatgaagttgctagataaaagatagacaagaaatccttaaagtaatgcagctaaagaatatcccttaaatttgttgacaagtatagtagctgtaaccccagtagtattttattgcaattactgagcaaaatacactttctttctgataagaataaatgaaaacaggatttccccattctctgtagttagagcattaaaaaggaagcacaataacttccttttaaaagaaagtcagacaaaaaccaaatggtttattctatgtaagctctggaagttgagaaagagaagcctccttttaataggcatgaatttgtttgaattcattatgtggcttctcgagtgctctgcagatttaaaatgacctttcagcctcaaagtgggagtctcagagcaaaaggatgaagagaatctgtttcaattaagataaacatcaactaccaagccccaattataccatttgaatttgaaaaaggcaaaactgttgtcaaaaaaaattggaaagcatcaggacagcagtaaacctggtaaaatttaattgcatcacgttttgatgatgttactgagtgttcatggaacgtagggctatgtttggatgcattcctccttttccttccctccactctccctggctcattttggagttgtttttgagtgattctatttagctgcattggcatctttacttaaatggacatatctgtgcagagaaaaccctgttattcattatggtcaaagaatggtagatattaactaacaactacgtaaatatactaaaaatcaatacattatataacctctatagatgaaaagtatggcatacgagttatatctcaataaagttcttccagagcaacacaagtagcttctctttgtatcaacatactgtcaagtgcaaaatacaaactgcagaacaatgaatgtgcagattatgctccattttgtataaagaggggggatgagcatagaataataaagtgatacatacatctttaataaatgttatgatgttgaaataattacaatgcaatacatttcatactaaataaaaatcgtatttagttacttttggttgttattgttgcttttgtcatgattttgctgttttgtgaccaaaaatatacttgagaacttgcatacatgaggaaaatgatcgtggcaatgatgtgtgatgggtttcagttcatacaggccaaactgtgtttgctgtttgaagctgatggaacccattcataaactccttaagggtggccaggaaaaagaacaccacatacatcctgagcagtctttccagtaagaatatcagtacctggcctttgatatgtgtggctgtcatgctcatccctactgcagtttggggaaccacggcttacatctgtcttttgcatcaaccatgtcattcatccagcaggcacatcctattaccagctgaaggccaatattacattctttgggaaaactattccaaccatttggtagaatttttttttactcacatatatctactatccaattacatttagaactcagatcagaggcaaatttagctcagagaggcattagaacactgaaatctatgcacttatggcaagagagaattcagcgagggttgcctggtgtgtcacttgctacttaaagtcaaagtgagatcttacacctaataaaaatgctcttgtagtttagcaagtcaaactcttgggagggtcttaaactttgtgtaaagagaagggatttacagcagcagaacattttcaagggcacttttatgtcagaagcctttccttttttcctaggtgaagtccactctctctgacctcggctcaccaaggcccctgggaagacaggctagcaacagaaatcaggtcagatatgtacagaaaacaccccagtcaaagacaaacactggagacttgtaggtaggaaacccatcatttcacgttgtccaacttttcactggaaatctatacatgagtgccatataaatttaagttcttaagacagcaatctttcacttcttttcctttttaagtgattgaaaaagatagcctttctgctcctcatatctgctggatattcaagacctttgtacctgctataatccccttctccccaatgtttgtttgactggttctttcagttctcaacttccctgaccactccaactaaagtacatctctaggacacacagccacaaagagacacacagacacagacacacacccatacacagacatacacaaacacactgtttaactcggtccctcctgtgttctcttcactggacttaaaacacaattaggaataattttatttagtgaatttgttttgcttggtaagctccaggaagggagggaggcaccattgcatctccagagcctagcacagaaaggagataaaatatgtattttttctgtatagaaactaccctaaataaaactgtagaaaattattctaaataagaatcttgctgttgaactattttatatataaaagtatatttatttcttatcttcttgtatcatctttgtaggctactattaaaatataatttacatatctctaagaactgagatacattgttatatcagttagaaatatatatcatatattatatatcatatagataacatatatataatcatatatcatatcatatatagatatatatatcagttagaaatatcagacatttcagtttagaaatagcatatttctaaataatatacaatttagaatataagatatatatattttaagaagactatgtcaaagaagtttcaaggccagatttagttagaagtgatactgatttttttccacattcatgtgactttaacagaataataaatttagattaaatctaattcatacttttattaattttcaaattaaggaaaaattaagttttacctagaactgttaagacattttcagtaaactttccattatcatttcacttgtgagagatcatatacatgtcatatcatacaccattttgtaaatggttaaaattctcacattctcaaacagtaacttgttttaagactaacatgaaaacacaaacataaacaagaaaatattaataggagtttttcccttctaataataaactggctagcattttttttggtttgctgtgtccctaccattacttcaagcactttccatgtattatttcacttaacattcacagaaaccctatgggtagcttttcccccttgtccaaaatcacccagcatgtaaaagaagatgagttccaaattcatttgacttcagaatccacccccatctctccagtacatattgttggcaattccaaactgccctggaattttaatagctcagctctatgttttcctacagcctaacaaaatagaaatactttgaatgaagttaagcacataaggtctgacttcgaaatgataccaaggtttaaaactagccattaacttttacatggaacaaaaaggaatatttataaagccatacagaacatggccatctggcctactcctgatgcaagaagctgaaacatgcttctgaaaactaagtgctttttatttctttctttagaattgttaaaagtttcttggataactgagaaaaaaaagaacctactttctcttgaggatgccagagtaagtatctttcatgtagcattaatgttctatttacccatcaaaaacaagggttaaaagcaacggttacacagagtccctccccaagcctctcatatataatcagaaatatcctaagggaccaattattttctattactcctattagtcagaaattcacatattgcaaataataatttcttctctccgtcggtctgaatgaatttattcaggatgttatactaaattagaaactgtgaggattatgaccaaacaagtttccatgaatttaacatttttttctacaaaactttataggatttcacaaattccagcatcagttgatacacaagggactcccctttctattatctgactacctgaatctaccctgtcttagccaaaatagattatctgttactcctttaaaaagattgtcctgagagtctttttttctttttctccccaagttggttcccattctgaatttggacactaacgaacatagaaatcaaagactgtaaagcaactatttattcagaaacatttcagaagacactaaggtttttatttagtattcaattaagacttgcctcgaaggctgggacttctttatgtgaatttgaaatttacagggtatgtcacacctacgctatatttaggatgcaactgagtgaagatgaaatgcctaaagcaattggcaccaagggaatttggtactttaaacattttggaaagcccaagattgcatgtgtagttacatttcctatattctttctctatctcttttatacacttaacacacaaatggcatgaattacgaaagcaaatgtgtttggcactttgaacaaattatccatcttattgaagtaagttagctaaaacttttctttgtgtattggaaatttagacaattgtttgactattaagaaatgatccatgggaaatttgaaagataaacttctgtactttattcaggaaattactaacaatttataagaaagtcaaatcgtcaatataacagaaacagtgaaaaaccaaaaaaaacaaagcttcaaaaaagctaattacttaaggagggatgaccaagcatataaagctaagagaagggagaggttcaaattagaaattaatttagaattcaattaaaatcttataagtaacgtttataaagcttacaaacaaaatcttacagtttttcccgattactggctaaagtttataaaaatcatttatggaatttcccacaatatacaccaaaaaaaaaaaaaaagcagaggatagtaaatgggatgggttttaaagtcagactaagttcaaaactagccatatagaactggagctgctgtaactgcacacaaatggtatagtagtccagatgtatgactggcagtcatagaataatgtggttcattgtgaaagtcagataataatttgatattttgttgtaaacaggttttccattcttgcatggtgcccttttatggcagttgtaatccttaagggcaggccttttaactgaactacactaggacataaatgccatttccttctgatttcctgcattgaatctggtctttgatagtccattcgaaagtttttgttagatccctatttgatgtaatggccttacttattaatgcagttatagccagggattatgcacagtaacaaaggaatatataacagcactcaagcatagtaatagtaaaatgagtttatttagagagctgacaaacaagctagtagcagttatttatagaaagaaaaagtttatttctcttattagtgaaatagagcctcaagcattcaaaaaatattttaactagggcctataaaaataaaggtctcccgaagattatctgtaaagacagattttggcaataagtgaaataatgccttatattcattttatgagttaattttgtataaaattcacttttttccaactattttttcctgatgtgccctttttgtgttccctctctacagatacattaaaatgttctactctgtatattttatctttgaaaactcaaaggctaaattcattaaaatgagaaagaaatctgttggttttaaaatttatttaaataaaaataaatttaaatatttaacttggctgacacagccttgttaggaggtgattaagtaaacaatttacctagaataaaaatatctcttattaaaatggcatggatttccaggccagtaagaaaagaaaatatctctctaacccagggaaagtattttggtctaaaaaatcaaatattccagatttattttatattactccaccccaaattcaagtagggaggttttaaaattatgttgtttaccactggatttctggaagcaactgaaacacttatataaatgcacactcctaccaggaaagtaaaaactattccaaggatatagtagaaggtgaaatagaagtctcctgccctatagaaatacttcagaaagtcactagaccataaattttatgaagccgagtgctgtatatttcaccattgtctctctaacagccagcagggtacctgtggcagaacaagcttaataaacacttaaataaagcaataaaaaatgcacctttacttttgtaactaatagacccacagaaataaaacttttctttaaggactatatattttaagctatagaactagactaaatgatcaggtagctagaaaatgtttctgtacaatactaaaacaaattacttcctcattattaaggattaagccttaatttccttctttttttttaagcctaatttcttgccattccaaatatttaagtctgggagtgtggtaaagctaaaagctggcttcacaatcggaaaagttcacaatacaagaaggtaagccaaccctaagttgttccctgactttgaaggtcgggggtcaatccctgtgttagggctccaggacaagcttgtcactttggttcagcatccctcctgtggaatctgctcatatgtgacaactgtgtggggtttcaagatgcacacaatgaggttagagtgagcctgaagtggtggtcttagtacttaccaccaacagatttcttggcttcatataaaaatcacccattgatagagtcagaaggtcagcatgtcagtcgggtgataaccatgtgcaacacatttatcagcatttctatatgcactactctttactagtttatgacacgagaagagtcattcgagcagtcagaaaatatagaggaaaacttggaagtatatattttagaatgggaaacacaggaggcaatggaaggtgtgcctagattagaattgccagtggtggtggcaaactaagggtgaaagaaagccacagggaagaggcaaaaatcctcccggatactatacaactcttgccataaagagtaactactgtgtctacaactcacccagtacaatctcctgaaaagtgccatctactaaaagaaaattaaaaataaaaattgactgtaatattctttgtaatatggaagaactcactgttctactttccatgcaaaggacagatgttgaatgcccatgatggagcaggcatggtgctgggaacaggggttcattgctctacaaagatgagcaaacccagtctactccaaaacatgctcacaggagaggtacgtgagacagaagacaataattgtaatccttcaagagttagagaaatgtacaaggtttcatgacagcacagagaagagagttttaattctaattggggaagtctaggaaggcccttcagaagaaatgtccactgagggtgaatctaagcaacagaatttggatattaaatcatactaaaataattattgtaaaatgacaacagtttaaaatgctcaaatagtcatatataccaaattattatttaaatagaaaatctgatttttaccctgaatttgtatctcaaacaaaagtttgcttaattacctatacttaagtgagaatgaatgaaccatatccgcatcaacaagggatcatctttcaaacataattttgcaagggggtgagggaaacagccaaacacaaaagagtacatgctatattattccttttatataaaattcaaaagcaggaaatttaaaaagtttgtgattttcaaaatcaggatcactattatttttagtaggtgggggcaggggcttaaaggggcataaaggtgacttttggctgctggtactatttttaatctgggtggtgattacaggggtgacctttgaaaattagaattacttatttttcttctttgcatttgcaacatccaaaaagagtttttctgtttacaatatttatatgttcttcataggtgacaaatagacaaaacatatcaaaaaatacacatgtatttgtatgtatgcataaaacctgtttctgctacaatgactttatttgcatgcaaatttaatggtgagattagatatatagagttatgatgagatcatcaaggccatttaaatggcaagcagccacactatgtccctcttctgtctggcagagatcaccaatggatcacagcacattttctctgagaccaacgcagctctcagtacattattccaggcagctactgctattcgtaattacaagttgcccatagattaaaaagactagctatcttggttttaaacaatgcagactgtctaattcttttgatatttacatgaaaaagatcttgcaataatggagggatttcacatatatttctaggtaaacataaaatttcattcctatgtacgtaaaatgattttttcagttacacgaatacctttaaaaagttgtctgctaacatcaaatttgcttttttgtgtgtgttttatattaccctagaagctcttactgattcatatactagtagactcttaacgaaacacagaaaagtaattgggctatctctttttaaagcaaaacactcagggaatctttaatggttaattttttttcccaagctggtgaactccaccctcaatcacacttaatccaatgtgcagttgttaattataacaaaataatgcttttacagtttgttttgttttgttttggtaactactcataataaaatagtagatatcagagacaggaatgctaaatgcctgctctaacgtattgcattcttgacatttctagcccctgtggctgttcagctcatcctaacacttcacgccacaagaacagacctaaccagatctctatttttgtctgttgttctttagaaatgatggagaaagcatcttaagccttctgcactgagctgggatggcgggacaaaggaaaaaggagtccttctcagtctggtctgatagagatgatgaggctcagctccagggagataataatctgtgaattacacaaccaggaatgcaccttaggactagaagagtaagggatttgtagaggtagagaatgcctggcagtgtgattaccgtaggaccaagccacagggtggcacccagtaggaaagatacatggagaaagtctttacaaaggtgcacctagagataatgctcaggtagctgaccattcctttcagatgaaacccctgcctagttgtgcttccttagagggttctcattgagttttaaataactaaatcagaggtggtttagcttcccactgaccacttcttattttgccacctccactaagtagtttacttctttgacccacctagatagcagtgtgtcttctttgaatcacactattaacgtgatttatctggaatacctagctctatataaatgcttaattctgactgtgttaaaaaagactaccttatggaaaagaaacccttacaaaatgaatcagctttcacatttagagttcttgattatttagaaagtcataccaatgtgtaaacttcaaaaatgcataatataagctaacagttcctggtcactcacaaggagccagccatgtgctaagcacttcaggtagatcaactcattgaacatattaacatatacatcattgctaaaggtaacattttataattaagaaaatatgcgaatcatgaaattatcttatttgccactcaaatttaggcaagccactttacttcattaggcctcagtctgaggaataagactaatgagtactgtctaggattcatcatgaggatctaatgagataattaggtcaagtgaacagcacagtgcctggcacatagttaagtacacaataaatacaaattgccacaatttttaattcagatgaagactatattgagaggaaagaagtaaatttaaaatttcaagatgcgaattacagctacttacttagctatatgacataagtttaggaattacattatagctcaatacaaattataatagaactgctttcacacatttgcctgacagactaatttttagctctctttttcagctcaaacttcatttttgaagttaaaaaaatatttctccagccaggcatggtggtgtatgcctgtagtcccagttactgggaaggctaaggcaggaggattgagactaggagttcaaggctgtagtgcatatgatcacacctgtaaatagccactgtacctcagcctgggaaacacagtgagaccctgtctctaaatatatatatatatatatattcttcaacaaatctttttaccacttaagcattgacattgtttttaacagtttttcttgaccctacttgactggaaatgttaaagactagcaaaatgtttccagctccacattggggttaggggtggggaaaatcagattataggttattctctgtggtctcttttatttcaaaggttttatggtgctactaactggtcaaatgccagagagaaggaaaactgcaatttatagtctgaccagaggaagagagtcaataagctgaacgagtcaggaactagctagatctccaaggaatggagccgtgtcaaagtccatgttctatttctcaatatatctctagggctcacggttggaggcttgtatacaaatcttggggggaaaggcagacaaataccataggcaaacatgttcttgatatacataagattaaaagaagaaacttgaacagtctaggacaggaaggaaaagtataagtagcagcttgttgactacttttctaataccatgaaacagaactatgtgtagccaaagcagtttagatagtgaggaaaagcaaacaaaacaataagaacaacaacaacaaatatgggatgtagtttcgacagaccaagatttttctgcagcactgtaattttataagctgtgcgacttcaagttttattcatacagtttattcatacagttgcttcaactgtatatagtactaagttcattgtctgtcaaagagtagatgcccaatacattgtagctatcattaatgaggttatgactccaactatgactatagacctagaagctgctttctccagctagctggtgatctagctgccaatcagttacttgctattctataacaaagttgcagtatcagagcaaaaatcacagcccgctgttgcctatcccatgttagaatgccattggttaaaagtggacacattttacagtaatttatcctgactaaaatagtatcagtcatataaattccttgatgcaaagaaaaaactctgtgccacattgcaatggaatgacatcctgaatgttaggaattattattttctgtattccatatgaatgtctcaagcaagttcactaaaaagagctcaatttctcatctttgatgtattttaaacaagaaagagaattagatacaacgggagcacttttctctaggaagtctgaaaacaattacatactgaaattatgtttaatgaaacatttattttaacaagtcacactggtgccatctattttacaatttagaatgaatattttgcaatatgaaatgaaaaaagaccaagaagtcactcactagcagttttcaaaggccataaagaagaattggtttatctattgattcactctcattatatctactgacaactaagaggaaatgggttagaatttaagcaaagaagatttgtattagatataaagaaaacttcctaactctgtgggtttaaaacaacaggactgcttcctataagggtactttggaagatgcaatccttggtgtgcatacattctacacctagtttctagttttctaatttcttattcttcctcatgtgtagtagggaaatggaagggcttgcaggtgaccccctttaccctatggcagaaattcttagggctgagatggggggcaaatgtcctctacactgagtttcattaatggcagcttttgcccagaggttgccagtgttattaaacagggtagggtgctagatggtggatgcttagttcaaactgggctggaattcttccatattggtctctgtataatctcttttttcttgccacacttccccagctcttctcttgaaatattcccttgtgtttttctaactcttattctgaagagcagttcacccttctgttagcttctctaattcgcatcctcagccatcacccaggatgctcattagggagccaatccccttagaaggcttaggacagataataaatacttacaatattgcccctgtcatgctaaaaaactgcatccataggttctggcattcttcctactttccatacttttgaaatgctttctaatttaggtcaaacttgacaaagaactaggcaatttgagagctgagacatatcactggcacgggctctcattagttagttacctgtacacagttatatttaacagtgtctcacccaggcttgctgtcattgtgccccatgtggtaccccagcccttcccataggcaccaatccctggagagatttggtgcttgtggctgaagtataccttacttctgtccattttctaatataccttcaacccctgtattatattttgagatattggatcacctctggaaaggcttccaagaaaatctatattgattttttattaagactgtgctttctttgtgactatcttccttaccaacctagctaatatccctcaggccctattctctatacctttatctaaactttgacaattctatatgtttagtattagtattattgggaatatttatacatatcgctcagcatctttccctaaaaagcttaaaaactccttaaaggcctcattaatattcttccccttcagtttcatcttagaatctacttttctcaatcttgctagtaatggttgggtggatccatgactaaccattcgtatactcatggttaccttcatgtcatcatcccttctgattcaatagaattcactacatgattggaatgattgacagaggaactactaagtgagctattcctttacctctcctaaaaggcaagttttaatgataaggccaaaaccatggtgtgcctcagatccgtggggaagaaaaaaaaaagagttgcagtcaggactaagtattattgcacacataaccacagccagttgacatgatagaaaaagagggtggagaaccccattttgaaataccaaaagaagcgtcttgcttctgaagaatttcataccaattcagcatttctttaccaacaaccatactcacttcctgaattatcagctatgcatcatacagtgtttagtgcatgattttctcattccagatgagcctaaaataaacttgtaaaaaataagatgctaaataaaatgaatagatcttaactattatagtgataactcttctgtgatatctcagaagtgggaaaagttacataacttcaaggtcttataaggcagaggtatttgaactgctacattacctacgagtttatcccaatccatatagagatacagaatacacaaatgactctcccgcggtaaggcagcactgcagagagtaaaactgtaagtgatcttaacagtcattagcttagtggttttcaaacaatattccttggaatcctaaagtctttagaggtattttaaggagagggtttgaatttggggtggggggtaaatgtacaaactcagtggctgttttattgttttatgtgtgcttatactttttacttatatatttcacacatatctatgtttttaaaaattatatctatatattgaatttatatatgattttatatctaaaaattacagtataaatattcatttatattaacttcaactcacatttcattaataaaaaatgtcccattgaaataaacgtgtttaaaatccattgacctgccttgccccttttattttacaggacagtagacttggcttcagagggactaggtgactcctccagggacacagagcatgttagaagtacagtggacaaatggctttttccagggaatctcatacttcatgactttaaagagtaaacctatctgtgatccactctgtgtctttctagttatgttttaaatacatcaaatatttcaaggtatcttaatcatttctaaaagctgtatatctttaagtatatttcataacagatacatcactaacttgggtaataggaccaaaaaaagtttacctcatgctcaaaaccctgaaccaactttgacagtagtcacatacctaaaccaaatcataatatatattgcacaggcagaaaatatgagaattccatttgtttgcgtatttacaagtttctaagatagaagaaataggaaggaagattgcatatttttttcaaagctgatcttagatgtcatacaaaatctgatatgtactacttgtttccaacctgaagccttacagagcttgcagagaacagaaaaacttggtaatagaattggaaagataatctattcaaaattgtgaggcattggccttttgttctttattgtctgttataaagaccagaggaccttatttgctaccagtagagaatataatggtctacaagctgcaagagcctttcacaaagctatttttcaacaaccaacagtctttcacaaagctatttttcaacaaccaacaacgtcaaccctgaatttcataggctaccatacttccgaaaagaaaactgccaaatactgtaatgcatctagaaatattcacaacatgaacacttttatggccattaaaaagataattatatccacagtagaggaaggcaacaagctgaagaaccagagcacgttctttgaggtagacagacttgggttaccccagcctatgaccttgctcaagttatttcatctcacggaatcattttctcacctgtaaaattaggattaacaactccttcttttcaatattgtaataagaactaaataatatatatgtaaaattcttgatagagctctttcataagacactcaataaaatgaaagctataagtattagaaaaatggattttttttttttttaaattgagacagagtcttgctctgtcacccaggctggagtgcagtggcacgatcttggctcactgtaacctccacctcctgggttgaagcaattctcatgcctcagcctcccaagaagctgagattacaggcatgttccaccactctggctaatttttggatttttagtagagacagggttgcgccattttggccaggctggtcttgaactcctggcctcaggcgatctgcctgcctcagcctcctaaattgcaggtattacaggagcaagctacgccgcctggccaaaaatagaaaaatattgatatgttaaatgaagaagcagagtacagaaatagtatttacagctatttaagatatgtaaggtaagttgaaaatgagaataactgaggatggaataatggggttaatgggttattttccttccaacatattaatgttattccatctttttgattctcaattataaaattggacattttagcttatatgaatgctttccactgtgatcatgaggccaaaataagaatgctaagccagtctagatttttacaaccttaagagaaaagagctaataaaaaaattataatcctccattggtcagagttgcaagaaaattcagaaaattgtatccaaccagtactgaaatactcatttgcatattatataacctgagcaaattgtggtttaatgtctaagtagatattggcatatataaagatgagcttgctaatacatatagtaggtatatttttaatattttaaactttcatatataatactttattgataaaaactacatacaatatgcaaatacagtgaagaaaagagaggcagtcccccttaccttcactcctaccatttttttttttactcctaaaaaataaccactaccaaaagcttggacagagtcttccagaattttttctgcatctacaaacctaagtattacatgtatacttattacataataatacttataatgaaaagtataagtactattacatatacaataaccaattttaaaatttgctttaaaaacaaccacagtcatattttgaacagtagcatctcttttattttcagattacataatgaatgatcttacatgtaacacataaatcctaaacactgttctgtcagcaggaaagaaaaaagtccacttccattgactaaacttctctttatatttatatttgtaagactaataatgttttacttacttaaactaaatcacaagtcttaattacattaatgagaagtatccctgggaaatgtttataaatgtttataaaagtgttaaagagatatcaaggaatatgtaaggtaatattttcatagtatataacaactgactaaatctgaatttaagatatgcaagaaaggcaaacaattctgcaatcaatgaatctgctaattttattagctttatgagcataagaaaatatataaagtttttctcaatttcatgcaggcacatttttttaaaataatgcttaagaataaatactataatcactttctgctagaacgtggcatataaataactgttccttaaataaaagcaacctagtatacacctttattaaataaaccctaaatttggacacctatgttacaaagagacaaatagattaattttaaggttatttgtattttgtcttgaaattaataaaattttaattataacaggctgacctttaataagaggaagggtataaaatacaagtttgccatgaaatcccatttaaaatgtgaatatctcatagcaatttaattaaggctgtaaggacaagttagtgtggactgctttttatgatacttggagagaaacaaatagaaaaaggtaaagaagtaatccaaaacattggattcttgcacaatacaacaaacttccaaacgtaatgtttggctttagggaatcccggaggacagtagacagatttggagaaagtagaccaatggaacacaaaatagatttatgtaatcagagtgaagatggtaaagccagaaagatgtgtcccaagaacaaagtattttggagatcaacctggaaacaaataaacatctgaaaaagagataaatggcaaagttttaggtctctctcatgggaagtcaactgaaaaggaatgagggtagggtggtggtggagaaatgcagacagcaacactggtgagaaaacattgtccctctgagcaatttgaggcctgtggcctttatgtgcagaggcacaagaagagaggccgtttgggtttttttaatgctcaagtaaacatgtgtgtgtgtatgtatgtgtatacatatatatacacacaaacatatattttctctatataccaaatctataatctatattgattttatacatgtaattaaataaataaatataatagatgtgtctaatatttgactgatagacggataataaaatggcaaaactgttactacagctgattataccctcaggccaaattttttggcagctgcagtgatatacccaagcggttatattattaagtcagatgtaagattaataactggagaggtttctatagtgtgtagttaaatctaagaatcatgcatatatagagagagatttatttcttacacagaaatcattctatccccaagtctatggagaatatttttagttaaatggaaaaatacacacattaacaaatcaaaatatttaaaaatgcattttaaattgtggcttgacttatgaaaatatcccatacaatttaaaacaaaaaatataataattgtggataaaaatagactatgataatctcagagaggtaaagggtgtcaatgttactcatctcctgaaatgaacaaattatttccaattgaaacctgaatttgaaaatacatctcctggcagtttagacaaaaagagaaatagtttggttaaacactatttttaaagtagtaacatcttttcacataggaatggtataaattataaatgagttaaattcatgtatattataaattctgtttactcatgttggtgatttatattagctatggtaattcatacaaggattttaaggattttccagtatttattgtttgaggaaaaaaaggacaggactctccaaatttgtttgcagatgcaatcttttctttaaataaactcaaggaataatttattgcacgtgttattttgtaagaaatggcaagtaacgttaagagacaaaatcttcatctataatttattaaaactcacagaaatactgcggatggggcaattcttgtttctggttgactgtaaaacactacaataacagcaaaggctaacctatccacaaaaacacaagctaaattcctgacgcaaataatttgagtatttacatgtgtgtttgcctgctcacatgataatgcatattttgctggcctgttttcctcccattctcaaccacctcacttcaatcattgcttttatttccccagtgtgaggtatgattatttccatttcaaagaggtgagcttagttatttataatcaatcactaagaaaaacaaaataagactaacccctaaaatagccataaaagtattttgtaaatacctattgtagaaaaaaaagttactttgttggaaaatactccttaagggccatgccatatgctgattagcatatcaaatcaccattggggaaataatagaacattagaatacattgaaactgacatattttttcatcagagtaaaagcattaaaataaccaaaaatataattactaggaatcatttctaataaaataaaacataagagatgaatgaatgataagcaacttgatatacatttagccacatagttaaattcaagtttgtttcatgtgtatgattaaatataaataacattattaatttctaacacatctgtgctaaaagtgagggtattgcttttaaagacaagggcaaagcctgtcaaccaccagcctgcttgcagcaagcaaagaagataagaaaacaagcaactgaatcaaacactgaaaaatgacaagttttcattttcaaaactcccaacatatctgcaagtttctttcctcctttaaaaattatcatcagataaattgttacagtccaagaggaattaaaaaaaaaatcagcacccatttggttaaagcacatgagtttgggaacaaaataaagaataaaagagccgccaatactgccttctttcacaaagcctcgacatcacacaacttactaaatactcaaggagtacgtcaatcttaaaagagaaaaggggaaaagcatgagagaaaagaacgttaccaaactgcctctgcagtccttagggaacttgtagatcgggatcttggcttcataataatgctcattttgaaaaaaaataaaaaggaaaataagtcttcaactattctgattaatacattctaactgtctttctgcaaagaagattttaaagatattccatttccaagggaggctgcttgaagaaatccaattttcctggagtccatctcctgtcctcggtccagctcatgggcaaggttctaacacgcaggagcgctttcttccttcatactgaatttactccagtactaggctgttaggaagtgacagtttcttctgtgtcttgcaatgccaagggaggaactgaattctgaattgattcttcatctgggtcacaagggaaaccagcatagtgaaagagtcacttgatctcttttttgcaattccatagtaacagctttaaaggtttctgacactcgaagagcgcaggtagagagagagaaaaagaaaatgaccgggaggtactgtaacacgggagagctgtcaaggaagttccatttcagggcaagcacaggaaaacactcctctccgtggagcaaagaagtcagccaaggaacaaatctctccacactttggctgggtgggctgatttacctgcgaaagtaatttctgtgtgtccctgcttagaatccagggttttgtgaatgagaactatcattcaatctcaccaggcagaaactattcctcaagggctgtatgacgtctgtaagaaggcagttcaaaacaccgcagggcagtgagaaaggaaaaaaaaaaaaaaaaaaaaagaaaagcccagcgcccagcctagcctcgtcaattgctgagacttacaaagcaaaggggcggatcagctccagagaccagcactgtaaaccggccaagcagacaagagacctcacaaaacttataaaaccatttccttctctgggaaatgagatgtctgtgttattctgggtaacattccgtgatcacctttacaaggaacacaccccttgccattaagttgtttatttaccataataaacaaatgaattttataaaagtcattctttcaaaaaagtatttcactgaagcactaaaactaaacttttctctttagaagcaaagttgagagaacttgatgacttagcagctgttcattttgagcggatgtaatgaaatgtcatgctttggagttggttgtagagatgtaaattacctcttaaaaattcagcagagtgtaacaggcacccttggatcagaacatactggaattttaaactgaaaaattgaatgtattattcctggacaagtggctgcacgtattaaggctgttcccttgcacaatgttttctaaaccttatttttttttaaaaaaaatgcaaatttcattcatctctacacacaaagacttgggtttgctaatccttaacagctcttcagtaaggaatgaagctttatatcttgtcaatatctcttattatttcgaaggccaaaacctttcccacctcctaaatataaaatattttctattacagtagatataatctaagctgattccaattgctcccaacagaaggaacagttgaccagcctgcctatctctctgaacatctacacagaggatatatactcctctgggtgtgccaacttcaattattttggatgtgaattaccaagtgaaaataatgtaagcattctgattgcttaaatggcattagctagtacgttggttctctagtctgacgtgaacttggtgtttatttagcatttgcagacaggatgttggagtgcagttgtgacccacccaaacaacttggaaaatgtagtacggcatccgccagaggctctggctgcttcttacaacaaacccttcatctgctcccctggtcacacttcaaggtgcatttgtgacttagtcttctttcaatgactctcaggcctcttacggtaaatgccaataaattgctttccacatagttatccccttaagcttttcagtttccttatgactgccaggggacattcacactttcttagcactgtcccatgtctagtatattgctggcattttaaagcaggttaattaatcatgtatttttttggaaacttaaaagttttgtgagactaattatttttaggggagaggggatttagaggaagaggtttaatttttttcttattggaatttaaatgtgggaaaagaaagaacaaaagcaaaccaagtaaaattaggcaactactatttatttgaaacactgttccctccatgtaaggtctaccaaatagcttccagttgccatttcagaaagcaaatgacaatgatcagagaatgtaatgtctgactgttgagttttcaactctccagaaataattagcctgtgttctaccgtcccccagatccatgttacaatgagcttatttagcctgatgctactcccttctctgtcacacacacacaagtttagtgcagccccatgtgctgttccttgcttacttgcccaacattctacatcttccaagaatctttctctgaaaacctaacacacttattgggcatctactaaagactgtataatagtaccataatgactaagaaatcgtccctctcccctggcaaaaacaaacttaagtggggaatctgacaatgtatggaactaaccagaatactcaaagtttttggattggtacatcaaggttgccattacagagaaagaaagatgcgctatgttgtaagaccattgagatttaaatttaagttttgcttctactcctaatatttaaggtagtgacagaataaaaaaaaagtatgtatttgatgttacagagttttatccacttgtaagaccatttctcacatgaacatttctgaaagaatgttttgttatctaagcatcctgtagttttccctctgaaaagcttccccaaatggaaaagatatggcatttccctcgaaattcctgttagcatgcaagcatatgatggcatgcaggctgatgaggaggcctgaatatggggagactggatttaggaaccatgtggcccatgcttttgatccagaagctgcgattatttctcagtatttccctgttgtactgaattgtataatgtatggaccttttactttctggttgttaccacatttcaatagactgtaccatagatgtatacatccattgggtcatccatctgtagatgttttgttgaatcaaatgactatgtcatttgatgtttctgaaacttcagtcataacaccaccttcataattctttccatattagcattccatctataccatgatttgatatttttcttaattgactcactttttaaaaaaacttaaactgaatataaaaggtaactttatatttattctgtaaatagatttaatatactggtataatttgcccccaaaatataagatatattaatagaaaaaaaggagtccaaaataactcctaaagtctgtctcataccactaatggtgccccgatacaacttggcaacacttacatggaaagcgtcaattgcatacaggtagattgtgcgcacctaaaatgtgatctccctttctcttatcatccaatggtgagcgtgacttgtgagacttatgacatttatccatggattaaacattaaacattaaatgaagccaactgaatgaggtgttacggagtaattttactatacaactcaggttttctcaagtattactattttcaaatactctgcctactatcaaatcttctgttctctaaattcctattttcagattacaatagatattctatactttccaatctatcatgagcatatttcttagagccatattatatatcaactaaatattcaggcctctcaaatatgctgaaattcagtactccagatatgtcaaactaactttttagaaaaaaagaccaggggactgcagtttttacagtttcctgctattctctattgtactctaacgttaatgagaataagacactgaactcctgtagcagttcctcattattgagaaatattgtgttattttccttatctggaggggaattttgaggcaatttctagaggtttcttttattttattacacttactaggaatacagttggattcaaggactttcctactggcatgaaccttgcttggagctacatttcttaattcccaaaggagaagtccggagtattatattttgaaggctttcctatcttcagatttcctacctctttcataaactgtcaggttaggataataataataactactaattattaattacctacatgctaagtagactatactttcttaattatacatcacaacatccctccaaagtagatgtgataataataatttcatacataaagaaagtcaacaatttgttcaaaatttttggacccaggtatatttcattccaaagcttgctcttcatgatgtgtatgtgtgcatgtatgtatgtgtatgtgtgtgtttgtgtgtgtgtgtgtgtgtggaagacagaaagaaaagaggaagagaaagagattaaaaaatgctaccaagtttttggaagtttttaaaattcatccatcctctttagttgtacagtggcaatgaattaatataataaaaatggtgcacgtacattactagtataatgataaacatatttaacagctagaaaatgttagatctttaagatatgcaggattaaacaatctaacttcactgtccttgtttctaatttttaggcactaacttttaggtatcataaacactgtgatgagggcatatatgacaacatcatgagtttgttagccataaaatatgataaggtctttgaccatctcacaacatgagtaatggtagtttcctgttacctatgcaacagatgacattttgattgcctcattaggcaatactggttaataaatgatcattttaaaaggtaacaatacgtgagacctctggtaacgtataaatttcaatatttgtcaacaaattacattggctattaaaaggtacagaatactagtttttaaaactagaataaacatttgtgcatggagtcagtaatgttgacataaaatgaattttgtaattgactttcagaattttgcactaattcaatactggatttcagaagaaaaactatctaatttaaaattttctaagtgctgctgtatttcctttgcattctgcctctcctcttgtccctctttcacatttcttgttcttctttattctaaacttaaatgaatctctgcaaatttaacattattttgaattaaatatttaaattttattaaagaaatacatgtaaataatgtaaacaaagagcaatgagtgtaatatcctcaaactccagcattgattcctgatcccaattcatacacaagaatgagaccctagaaaggtgacagtaagttctaagtgcatgggtgaggcttgtgtactgggagttttactgcagtatcatcaagtgcccagtggggattttttttgcctcttccaaatgttactatttgtaagagattttttcctctggggtatctctatttttctagagaaggatataaatatgcttcctagcattctggtgtgggtaggagaaggacgctgaaggtcttactgacacattgcagacattcatttaattgtcctaaataaagttaaacatacagccatccttctcctactctttgcttagtatcccaaagtctctgtcttccatggagagggatgcaaaatatgttgactacactgaaaaagagtgagggcttatggagaagtgtatataatatacatgttcatacacctgctatatttagaactcttccatcttccaaagtatgttttgggcgactggggcagctcagtttgcttcactttagtattgttctctgatttggttaagtcattgaccttttctcttcctacttctatctttatgtattgtggcttagagtcacagacatctcccagtttcctcaaagatgaaatgtacctttctgttttttgtactaattattggtttgagtgactttttaaagaaaaaaatggcataggaagattgtttctccacagttttaaagctagaaatctataagttctactttaaaacaattttctatgtttatctaagcatacgcatttacaaattttatttatcaaatgactatatgtcaactctctctaagcataggtaaatattaagtattttttattatggtaaaatacacatcacgtaaaattgacattttaaccctttctaagtatactgatcagtggtgtaatgtatattccccctgttgcacaacgattatctccatccatctccagaactttttcatccttccaaatcgacaaccctgtactcattaatagtaacttcctattctcctcttctcccagcccctgacaagcaccatttggctttctgtccgtatgaatttgactactctagatatcttatataggggaatcacaaagattaagttgtaaaggtagattcagaatcacatagccagttatggtctagatgtctcattattaaagaaaaaacaattatggaagcacaaagtttgaagataacaattcacaccttgagaaatcaatgtacttgccttatccatcatcaattctttcaaagtattcacttgactttcatagacaaagtcaagagcaaaaatatctttgcctttaccaacatctggtgtgtgtttttaaaaattattcttctaactattttttttctgtttaaatatatacaaatgttatcagtgcttacccagtctggtcacattataactttagttcttatttcaaatttatagtagcttcctgtatttaatcaagtagttcctaactctatataccaatctcaagggataaagcaaaaatttaaaattaacttacttcaataattcttaaaagacttttgaaagagatgaaacaactggaaagaccacattgccaaatgaagccctagtttctaacactgagataaattgagattttcattaaaataagattggaggctgcgcgcggtggctcatgcctataatcccagcactttgggaggccgagacgggtggatcacctgaggtcaggagtttgagaccagcctggcaaacatggtgaaaccccgtctctactaaaaaaatacaaaacttagctgggtgtggtggcgagcacctgtaatcccagctacttgggaggctgaggcaggagaattgcttcaacttgggaggaggaggttgcagtgagccgagatcgtgtcattggactccaacctgggcgacaagagtgaaactccagctcaaaaaaaaaaaaaaaaaaaaaaaaagatgtgaaaagcagcctgtcaaaaataaatgaacacaagatgtgttttaataataatttagtttctgatgtaatgggaaatgttgaaaattgttttattagaaagtaaactctcatcaggacctttaaatttacatttatttgataacatttttcttgtacatattaaaaatgccaaaataatccaggcaactcaggcagtttctccttgatcacagattacaaataagttttctctaatgtaaaacagctgctctgagaaaaacgcctactatttaggaagggtatgtaggatcaagttaagaagaggcctttggagtcagactgcctggttgcaaatccaaattccaccaatcactagttgtttgattgcaaacaaattatttaaccttccctggcttcagtttcctcagctataaaatggagatagaagagaattttctgaggactaaaaaagacatgtaaaaccttagcaaagtatctagaaaatggtaaggaatcaataaataatatctgctattaaaaataagttttaaaagagtaatcaataagctatggagaaaagcagctttaaaacttaaaaatatatgttactgcactagtatttgatttaaaataattggtttgtgcttttgtcttcctttggatcctgtccccttgactccctttacacatagcttgtgtagttttcctgacttctattttacacatctaaggtttttttctcttatctttggattatctttcaaagatacaaaccttaaaatgtcaaagcctgtgatgaaaaaccttctatagcttcatattccttacaggatcaatttcagccttttttgtgtgttaaataaaaacttctaccatttgggttcaatctgctattcagctttgcccttgataactaatttttcccaccctatattgccaaccacacaatctcacacaccttgccccaaatctgctcactttgtttcccctgcctggggaacctctcacctttctcccacttccctgctaagtatatttcctactctgccttcaagatctagcataagtagcagtaaagcccaactaactccaagacaaactcagaagttcagtctccttggattgattcaatctgggaatatctcaggttaattttgtttattataattattattttataacacatttgcagtatatggcaacacacagtgaacatcacagggggattcaaatcccacagacactgtttagctatcgatttggactctgtaagctttgaaaacacattatctctttaagattcagtaccttcttctacaaaataaggacaatatgcacacctagaatcctcccagggttcctctgggattaaatgagaaaacatgctgtccaatctgcaatcccttgctcttgatcactttcagatctttgcacacgcatttctggcaggattatctttcttttcttttacccctctttttgatcaagagttaaatcaggactacgcctcccatcctgctgctctgcaatctgaattaggtgtctggccatgcaaatctctagatgttcatcctaatttctttcaatttatcagcaccatatggtcatcctctcttcatttggttaactataagccactaactaggaactcctactggaaaggattgttttaccattcttggtagagcacaaggcattatggaggcccaaatagaaacctgggcctccataatgctgtgagtttctttgaaaacagggaatgatgatgagcattttttcatgtgttttttggctgcataaatgtcttcttttgagaagtgtctgttcatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacatgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgcgttagtgggtgcagtgcaccagcatggcacatgtatacatatgtaactaacctgcacaatgtgcacatgtaccctaaaacttaaagtataataaaaaaaaaaaaaaagaaaacagggaatgaggcttctgcatctttgtattcagaatacctagcacaatatctggcttacaaggtatttgcttaacagcagaataaatctttggtcaacggtggtagataagccctttacagattttcttcctgtgcccttttgtggcatttgcttcatggctggaattagatttcaaaaactgagtcttgcctctttcttgtttttcataagcctctatctctaaaagttactttagatgccttctgtgccaaaaaggagttcctacaatagtgttataattaaaaaaaaaattctcccaaagaaaaaggaactggttgccagggtaaagaaatacactggaagaagtcttatgcaggcactgaaccaacgccagcatcattgataagaagcgaaaaattttttgttaaatatttaggaaaaatggccttaatctggagaaactattatgcaatgtgatattcaacccagacagagtatttgaattctaataggaaccttttggaagctcaattcaaagaaataacttttccaggaagagtttccccacattttggcaggacaatggggagggtgtttgtgtcatcttataaaatctgccaatcagtcaccactgtctatgaatgagatggctgtttctctggatgaaaaggctgcatcctggccagtctttaagaaccttatctggagccactactaagtgttgtccaatctgcaacccctcactctcgattactttcagatctttgcatatgtatctctggcaggattatccttcctttcttttacctctctttttggtaaagatgcattagcacattcgtatttgtatcaaccacatgaagactgtatatccatgtactggatgagaggaccgaagggcactaagtgcttcccctacaagttcagtggatgaaccaggtcagaactcaagcctggctggctccagaagagaaatctgaagatgacaggatgaactcccatttattgattgctcaccatgtgccaggcactgggtaagatgttccacatgttctctcatttaacatttaaaacaaactcacaagctaggtactattatttcttccaccacacagtcaagaaaactgaggtctacaggaagttaagtaccatgccctaggtcttacattaggacttaaacttagattacccaaatgaagcataacctggggaaagcataaccttgagaactaaacaaatcgtattttaagtaacatctcaataggaaattttttaaaacttatttaagcaattctttgaaaagaatggtagaatgggtaaacttattactctggacatggtttttttgtgcacatgacattgaaatcattaaaagttagtcactgtttttattctaggaatcacgactttcaaatatttcaattatttagataccagactgcaagtgtactcaaaagtaactcttgaaaacagtgccattaagcaatgactcctcattctgcacactcacattccctggcaactactaacctgttttgtattctctatggacttacctattctagatatttcattaaaataaaatacaatatgtgatcaaacaagtaacttttggaaaaaatgcatttttactttactatgttggttctttccttggaattaagaccatttattttttatttcaaaaacactttctttggatgtatattttcatttaaagttttctttttggatggagagggaggtggagccatatggctaaatagcagcctcccaaaggaacaacaaattgaacaactctccacacaaaaaagcaccttcatgcaccttcataagaaccaaaaatcagcttaggtaccagcttagccacagcagggtaaagcaccaaaggggttctaggggttcctgattccagggcttggctttagatggtatttctggaccttccctggcttacaggtgggcccactgccccaaaatagattcctaggcctggcagcattcaccacaagctgattgaagagcccctgggccttgaatgaacatcagcagtagccagacagtacttgtcgcaggcctggggcagtggtggccacagggagagactcctctgcttgtggaaaggagaaggaagagtgggaaggactttgtcttgtgacttgggtgccagctcacccaccgtagaatagagtaccggtagattcctaagatttctgactccaggccctggctcctggacgtcatctctagacctgcccaggactaggaggaactagttgtcttgaagggaaggatacaagcctggctggctttaccacctgctgattatagagccctagtgccttgagcaaacataggcaggagccaagcagtggttactgcaggctttgggcaagacccagtgctatgctggcttcaggtctgaccctatgcagtcccagtggtggtggccacaggggtatttgtgttacccctcccccagatccaggaaacagagacacacacagagagagagagagagagacagacagacagacagacagactgagactgaatctgtttgtttgggagaaagtaagagaagagaaaaaagagtctctgcctggtaatccagagaatgactctggatattatccaagactactaaggtggtacctctgcaagagccacagtgttactgggcttggagtgctccctaatgcagatattcctgcagtgacccaaaactcagaccacaacacccaagtttcttcaagcatctggaaagcctcaccaagaaggacaggtacaaacaagcccagactgcaaggctacaataaatacccaactcttcaatgcccagacaacaacgaacatccacaagcataaagcctatccaggaaaacatgacatcaccaaacaaactaaataaggcatcagtgaccagtcctggagagacagagatatgtgaccttttagacagaggaaactcaatggaattcaagataacacacagaaggaattcagaatcctatcagataaattcaacaaagagattaaaataatttaaaagaatcaagcggaaattctggagttaaaacacgcaactgacatactgaaaaatgtctcagagtctcttaacagcacaaaacaatcaagcagaagaaagaactgtgagcttgaagacagcctacttgaaaatacaaagagaagacaaaagaaaaaataataaaaaagaaagaggcattcctagaagacttagaaaatagtctcaaaagggcaaatctaagagttattgaccttaaaaaaaagttagaaagagagatgggggtagaaaatttattcaaagggaaaataacagagaccttcctaaacctagagaaatataacaatattcaagtataataaggttatagaacaccaagcagatataacccaaagaagactagctcaaggcattcaatactcaaactcacaaaggtcaaagataagaaagaatctgaaaagcggcaagaaaaaataaagaaaaaacatacactggagttccaatatatctggcagcagacttctcagtggaaaccttatagggcaggagacatattcacagtgctaaagggaaaaaaacttttatctcaggctagtatatcctgtaaaaatattctccaaacatggagaaatcaagactttcccaaacaaacaaaagctgagggatgtcatcaacaccagacctatcctgtaagaaatgctaaagaattctcttcaatctgaaagaaaagcatattaatgagcaataagaaatcatctggaggaacaaagctcactagcattagtaaatacacagaaaaacacagaatattataacactgttattatagtatgtaaacaactcatatcttaaatagaaagaataaaagataaactgatcaaaaataataactacaactattttttgaaatacagacaatacaataagatataaagacaacagaaagttttaaagcgggggacaaagttaaaatgtagagtttttattggttttccctttgcttgttagtttgtttatgcaatcagtgttaagttgttatcagtttaaaataatgagttacaatatattatttacaagcctcctggtaatcgcaaatcaaaaaatatacaacaggttctcaaaaaataaaaagcaaaaaattaaaacacgccaccagagaaaatcacttttactaaaaggaagacaggaaggacaaaaaccatatgaccatttcaacagatgctgaataagcatttgataaaattcaacatcccttcatgataaaaatcctcaaaaaatcgggtataaaaggaaatacctcaacacaataaaagtcatatataacagactcacagctggtatcatactgaatagggtataactgaagactcttcttccaagaggtgggacaagataaggatgcccactttcaccactagtattcaatatattaataatactggaagtccttgctagaacaatcagaccaaagaaagaaatttgaaaggaagaaggcaaattatcccatttgcagaaaatatgatcttaaatttggaaaaacctgaagattccaccaaaacactattagaactgataaataaattcagcaaagttgtaggatacaaaacaaacatacaaaaattagtagcatttctacatgccaacagtgaacaatctgaaaaagaaatggagaaagtaatcccatttgcaataggtacaaataaaattaagtacctagggttaactaaaccaaaaaagtctacaatgatctatcaactatcaaatactaatggaaaaaaagagaacacaaaaaaatggaaagatattccacattcatgaattggaaggatcaatattgttaaaacgttcatactacccaaagcaatctacagattcaatgtagtccctataaaaataccaaggacattcttcccagaaatagaaaaaaaatcctaaaatttatatgaaactataaaagactcaaaatagccaaaggtatcccgagcaaaaagaacaaaactggaataccagttttgaacccagaaatgaatccatacatctacagcgaactcattttcaacaaaggcgccaagtatatactttgggaaaagacagtctccttaataaatggtgctgggaaaactggatatccacatgcagaagaaggaaactagacttctatcttttgccatatacaaaaatcaagtcaaaatggatgaaagacttaagtctaagactctgaactatgaaactactaaaagaaaacattgaagaaagtctctagaacattggactgggtaacaatttcttaagtaataccctacaagcataggcaaccaaagcaaaaatggacaaatgggacaaataggatcacatcaaattaaaaagcttctgcacagcaaaggaacaattgacaaagtgaagagacaacccacataatgggaggaaatatttgcaaactatccatctgacaagggattaataatcagaatatataagaagctcaaacaactctacaggaaaaaattaatctgatttaaaaataggcaaaacatctgaacacacatttctcaaaagaagacataaaaatggtaaacaagtatatgaaaaggtgctcaacatcattgatcgtcagagaaatgcaaatcaaaactattgtgagatgtcatctcactccagctaaaatggcttttatgcaaaagacaaataataagaaatgctggtgaggatgtaaagaaaagggaaccctggtacacttttgatgggaatgtaaattagtacaaccactatggagaacagtttgaagactcctcaaaagactaaaaatagagctaccatatgatctagcaatcccactgctaagtacatacccaaaagaaagaaagtcaaaatatcaaagagttatctatactcccatgtttattgcagcactattaacaatagccaggatttggaagcaatctaaatttctatcaacaggcaaatagataaagaaaatatggtgcatatatataatgtagtactatttagccataaaaaagaatgaggtcctgtcatctgcaacaatacggatggaagtggagataattatgttaggtgaaataagttactcacagaaacacaaacttcacatgttctccctttttgtgggagctaaaaattaaaacaaacgaaggagatagagagcagaagacagtttccggaggttaggtagggtagcgtggagggaagggtgggatacttagcgggtataaaaaaatgtaattagatagaatcaataagagctaatatttgatagtacaacagggtgactatagttaacaatttattgtatgttttttaagcaattatagggtaaaattggattgtttgtaacataaaaaaaggataaatgcttgaggtgatgcatacccatttaccatgatgtgattattatgcattgtatgtttgtatgtattccacaaatatatacacctactatgtatgcaccaaaattaaaaattaaaaaaagtaaaaagaagttttttttttttttttttgaatggatagcttctgtataagggataggaaagcagacttaactatttaacctgaccttgtatattaatttgtgctcttttggggagaaacacagcctattcattccaggcatgcagtgaatgctaaaaaaatatccacaaacaacatagaacagtgattttcagaagaagggatctagtgtgttctctgtgttcttaaagacagtgctttgtctgatatttttgcaaaaaagttgagtcttaagtatggtgcttggcaaaagttgctttatggaaaatggaaggcaaataagcaaaaagagatcatgccaaaatactccctgttttcagggcagattgttattccatatggggaaagaatatgaaaaagttctcccacccaagaccatgaaatttaagccttcattcagttgacagtcttcagtgagtcagattcctgcaggatttaagttactccctggctgactctcaggcatctctgcagatagttaacctttttcttgttatcttacagcaactataaattcttattagagtgataaaaagcaataacaatttaaaacataagctatttttaaaataacaatcttgcaaataggtagtaccttaagcaaagatgttttaatacctttttaggcctcactacttatatctaacatattaacatggacccactttccacaacgtagattatttttgctatcaacagtctgggaagggtctttataattttgcttttgaaattatgtggctactattaaactcatttaaccaatgactggccttgattttctttgcaatcatccagcatacttggagatacttgtaaaataaaaaactcagcacataagtttttttaatttagtaaaatgttaagaatactcatttgacaattattgaagtcgacataatcttatgctttgaacatttaattaaatgttagtcctcattttgcagttttctgtttgtattcaattacttcattttccaggtctcaaatggtttcatagccccatgagacgctcataggctgtagcccctgaggaatgtagtgcctggtatggaccacagaaccctggaggtgggatctggaaagaaagggaattctggtaagaagtgattcatgcaaggagatgtatttagcatttccagatagtgccctatttcctgtagtaccttgataattatgagttaccttcccttgctaatgagatgaagtaagtcatcaagcatttattgttacaagggttttattcatgatccagctcatacttagtatcatagatgatttttagaaagcataaattgtggttgccagctttgaggacctaaaatttagctgggaagaagaatacaattctccttaatgttttctctggaataactgaacacatgagattgcaagatgatgagtccaaggtttggatatatgaatgaccaaactaaagcaataatatggctttcttaaaaaatacagttatttaaatgattctagttgtgttaaatcattcttttaaatacctggtgagtggcttaggaactaagatagagtctgagaagaatagcattgctggtggccccaccaggatgagagtcattattatgatccaacaaaataggaggatcattaatttttcactcattcccagagatgtagttttgaacagggttaggttcttatttcaattagagaaactagaaccatgaaaagaagatttcagccctaaggaaaacagatatatcagagtttaaaactccgattcccattctgctcaattgctcagtggatatggtcattatttttgttctttgaaatggactttgttttttaagattatgtagaatgcattgtttggcaaaaagcacaggatattcaaacagaggcccaataaccaaatgcattttttctccattgcgttcttacctaaataggaactataataataacaaggcctcagtaatgcagagttcttgcccttctgtaagtgggcagggtgcgtgtgcaggtaggtaggccattaggtcaaatttcaatgtctgagatactctcctgaccccatgggagtcacataccactgaaggcaaaatctggctgcagggtcacctgtgttgcattggaggactgtgagtcatctcttcatactcagctctgcaacagtatgaaaaggtcaccacgaccacgctcacctattctggtgaattagacgtataagcagcctgctcccaactccttggagatcatttctgagaacatttgtcttctcaacctgttgctgggcatgactggaagcagaataaatgactacagaatgtttagtttacccagataaactgcttggcagtctttggattatgtaaaattaattgtggaaacttaatgttgaccagtgatcatagtatgcggacagacctacttagaaactgttttgtgtgtgtgtcagccagtgttactaagaatcatttaagggaatgaagagtaaaactcttttatgtaaggcattagtttagcagggccactgcatctctgtgtgagctgtccattgcccaactctagggagtaccatttttacaaaccacagcatgaattgtgctttcagaattgtgcaaaatggtggccctgtctttctgcatctcaaatggtgacataatgtaactatattttccatctttaaatagatcctgaaagctcaagttgaagcactgaggctgacactctgggctacacagagaaagcagtgtcagatggtggtgaggaacaccttgtaggcagaccgccaaggtataagtcccaacctggcccttactccagccaaattgctttagttttctatgcctcagtctcctcaattgtaaaatgagtgaaatcagagtggctgggagaattacattaaatagtgcaggtaaaatacttgaaagaacaatgcacgcagtcacggactcaatagatgttaactcttaagactgtctctcttttgttcaatcattaggattctggaatgaataaaacattatcacagctgttttactatgattctgctttaggaatatttgtggctgtagaggaaacattttctgtgtgcctttatgaaagctaataactaggaacagtttaatagaatgctcttagagaaaatgaaaaatagaattttgtgacagccattaagagtttaaaagagactgtggtaaggattgtctcttctggatgctttcaaatgtaattattggtgaaggctaatagaaatccatggagtttcagatactgatagaaaatgataggcatttcaaaaataaacattaagcaaaggctacaaaattaacattatacctccccatttatctttttttctctcaggtggcacaaaagcttgacaaagcgtccatgaaccatttgaagatttttgttgggataatcagatatctataaatgccattgtttaagaaagctaaccaaataacgttttactattgactaataaacttttctaataatcttcaattttattttaataaaatattagatgtagttcagtttctcaactctggaatagtgacccaggaaaaatatgagggaaacttgaagtctatggaagttgtatttggtgttaactgaggcctttgtgtcagcccagcacaaactgtaaagtcaaaagtgtgactttctctttctggtcttgacaggcttttgttttgatagacttgtcctcatctttaacctcctactgttcttctaggttatccaggtagctcttcaggtgcccaggttgcctgttgcctctgctagcctgcctagttcgtaacatcaggcagagatgaggcaggaacttcggccctcaggcttgattagtggttataaggccaaggatcataggaaaaaggtatcaccttcagattaccttccctgtgtattctgtttttgtagttttcatcagagagtaagcaaccgtcatgtgaatatcgtgtctttaatgatctgttaaaatggcggctctcagagaaagtgctctccattctcctcctcctacctcaggccccctcagaaatcaggctggtggtgttagggagtgaagtaggctaagtgtaagaaaaaaaaaacaaaaaaaaaaacagctttggaatgctgatggacagcaactcatatttgtcctcagtgtcaggataataaggactcatgggggtgggaaatattgtaaatacaaaccttgaaaggaggtagctgctattcagagagccaacatagccaacgtttctcaattgtacagagaaatgtgaagttatatgtgagatctttccactttcaatcgtgatgctaattcaaaatgaaaaaaaaaaatctgactggcctaacaaaacaagtttggggtcggggtggttactaggtttccttttagccattgtttgggacatactgatgtactgctttattaatctccaagaaactcatttatgttgagtggctaatgcatcagtagggtaatatttactttatattttaatattttataagttaatagatataataaataatagtaaccatacagtgggattagtttccaatggtaaacatttcaggccttcaggccttcaggaggaattttgaattgtgatgaaatggcaagtgcctattccatccaggcataaaaccaatcctagccaatttattaaaaaaaaaatcctgcattgttactctttagctaatgattaactaaagtctgagtgactagtagaatgagtaattttgttacataagccagagaaggtggaaggaaactaacatttattcaatacctactgtccactgggtacttcatctatatattctcttctaatcttcaaaacaacactgtaaggtagttgttacaaataaggaataattacaacttattccttattttgcagctgtaagttgatgtttagagaggtcacatccaagtctcttggaccatgcttcttcattatacaaggaatattgatgttgccaaatattaattcaggagctggtacagttagaaattagtaacacacacacacacacacacacacacgcgtgcatgcacgtaaaaagcaaggttaaactcgcaaggttaggcaaggttagctaccatatgatagcttaaagggaagaattctgtgctgataaatggagtatttttctccttaactgagtcatcctgtgtcattgttaggcactgtagacagtacataagttaactgagatctgatacttccttttatcccttaaaaatccaacacagggctcactgtaattaggtataaataggtgacttaacccttcagatctttctggaggagagataagtgtcttatgagattgaaataggagggatcaacaaagattgcagaagaattaagggctagcaaaatctgtcatgattccaaaaggatcaagttgaaagtgaaactagttcacacattttcacgacagcttcagagttaacatcctataaaggaatctatcaacattgtgacatttgtttaggcttctataagtgagaaaatgtgtccttccatgcaatactaaatgtaattatcatgttatctatttaatccaacttcacataaatcccaatgattaaatctactatctatttagaatattatcacatacttaggaagatatatcaataaatacttatgggtccttgtggtaaataaatactaatgtatagatgaggttatacttgccttagagagtttacaacaaaaagagggacgggtagtgaaagacataatgtccatgaaaaccaccacattattgctttatttgcttcacaggcctcatatgtgaatttttttttaaactatagattcttacctactaaagtaaagtttcagtgagtgcaaaatttgactggcttctatcctcctatgtccccagtacctagaacagtgcctgaacttaggaagcactcaagaaatattgggcaaatgaatgaatgaatgaatgacacagatcatgaatgttataatgagaaagcagagaaaaaaaattatctgggctggatagtcagagaatgtttccaggagaggggatcccaaatatggacttttaaagctgataaaggaaggcaatttccttgagaagaatggcatagacacaaaggctaggtaagggcaaagagacacctggagtaatgtggatttactgttattctatcagtaaatcttgatgaaaagacttgaggccatgtaaagaagaactctctaataaaaatggaatgggttcccttggggttggtaggagaggtgatttctgtgaggggaggtactggagcttggggtagaagaacacaacaaaaatatgatagcaggcagccaaccccaaggcacaagtgaaactttttttttttttttttttttgagacagagtgtcactctgttgtctaggttggagtgcagtgggatgatctcactcactgcagcctctgtctcctgggtgcaagtgattctcatgtctcagcctgccaagtggctgggattacaggtatgcaccaccacaccaggctaatttttgtatttttagtagagatggggtttcaccatgttgaccaggctggtcctgaactcctggcctcaagtgatccacccatttcagtctcccaaagtgctggaattacggtgtgagccaccgtgcctggccataagtgtaacttttaaagtttcctctcaccttgggattccaggcctctcttttggcctggttgctgaaacaatttaggagaatttctgaaaattttcaaagtattcataaatggaactttgctttcctcctcctaaatcaagacaaagctcacactgaccacagattatcttaaatttggtgaaaacatatttcagttggtggaaacacaattgttttgcaagttagctccagaagtggtaattgaaagtgacatttaagaaacattttctatggatctcagaagatgattactcattttgttttgaaggtttatgatatgctaaagtgtttttaaagcacattataattaaacaacttgtaaaaaaaatttaaatttccccctatggaagctcctatttcaaatgtagtctagagagaatttcaagtaaacatgtaactgcacatctgattttgtgataatttgctttatactttttaatatcatctttgatgttacatattcagatgtttaaataccaatacaaaaacaataataattttgtttaaattttccaaacacacaaaacaaagagaagcattcattcaaaatacttgtatacacatgcaaacaaaattaactttgtgtttatgactcacataagggaagttattggtgcccatagcctctgaatacccgcctctcaaagcttattattacaaagaccagtagctccttgcctgaaggtttttaattcctgtgagtcttggcaagggctattttctggctgcagttacatgcctggcctgagcataaataacctgggagtggtggattgttaatgacccccggaagcaggtgatggatgaagagttggtgaaaagcaccccagcttcctcatctcacagttgggataactctggggtctgttccacactgtcttccagaacccaacaatggggactgagctcctgtttccctctgtgggaacggacttgatgatgtgtattttttcagagatccttccatttcctgtctcacttccctactcctttacttaggtttcttgaatttcctaaataaacaactaatattccttatattggggtctactgctgcaggagcctaaaccaatacatgtctcttccattattttgtgacaccaaagaagattttgattaggcctagaaaatatacatgaaagctgatcaaaatgagaggaatgattaggtttgtttgtctgtttttggtaaatatggaaacaatgccatttcattttagtaaattgccaagttttctcaagtccctcctatctttctccatatacttgctcttctgtcatttgccttttttcatctctggcatacatacaacctgaaataaaacgccatggggtagattaacgagaaacactggaataaaaaaaaatgctcgcccaggcgcagtggctcacgcctttaatcccagcactttgggaggccgaggtgggcagatcacctgaggtcaggagtttcagaccagtctggccaacatggcgaaaccctgtctctacaaaaaatacaaaaaaattagccaggcgtggtgtcccgtgcctgtagtcccggctacttgggaggctgaggcaggagaatcgcttgaactcaggaggtggaggttgcagtgagcagagatcacaccactgcactccagcctgggcgacagaaaaagggtctgtctcaaaaaaaaaaaaaaaaaaaaaaaaaaggcttacagtgtcacgtgaatcacatgcttattaaatgaatgaaaaatacactttattatttcatgtgtgtattaagaggtcatatggatagatcagatgttggcaaatgaatgtgttatttctagaagaaatagaaatgtttccttatttgccagggcctaaatcagtgtttctttgaaatgagtatattttctgacagtatacttcatgcagacactcccacacactccccatacatgtgtgtgtgtacctgacttatatcacttaataatatgaacagactgaagataatgtcaattaatcaataataaatcctaaattccgagttaatgtctgtgctgttttgaacaaggtttgaccgtcttaaataaaaagatttttgtgtttgtttgtttttcacaaggtttgaatgtcttaaataaaaagcatctaggagctatagggtgtagagaaaactctccctgatggcatttttcctctactctcacaccacaaaaatcatcaacacagatgaagccttctacgaacaaacatgtgaggtttcccccccacaccaagcagccaacactagctgggtgtcctgtaattcagttccaacgctgtctacctggagataatgtcagatcccaccggttgaaggttcagttcccaagactgccccccaccacaccagtcacaagtgtgggcctctggagcttctaaccggccacctccaagttggcatactcataatcctctctttgggttcaattaatttgctggagtggctcacagaacccaggggaacacttacttatgtttgctagtttattataaaggatattgcaaatgttaccgattaagagatgcatatagggtgaggtatgggggaaggggtgtggagcttccatgccttacctggctgtgccaacctccatgaaagtccaagtgttcagctatgtggaagctcactgaaccctgtccttctgggattttatggaggcttcatgacatcagcattccttcccccagggtatagggcagtactctctctggggaaggtcttaaaagccacaatcagaaaggcaggaacaggtgaaaggagagaaggagaaggtcaggggcctgcccctgaggcctaacacacccaacattataacaaaagactgtaacaagggctgtgggagttatgagctagacctcagatgaaaactaatatatatcataacaccacacatagattcaaagatctaagttaagttggtcattagtcaacactatttaaaagccagatatgtccaaatggctcttgaatctacacttattatagcaaatattttaacgtgtagagatgaaaaggacagattttctttaagtgtctgaagccggtaaagagaatttctgccttttttcctctgtaaatctaaatctgtttgaagaaagaagtgcgctgtgaaatgggaaggcaggggtgggcaaagacacattttagtgaggttttaatctccattttgctgagtagaaatagaaaggagttttgaggtggtttgaagggaaagtgggggagagagagagagaagaaatgggagaaccactgagaaggtttaaaatgtcttcatgttacttaggcagataggcagatatgagcagggtaggagagtgccccaaggaatgtcaggcaacagtcaggtgactgtcatgcaattgtcaggggcctccttgggaatgacagatggtcatggctggcaccaagaaggggaaaatttcctcccaaacaggaaacatcttgagcttatgagcaacaacttcctcataagatcccaggaactaagcaaacatgaccaggcatctgcagtaaggggcaaaatggcggagtttggccttccttcggggatatgtccaggcatgctcaagaaggggcaaaacgtcagagtttgcctgatatgtgaccttcctttgggggcactagaccagtaacgaaaaattgtcatggagagcatacacacaacttcagccaccaaacggcacatgcagcccctgacagatattagcaagttactgcgcatgcaaggattagccaacagttcccccaagaaggatgaggggaggagatcaggaagaatcaggatacagtaactctataaaagccttgaaccaatgatcaagcggggcactcaatcttttaaattttccacttggtcccttccgaatgtactttactttgcttcaataaacttctgacttaaatctattactttttataaaatttttttccataagttattagggtacaggtggtatatttagttatataagtaagttctttagtggtgatttgtgagattttggtgcacccatcacccaagcagtatacactgcaccatatttgtaatcttttatccctcacccccctcccactcttccccccaagtccccaaagtccattgtatcattcttatatctttgtgtcctcatagcttagatcccacatatcagtgagaacatatgatgtttgcttttctattcctgagttacttcacttagaataatagtctccaatctcatccaggtcactgcaaatgctgttaattcattccttttcatagctgtgtagtatttcattgtatatatatctgtacaccacagtttctttatccacttattgactgatggacatttgggttagttccacagttttgcaattgtgaattgtgctgctataaacatacgtgtacaagtgtctttttcaaataatgacttcttttcctctgggtagatacctagtagtgggactgctggatcaagtggtagttctacttttagttctttaaggaatccccacactgtttcccataatggctgtactagtttgcattcccaccagcagtgtagaagtgtttcctgatcaccccttccatgccaacatctactgttttttaaaatttttttattatggccattcttgcagaagtacggtggtatcacattttgtgtttttgatttgcatttccttgatcattagtgatgttgagcattttttcatatgtttgcttgccatttgtatatcttcttttgtgaattgcctactcatgcccttagcctactttttgatgggattgtttgtttttttcttactgatttgtttggggtccttgtagattctggatactaccctttgtcagaggtatagattgtgaagatttttctcccactctgtgggttgtctgtttactctgctgactgttccttttgccctgcaaaagctcgtaaagtttaatgaggtcccagctatttatctttgtttttattgcatttgcttttgggttcttggtcatgaaatccttgcctaagccaatgtctagaagggtttttccaaagttatcttctaaaatttcatagtttcacgtcttaggtttaagcccttaatccatcttgagttgatttttgtatacggtgagagataggatctagtttcattctcctatgtgtggctagccaattatctcagcaccatttgttgaaaaggttatccttttccccactttatgtttttgtttgctttgttgaagatcagttggctgtaagtatttgggtttatctccgggttctctattctgttccattggtctatatgtctatttttataccagtaccatgccattttggtgactatggccttatagtataatttgaaatcaggtagtgtgatgcctccagatttgtactttttgcttggtcttgctttggctatgcaggctcttttttggttccatctgagttttagaattgttttttctaattctgtgaagaatgatggtgttattttgatggggattgtgttgaatttgtaggttgcttttggcagtatgggcattttcacaatattgattctacccatccatgatcacgggatgtgttcccatttgtttgtattgtctatgattcctttcagcagtgttttgtagttttccttgtagaagtctctcgactcctttgttaggtatattcttaagtattttattttattttttttacagctattgtaaaatgggttgagttcttgatttgattctccccttggtcactgttggtatatagaagagctactgatttgtgtacattaatcttgtatccagaaactttcttgaattcatttatcagttctaggagcttgctggaggagttcttagagttttcaaggtaaataatcatatcatcagcaaacagtgacagtttgacttcctctttaccgatttggatgccctttatttctccctcttgtctgattgctcttgctaggacttccattactatgttgaagaagagtggtgagagtgggcatcattgtcttgttccagttctcagagggaattctttcaacttttccccattcagtattacgttggctgtgggtttgtcatagatagtttttattacattaatgtatgtcccttgtatgctgattttgctgagagctttaatcataaagggatgctggattttgttgaatgctttttctgcatctattgagatgatcatggaatttttgtttttaattctgtttatgtggtgtatcacatttattgacttgtgtacattaaaccatctctgcacccctggtatgaaacccacttgatcatggtggattatctttttgatatgttgttggattcagtcagctagtattttgttaaggattttaccatctatgtttatcaaggatattgatctgtagttttcttttttggttatgtcctttcctggttttggtactagggtgatgctggcttcatagaacgaattagggaaggttccttctttctctatcttgtggaatagtgtcaaaaggattggtaccaattctttgaatgtctggtagaatgctgctgtgaatctgtcgggtcttggacttctttttgttgataattttttaagtaccatttcaatctctctgcttgttattgatctgttcagtgtatctaattcttcctgatttaagctaggagtgttgtatttttccaggaatttatccatctcttctaggttttctagtttatgtgcataaaggtgttcatagtagccttgaatatcttttgtatttcagtggtgtcagttgtaatatctcctgtttcatttcttagtgaagttatttggattttctctcttcttttcttggttaatcttgctaatggtctatcaattttatttattttctcaaagaaccaggttttgtttcatttatttatttatttttttgtatggtttttttttgtttcaatttcatttagttctgctctgatcttgattatttcctttcttctgctgggtttgggtttggtttgttcttgtttctagatccctgaggtgtgactgtagattgtcttttttgctctttcagtctttttgatgtaggcatttagggctatgaactttcctcttagcaccacctttgctgtatcccagaggttttgataagttgtgtcattattgttgttcagttcaaataattgtataatttccatcttgatttcatttttgacacaatgctcattcaggagcaggttatttaatttccatgtatttgcatggttttgaagattccatttggagttgatttccagttttattccactgtggtctgacagagtgcttgatataattcaattttcttaaattcactaaggctcattttatggcctatcatatggtctatcttggagaaagttccatgcactgttgaatagaatgtatattttgcagttgttctgtatatatctgttaagtccatttgttccaaggtacagtttaaatccattgtttctttgttgactttttgtcttgatgacctgtctagtgctgtcagtgaagtactgaagtcccccactattgttgtgttgctgtctatctcatttcttaggtctgttagtaattgttttataaatttgggggctccattgttaagtgaatatatgtttagcattgtgacatattcctgttggagaaggccttttaccattatataatatccctctttgtctcttttaactgctattgctttaaagtttgttttgtgtgacacaagaatagctacctctgctggcttttggtgtccatttgcatggaaagtcttttccacccctttactttaagtttatgttggtccttatgtgttaggtgagtctcctgaaggcagcagatagttggttggtgagttcttatccattctgcagttctgcatcttttaagtggagcatttaggccatttacattcaatgtcagtatcgaaatgtgaggtaccattgcattcatcatgctctttgttgcctgtatacttttgttttgttttgttttcgctttttagcttgtatttttgttttacaggtcctttgtgatttacgctttaaagaggttctgtgcaaaaatcacaagcattcttatacaccaataacagacaaacagagagccaaatcatcagtaaactcccattcacaattgcttcaaagagaataaaatacctatgaatccaacttacaagcaacatgaaggacttcttcaaggagaactgcaaaccactgctcaatgaaataaaagaggatacaaacaaatggaagaacattccatgctcatgggtaggaagaatcaatatcgtgaaaatggccgtattgcccaaggtaatttaaagattcaatgccatccccatcaagctacccatgactttcttcacagaattggaaaaaactactttaaagttcatatggaaccaaaaaagagcctgcatcaccaagtcaaacctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaacggttctgggaaaactggctagccatatttagaaagctgaaactggatcccttccttacaccttatacaaaaattaattcaagatggattaaagacttacatgttagacctaaaaccataaaaaccctagaagaaaacccaggcattaccattcaggacacaggcatgggcaaggacttcacgtctaaaacaccaaaagcaatggcaacaaaagccaaaattgataaatgggatctaattaaactaaagagcttctgcacagcaaaagaaactaccatcagagtgaacaggcaacctacaaaatgggagaaaattttcgcaacctactcatctgacaaagggctaacatccagaatctacaatgaactcaaacaaattcacaagaaaaaaacaaacaaccccatcagaaagtgggcgaaggatatgaacagacacttctcaaaagaagacatttatgcagccaaaaaacacatgaaaaaatgctcaccatcactggccatcagagaaatgcaaatcaaaaccacaatgagataccatctcacatcagttagaatggcaatcattcaaaagtcaggaaacaacaggtgctggagaggatgtggagaaataggaatacttttacactgttggtgggactgtcaactagttcaaccattgtggaagtcagtgtggcgattcctcagggatctagaactagaaataccatttgacccagccatcccattaccgggtatatacccaaaggactataaatcatgctgctataaagacacatgcacacgtatgtttattgcggcactattcacaatagcaaagacttggaaccaatccaaatgtccaacaatgatagactggattaagaaaatgtggcacatatacaccatggaaagctatgcagccataaaaaatgatgagttcatgtcctttgtagggacatggatgaaattggaaatcatcattctcagtaaactatcgcaagaacaaaaaaccaaacaccgcatgttctcactcataggtgggaattgaacaatgagaacacatggacacaggaaggggaacatcacactctggggactgttgtggggtggggggaagggggagggatagcattaggagatatacctaatgctaaatgacgagttaatgggtgcagcacaccggcatggcacatgtaccctaaaacttaaagtataataataataatttaaaaaaaaaagaggttctgttttgttgtgtttccaggatttgtttcaagatttagagctccttctagcagttcttgtagtggtggcttggtaatggcaaattttctcagcatttgtttttctgaaaaagactgtatctttccttcatatatgatgcttaatttcactgggtacaaaattcttggctgataattgttttgtttgaggaggctgaagatagggccccagtcccttctagcttgtaggctttctgctgagaaatctgctgttaatctcacagattttcctttataggttaccagtgcctgttctggtgcagggggtaggggttggggggcgcaatgggctctgtgggggttcttagctttcgtggtttaatgctctatttttgtgctggctggtctcctgccaggaggtgttgccttccagagagcatcagctgtggtagtatggggaggaaccctagaactcccaagattatatgccctttgtcttccactcccagggtagatagggaaggaccatcaggtgggggcaaggctaggtgtgtctgagctcagactctccttgggtgagtcttgctagggctgctatgggggatgggggtgagattcccaggtcactggagttgtgcacctaggaggattatggcttcctctgctgagtcatgcaggttgtcagggaagtgggggaaagccagcagtcacaggcctcactctgcttccacgcaaacccaaaccaaatggctagtctcactctcactgtgtctcccaccctctaacagcctgagtccattttcagttggagggcaagatgagcttgaaaatctgccccaggctacccacctcccagctgtgaatgaaagggattggttctactccacctgtggagtctgcacgccagatgtgtgccctcccctgagttctggccaggaggcttctcaccccattcaaattgttacaaacttcagctagagattttcttctccctgtagagttttaccccttgcacctctggctctggctgccctctggatggatccctgtgatgccaggcatggatggcctgctaggggactcagagagcttccagggcctttctgctactttctttgcctctgtatttcactcagctctccacattgactcagctccaggtaaagtcagaaacttctcttgcaaacagaccttcagcttctccagtgggggtgtgtgttcaggagaggagggtctccctttcccacttccacagttggggtactcacagtatttggggtgtttcccaggtcctgcaagagcagtctgcttccttcagagggtgtgtgggtcctctcaaggttgctggtttgttcttgcagtcaatctggagctataattcacaatgcgagcctccacatgctgctctgtccagagctgcaatctagtcctgcctcctgtctgccatcttaaatctacttctgtctcttggatgtattttttcttctcagacaataagaaccaaagactgtgtatcctgcccaaacccgctgccagtaacattttggtgtcatgaatcagattgcagcttctcggtaagaccctctgtgccttgccatctttggctggaggcacccaactctgcttacgtgaggtcttctttctcttgctgtctcactcaccagcccatctccagaaaaattctctttggtcactcttccctctagcagattcctcagttcatcctggtgggcgacagcagaggtggaggacttcagagtctgtactgagtagacctaagtcactgtggcccttttggacaggtggctcacaagggtgatagggcttgagcctaggccattcaaagactggagaccttcatttccttaaccaaagtggacttttccccaataagtctacaccctattatgcttcctttttttctgtggactttgagatggccttatatgctggccacactgtctgtcttgggggcaagtcaacctcttccctgcttctattctgcatatcatgcaacttctttctctgcttaatattgggaagactctgtctccaccaattctttatttcctatcatgaatttttaaatcctgctacacattgagaccaggttttccagtggctcttgaggtcatttgtttgtctccatagggcatctgtatgtggtccattaagagcaactcctacttcctttctagagctatctgcactttggggagaggacaattctttctctgccttttgtggtctctcatcccaaactccctggccctgacagttcttcctctacactgagaagactgataggcaatgtcctcttaggtctaagggctgctgtttgtgagactgtacaaaagcagccttccatgaatatcccttattttctaccattcccacgggtggcagatggattgtcctgtcattttaaatacttgttttccatgcttccccaggaatccacaggagggatgacaaggggactcagatgcaggttttcctctgttcctctgaccatctacattcttaacatatactgggacctacagtgctatgtccagagaaaggaaggcccagttcccttacagctgctggctagggataagatcctcacctacctaaagggatatggagaatgggaatttgagagaaaggaaaaccatttcattgctggaatgctccaaacaaaggtcactgtaagatcacagtgtcaaaggtacaggtcagccagaggccacaggtgcaggacagattaccattagcagagagatgaaggctggtcctggagggaaatgtgggaccagggttagtggtacctggtaatcactggtttattccagaactccaggatgaatgggggatgccctactcactactctgatccaaggtataaggggatcaggaaggaatgctttcagctgggcgtggtggctcatgcttataattccagcactttatgaggccaaggcgggtggatcacctgagttcaggacaaaaccccgtctctactaaaaatacaaaaattagctgggcttggtggtatgcatctgtagtcccagctcctcggaaggctgaggcacaagcatcacttgaacccaggaagtagaggttgcaatgagctgagattgcaccactgcactccagctgagcaacagagagagactctgtctcaaaaaaaaaaaaaaaaaaaaaaaaaaacagaaaaagaaaaaagatgaagaagaagggactctttcctcttccttactcttccctgttctgtcttgcagatagataacggtgtctccatactctgggactgaccccttggatgcatccttaaaatctgcgataaatccaaccaccaaaccctaaaatgaaaaaactaatttttcattgcagaggaagtctggctagagaatggaagtacaaattttaataccattctccggctagaccttttctgccattatcagggcaaaaagccagaggtcccctatttacaaacctttatggcctaaagggaagaccctaatcctcgtaaagcttgtaaggcaaacctcacatcctagctatgcttagccatctcctccagggccctgcatcggccctggagactcctctgctgattcctctccaacatttcttcctccagaagccaaaaggaaaaactacctcctcctttggaggtgaaagagggagaaacagccacccctggatcctccccctatttatcccactcccagacctttggaattggccccactttacaccgggctccttagttctcctctccaagcttgtaggaggtaagtgagccaactgaactcgtccaggtccagatccccttttccatgtacgacttttgacaacttaggaaaaacctaaaaaagttctcagatgaccccaaaaggctcatagagggcttccccaaattggctcttacatttagattaatttggaaggacataaatgtactcctgggacaagcccttttacaagaggaaagacagaccatctgcggagcagcaatccactgtcgaaatgacttacacctggaaaatgccaactaccctggaggggctacagctgttccccagctggaccccaatcaggactacaatgccaaagcgggaatatgggccaggaaccataggctcttgtgtctaatagaggtaataaaatgaagtaagatcaagcctctaaactacaataattagccaccataaaccaggggccaaatggaaatcctatagcctttctgaaaagtctacaggaaacttattaagcacaccaaacttaaacccagaatctcctgagggactagtcctaaaggacaatttacccaagctgctccagacattaggaaaatttacaaaagtcagccttagaacccagtgcccctatgccacaaatcctcaaattagcctcctcagtcttttataactgagatctggacaaggaggacagggctaaggaaaaggagaaatgcagggacaagatgcaggctcaactattggctgctttacaagcccaccagccccctccagggtctcctaaggaccctcctccaggtaactgccactgatgcagaagaccaggctactggagaaggaattttccaaatgggccaaatgggaggaagccccacacagcctgccctctttgtgataagctggagataagtcccactggaagagggactgccctgggatccaaaaggtcccccagttgaacccccatccaataatggccttgagctgaaggggccctccactctggccagcttccaaatcagacatcatcattaaaggaacagagccaagggaaactctggaaatgacaggtagtgctataaatatccttttaaatacaagaactgcctactttgtgctaacctttttctctaggcaacttacccccaaattctgttgggtaacaggagcaagtagcaaccccttcctctaaagattcacatcccctttatttatattgcttatgggactaattactattctcccactagtccctggcaatgtctaaatgcctcacactgcttttgagtaggaatatactttccaaaatgggtatccacttaatatttacccaacatctggactgatatttccccctaatatcccagtttctcccaggaaagccagcagtcctacctcagggttttagagatgccccacacttatttggacaagacccagcaaagaaatctaaccaagctatatcttgagtggggacaacttctgctgtatgtagatggcttactcatctgctccccctccataaagcttgcacaacaatatgcagtacaaaccttaaccttcctagcaaaatgtaaggtacaaagtatccaaatccaagacagagaatttcatacctagaaccaaatatatatacagagagtactgctggctccagaccctctaacaaccaacttgtgtacccacccaggtccttattaaaacctaaagtgatggatctacaaaatctcaactaatcccctcatggaaaggcccttttactgttttcctttccactgcaacagctatcaaagttcctggcacctctagttggatacatcattcctaaataaaaccttgagaggcttctgaacaatcaacaataggaccagcacctgagtattcctgtgagtcattggaagatctataatatctctttcaatgaaattataagtaatgccttcttttctttcaaactaatgctagctcagcataaggtagccccagtactctggatcttattcatggtgggattgcttatgcttacacttggttcaaaaccaacattcccgagtgggcctacacccctccaggctatgtatttttatatggacctaaacaaaataaactgccctgtgagggaagttctaaaagaacttattcaaccccctcacttgtaaacctttttatctgcatagataacacccaacatacaggggatgtgccctaggactcctggggccacaaggaacaggtgtaaccatctataacattacaaattcttaaaaaaggagagctcttggccttataatggtagggctaggggctgccataggattagctgccccatacagaggattcagttatcataaagtcaccctccaaaacctctctacacaaattggagacctaggtcagagaactgggaacagaatctctaaactcaaggcttcactgaattcagtagctaatgcagtcatggacaacagactagctctagattacctccttgcagaacagagtcgtctgtgctgtcatcaataaaccctattgcacttgtgtcaacaatagtgggcaagtagaggaacatataaagagaatctgtgaccacgctaagtggcttcatgactctgggaaagaaaatccctcagcagattccatctggaactctgtaaaatctgctctcccattgctcacatggttcctcccctgctcgaaccagctgtctccatacgtctacttctttttggcccctgccttttaacctactagataaatttgtcttctccaggatataacaatttcaaaccaagttcccaataatgcaggtgatagatgcaggaggcagataagagggaggatccctggagaatctcccgcccgcctgtgcactgcgacgatggggtaaagctaccaggaagttcatgccttgttggggggaaagagcctgggaactttagctcgtgtgtgggggcttggaatccaatctgtgagatgggagcctgctggcagaaacccctctcactttgctgaaagtttttcttttcttgttttccttttcgcccaataaataataaattccattcccctcacccttccacgtgtctgcatgcctaacttttcctggtcgtgacacagaacctggatttagctgaactgaggagcagaaattctgcaatacaggaatatctacctccctacccaaatgtgaagaaaacatacacctgtttcccctggacctggctggacaccaattctacctaccgatgggaccattctgttctgacaattagcaagagattgagacccagaggacaaatacagcccttatttcagcaggaagcagccacagaggactgaccttcatccactagccccaaataattgagtctcacactcttgaggggggaatatgttagggtaggtagataggtggatatgagcagggcaggatagggccccaaggaatgtcaggagacagtcaaatgactgtcattgtgactgtcaggtggcctcttcaggaatgatagatggtcatggctggcaccagggagggggaaatttcctaacaggaaacatcttaagcttgtaggcaacaactttgcgataaaaccctaggaattgagcaggcatgcacagtaaggggcaaaatggcaaagtttgactggtatatgaccttcctctgggggcactagaccagtaaaggaaaattgcccaaagagtacatgtgcataactacaaccaccaaatggcgcatgcagcccctcccagattactggcaagtcactgagcacgcggcgattagccaacagctggcccaaaaggaagtatgatgggaggagatcaggaagaatcaggaaatagtaactttataagagtcctgagccaataatcaggcgggacactcaatctttccagttgcccacttggtcccttccaaatgtactttgcttcaataaacttttgcttctgtctgaaatctacatctgtctctcagctgaatttttttcttccaggaagacaaaaactgagggccgtagaccctgcctggactcacctcccgtaacatttagactctttatttcacttaaatacttgatcaagaggtacatgaagataacaagctatggggctttgcaataataaaggcagattgccagtctgagtttggaattggaatcggtatagacataagattcatgaaatttcaaaaatgacatatttctttacatgtttatgatcatgaaaactagtctttctgtttaaaagaaactacctgggttcctttagtctttgaacatagaactttttttttaatgttacattgatagctgaaacagttgataatcatgttctagagcaggtgagtgttgctatatactggggttgagatggggaaaatgaaataaatgtataaaggatcagaactacagcatcttaaagtgaaaacatcacaaagctcagagtaaatttccatcttgctgttgatttatatataaactgtactcacatgttcagaaggagaagtggaaatattatcttggcttacatggaagaggaaaagactatatctagttatttaaaactacctgttaacttacccacagacacagctctatgtaatgaactctagaatgtggttagtgtcaatgttccagttgtggacggaggaaacagttttcaccaaatgtagttgacaatggctgtgaaacatggcacagtgactagaatgaggtaaacagatgtcataataaccacgggacacctgccttcttcacctctatgaaaatattgctgccttacacatgggcagaggtggagaaatgagaaattctgtccttagacacttcactccaaaacctgccaggttcaagtgctgccttcctgtctcaatggagaatttccagttctactctagggatgaggctgtggtctctccagaggtgggtcatggcctcagtactataggcaggcactacatcctgcagctgtcaatccaggctgataatttgagacctagcagctgatgacattccttctctgcatggcagttgtctctaacaggccagtgcacatctgagccaaagatgacatttttggcatttgcctagacgttgagagcatccactggcttggtgggcaccagttggcaagaagggaaaaccccagccaaggaaagttttaagaaggccacgtgctggcccttcagaagcagctgcattcatagtacacactaggggaggcaaacgtgtgcctgtgtaatctgccttcttcactcagtgggagggaggccagttaacaatgatttcaactctttattaaaatcaactaacacattgctgcacttagatagtagtaaccaggcaggacaccagcaggcttccctaactgcctttttattacaagacctatttcaggcccatcccactttacatctctgcagcatgacttcccaaattacaggcataataaactaacaaaggccacaacccctgcaggcatacagagtcagattacgtctgactgaatctgctttctctattcataaacaacttaaaacagctctttccctcgcgtaagaacctgacttgccaggcacacagtgaaccagcagaagactacatgaggacaatggagatatgggtgagacaagggcaggagatgccttgttcataggaaatgaaaagctctaaagcccaaagaatttcccttaattttttccacgcagttcccttgaggttatgcagctggatgttctcagagctgagagtggactggcttactataaactattcattctaccttcagatactttcaggccctctgttacgatggttgactcaattgttcctcaaaccaaagcttatgcatgtctaagttctctgatcttaaccttttgaaaggcagtaaaatgaaagaccttatgaacttttgtttgtccgtgatcttacttcctccttttaagatagttttccttatgtaaaagaagcatggagtaattgactttggacaagtgacagagaaagggatggatttctaacttaactgttggcatataccttgagaatgaatacataatacacgttttagtataagccacagattcctctggtctgggtacactggaggcatttttataaatgtaacatggtttattgacaaattcagggaattgtttcacattggtcttttctgtcataccagaggaagttttagactaaaaataatattatccatgttttacagataagcaaattgaggtggagtacagttaaagagcttgcttaggtcacatagctagggacaaatccctattaaatggaaaggatatgagactgaattagtttgccatgcagtaattaaaatcacaaagttctgtacaatctccttgatttttaaaagaaaaagttgtctgtttcatgaaggacagctacttacagaatatatgcaatagggttaagttgaaattgtttcaaatacacaaaagaagccattttttaaaaaaagggttctgaaaggggtgaaaatattctgttagtcaacgaagcagaccacaatagtacatttatagacagattagaatttatggaaagagaaaataaattaaaaatatgaaaaatgttaaacataattgtgttacggtggtagaataataggcaagattttttttaacttcttttttcacaatctctggatgcatgctgtttttgtaattagcaactgtgtgttaaagaaataaactacgtaagcagcccctttctgcacaagatggctgctatgttatagaagtctagttcaatttatacacaggtgaatttttctaatcttttattttataaacaacgatttggaaaattcttttatcttaataaaaaaaagaccatagcccttctgttcattgcaggcagtctttagttaagacaatacacacaggaaaaggaacaggttatcaaacatgaaaggtatttagttaaaaaatcaagtccctgctttcaaaatgctcataatctaaggagattcaagttaagctcatcatagagctgtgtgcagtatccttaaactacatgctaatttcaaatatgagagagtacatatatatgtgtgtgtgtgtgtgtgtgtgtgtgtgtgtgtgttttcccaagacctttctccttccctatttaaaacaataacattttgtcaagggaaaataaacaaaataaaatagtttgaggttgacccaaaactctgaatatttgaattctaatttgattctaaagtcagaaaaaaagtctactctcctggtataatacttttaaagcaaatggaatccatcatgcatgaaaaactaatctctgacctttaatggtaattttactgattgaaaaaagtttcaaacactcagttgtgggaaggaaacagacatttgctcacagtctgcagactttggctcagctgacagtaattttccattgattgggagaaaatcatggaaattacatagctatggctggctttagactggtcttatgtaaatttcaaccttaattctgtgtttattcttttgtgtgagtgaaataacaacagagtctctataaaaagatgttactaatatatctgaggtgacctataactactatgcatgatatagttatgtcttttggattaactatatattttatgcatttataatacttatacatgcacagttaaaattcttttaggaaaagcaataaggtactctgttctgaaattgtttctacaaatgctgcagtatgagtttttcaatgacttaaaaatttccatatgaggagaagtgttagaaatgtatttttccaaatgcaggtgggaggacatcttctaagcctcaagccagttctacaggaaccaagacaaacaccgaaaagtgaaataagattaagtctctgcaccatttctaaagcagtgaagcaaaactaccttcaagggtcagtggagaagacacccagtccacagccatagatgctaggatagtcttggtcacatccccagccataccttattgagtcttggtggttgaccctgagctctcatgttctagagttccataatagccaggcttccaaatgcaaaaagtgtgtgtgtgtgcacgcgcatgcatgtgcgtgtgcaggtgtgtttaggcaaattcacttaataaaaatgggatgctgataaggtgagaaaaacactagccagacagcctaaatgaacagtaaaacacttagaatcgtgcctaacttagaatagtgcctggcacttagtctggaaacacaggctatacataatatcaggaaggacatcttcggtccgttaagatatataataactatgttttcagactttatagaaccctgtattttcataggtataagttaccatttatgagaaacccatacacaggaggaaaataaagtgaacaattttaatcataacaacttactgagttttaacttcaaagcgtgtacttatatttatacttatttgatgtaattcattacccatattttgtcagcagcaacttgtaaaaactttaaatgaactactatattgtcaatcattgctttaaaatctcaaaatcatttcatgaatacagcacattaatatatgacaagattgaaaaaagttatataaaatctgattgagggcataatttgttaataactctaggcttttaaaaattgtgaacttagagcaccgctatttccctttcaaatctccctctctcacctcctttcctcctctactccttcttttcttttcttccttctttccttctcattattcaccaacgaacccaccaaccaatcagcaacaattatttgttgaagctttttgttgttttctcattaagataaaccaattaagtaatctattttttctattgataaatttgtttatagaaaataattttaaagtattcaatttctaaagtcggttgctctaaagacccatccttggagaaatccaatgatttcctgcacttaacactgggatgaaacacagggcccagggacattcatattaaacttgaactgactccatctgtactttgttcagtctgtttattgtgcttctattgagttttcattctctcagtctgatttcctttctgctcctgttccaccaacatggcaccctgagggcttttctccatacatcagacatgttacctggcctatgtctttccctcgctccctgagatggcattcttggaacctggcattgaacagggccttcctcctataatgtgtaatgataatcctccaatctactgccctgcctagacaagatttttatgcttagggttggaatcaagtttttcaagcacaacccctgtgacagctaatatttaagggtctcagcagaatttaatttgtaaagaactaaatataaatatacttcttaaatctggcatcttgctcatcttcttgcctttgtgttctccctgttcttttttcctttctttcaaattatctcctgcaacattaagaaaagtgtggaatggaaaagtagtcataaaaagaaagctagagtttggctctgaaatgtctatgagatggtgtgaaaaggcgcctcaggactgaactgtgcctggaaaggcaactttttcttcactatatgcagccttcctgagtcactggtcactgctagcagcacagaagccacagaatgaaaggagagcaagtgctgagtgtaatatgggaattatagagaaacagggagtgagttcttctgttgtactgtatgaccatgtcaccggtccctcttaaaagataatctaaaaatagagtacacgcatgcgcacttgtgcacacacactataaggtctgctcaagtactaggattatttgggcttgaggatttttggattgattgaatacaactttatttatgtatccttgattcaggaataaaaaaatggctaaaatcttttgctacatagcaattagagatttagggataacataatctgaggatgtcttcaagtctcagatatgtaacttagctgtgcaatcttaggaaaattatgcctctttcatgggccacataaattctcaggactaattaagacacactattggcacaataaccagcaaaatgccttagtttggtttttataagtgtgctggatttttggaagaagtccaataactacatactaaggaaaatagttcaatcattttttattgctttagttcttatcattcactcagtattgctggtgattgagggaacataaacctctagaggaatgaactgataccactgcatgagaccaaaggcaactaatcatgaaatgagacagtcctgaagtaactggttctgattctgaccaagcaacccaatgagtagtttatgggctcatgtcatccctttgaaaagcacaaataaagagcaaagaaaggaggtcacacaaatggaggttactctcctgagtttgtcaagaagctcattgggcactccatagttgggaacactggtattctagaatctttatggcttatgggtcaaatccaatgctatctatatttacattatgttttaggcattgcagcatatattcaccatccttttcttcctcatgctctcctccctcagtgatattgggtttagtcacattatgtgctgtggctaacagaatgtgggcacaaatgatactgctttataaactgaggccttacaaagtattgaacatttctacttgccacattgggagttgtaaactgtgccacaaggacacgccctgggagatcactggtccaagaaggagaaacatgaagaacaagcatgaaggcaacctgcagcctgaagcagcactattctgacccattagtaggactatgagcaagaagcaaatgtcattggtattttgtagttgattgttcggtagcattactgtagcaatagctgactaatgcaccttgcaataatagatcaacacagaaaatgtgaattttgtttttctcttggaatctcaacagttctgactaattcaactaatccctaacctttctattttattttgcctattcaagcttgctagcaatctagactgttatcattccttaaatatgcttcatgtagtgtacagtgcctccaccctcgacaattcccatctgtctaatctttttatgcaagattcaactaaaatttttttctttcatgaagaacatcagattctcccactaattctttctgagagagaggcaatttcttctttaagctcttttatctctctctcttgctttattgatgaccatctgtgataaattatagtacccctagtattgttctataccacttattggttaatatatcccttggcatttgaaaatgctttaaggactggaatacttctcttgaatttcatacagaataagcccttcattagttacaatttaaattaattcactccccttgcccccagtctgcttcttctttggatatcctaactcagtaaatgtcattcccatcctcctagttgtccaagccagaaatgtgagtgattattaatccctatttctcttacctattaaccaagtcctgtttagtcaaaacccctaaacatcaatcaaacctattcacctctctccagccccactgacattatcttaaagcccttcaccactctttcctggaatattgtaattgattctcacatgttctacctacttttggtcttgaagatttgcaatccaatttcccacagcagccaaagacattttttttttgaagtgcatatttaattatgtcatttgctgcttaaaatatttcactggctccccactgcagcagaataaagtagaaatttctatgtgacttatcagatcttttatgatctacagtttacctctatagccctatttctgactgactccccaacttatgctctataccttaggccaactaatttttctgcatctccccaaacctaccacattttatcttattcccagtcatttgcacatgatactgtgtctacctgataccctctctctccttccaccaccctttccttggctatctcctcttgagctttatatctcagatcagataacattttcattaaaagcccactctggcattcctctctccctcttgctcaagcaagcatggccaggggcccttcttgcgtgttcctacagcatcctgcatttacatgtttccctgtagcacttatgatactatagtttctgatttacttgtagttgactctatgggtagcctacccaagagccattccttcctactaggcccccagtgaaattcaaatatccacctacccttgcagccacatacttacagggaggtgggcctcagccccagccaccatgagggaaacctgattgtctcagctaatcatgaaagtacgatttccaaggcagtgatttgttaagacatcggcatgtgaaaccattttggccaataagacattgaagggaagtgggacaaggggagaccatctggaaatgattttttttctttcttaaaagaagacgtaaaaagaagatcctcttttctgactggccatagttatctgcatgtaataggtggacctgtgacagacatctcgagtttacaggaacaaaccagaaaactcaccaacacttgaggctggcagaagagaaagatgaaaaagactcaggccgcctttgataatgtcactgagtgacttggagcctcccacctcaggatggctttggtttaagccagttaagttacaactttctggcagttacagctgcaagcattctcactgactgacacatgtctatcttcctcactgtactgattattaatgagaatttatgcttggagatggaactgcaaaggaactaagaactaaagaaaacatcttagaaggctgcatggcatcatggtaattaatagggaaaactttattaatgtggcatcatatagagaatcagaatcagcttttgaggaaaaggatgtagaagtcttctgatttattttctgggccagagaataaaatggaacagtaatagccttttgaaaagctaggtttaagatgatcacagaaatcctactgtaccaaattcagaagcctctagaaaagtgacctaattcagtttctgctgtgctctgccccttgctgttcactttcctatctcagctctggttttacttcaaaagctcaggaacttaaaagggggaaacctaacaacatatttacctaaactctgatcaaagatccaagaaaaggtcaaggtgatagctgaacccacaattatattaaccttttgtggaaacattgaacaatgcagtagtatctttgcttctgcagaatatcttgttagaaacaggaatttcaagaatagccagaaagataaatcttcttgctacctacgtttttacgctttaaatagtaaatgcatagcaaaaggacctacacagtagtgtattaaacagtgacacctttgtatttatcaataacagaactctcaatattcataaggaaatgtaagataatatggataaccaagattattgcttgagcatattctttaaaaattggcagacagttcaagctcctatagtgctgcaaatggaacttattgtatacttatagttacttgtaaaatgagataattcgtataaggtagaagttacccctcccttgaaagtttggtagaacttgtatgtagaattatttgagccagtactattgacagtctgcttattcactaatttctatgtgtggaggggtaggggtgtctaaaattgtaactattgatgcaatctgtcaaattgtataggtctactctagattttttttttaaatgtgttgagtcacaatgataaactagattaagaaaatgtggcacatatacaccatggaatgctatgcagccataaaaaatgatgagttcatgtcctttgtagggacatggatgaagctggaaactatcattctcagcaaactatcgcaaggacagaaaaccaaacaccgcatgttctcactcataggtgggaattgaacaatgagaacacatggacacaggaaggggaacatcacacaccggggactgttgtggggtgggaggagggggaagggatagcattaggagatatacctaatgctagatgacgagttaatgggtgcagcacaccaatatggcacatgtatacatatgtaacaaacctgcacgttgtgcacatgtaccctaaaacttaaagtataataataaaaaaaagaaaaaaaatgtgttgagtcagtttgtttcatttttgtacttttgtgttacaatcaaacttaaaaatataacccatggtaaaaatactgcagctttaaaaatacattattatttttccctctctgtgattctggagccatatagtctatagagtagccccccccaagacacatataactattaaatacttaaaatatggctagtccaaattgagatgtgtcaaaaatataatacacactctggattttgaagacttagtatgaaaaaaataatttcactgacttttaaacttttaaaaatctggctattaataaaaatctaaaattgtatatggggtgtgcattatatttccactgggtagcactgttctaaagcattcaacagctctcctcacattatgccctgcactacagacattgacatatgtgtaatctctaaaacacatgttacaatgaaaaaaagcatattatttcgaaatagatgtgtgatcttgcttggaaaagacacataactttcttgcatttccattgcttcatctttaaagtaaaagggctgcataagatgattcctaaattcctttccaattcgcatatatttaatgacttcatcatttccccaatagattccaaagccagagaatacaattcatgtaatagctcatttcagtttgataaatatttctgaagcatttgtcatgtgccaggtcctgtgagaggaggtaattttacacctaaccatcttccacctttttttagcactattctttattcttggcaactctttgagaaatatctatggaatgaatggacacattattattctgctgtctcatatgttaatacagaaacagaaatacacacacacacacacacacacacacacacacacacactccagactggctgtgaatgaaataccaaaaaaaaaaaaaattaaattgagttgtgattctttagcagaaactcaagtgcccatataactgaatggtctctggatctggtagctaaaagtgctttactctttctgaaaaatggaaaatgcattataagtctaagtaaagagcactccaattttagctgccttggccccttctgaggctttcctgggtcaataattagcaacagagcccaggagactgggggaaggaacaggatgatgaacaagtgcaaatgagctaccttaagaaagcgatagcacaaagcatgagagcactcagaattgtactgcaaagtgttcagattaggcaggcccaaaaatgaaaaaattgaaaattaataaaccagaacctagctgtatgcactgacttaatgagatccgttgttaatgtaacacatttttgcctactacttttgtgaagacttcttaaattattttaaatatttctcaagaaatgcctctccaattttactggggttcttaacgttcttctcaattttctttccaaaagcataagggagagaaatgaaaagatgatttgaaatactagaaagaatgtaggactaagagccaggaaatttggtttctagtcacagaactgctacaaactggtgatatggagttgaacaaattgtttagtcttctttggtccatttcttcgtctgaaaaatgaggataaagctctgtatattctagaggtggataagggggatcaaatgagataatggtaagaaaaattacatttacaagatacaaatgttctataagtgtattttatacaaaattatcagagaagtctcttatgagctaaaatatgataatagcacatgtggtccaagatccaaaagtgaagactaagaagaaaaatatataacaaaaattatatccttttattagaaatagcacaatatccattaaactaacctttaaaagcacagggagcagtggttaattatatagactctgaagacagactagtggaatttgaggtctgacactgccatttactagctgtgtgatttggggcctctcacttcaccttgtgtactgcagttttcacatctgtaaaaagggggtaataatactacatccctcctatgtttgttgtgaggattaaagcacttcacatatatgaaacactggcacaatgtaggtattatataagtatagctgttatatgggagtacattctagaatgctttaaactctaggcacacttcctagctagcatttgatttatcttgtttgaaaaacagcctgtatttaacatatacatatcagaggttggaagtgtcacaagtgtatgttgggagaacaaagaaaagcaacttcagtacacaatccacaaaataatagcctcgatggactctacacttcagagggctaaattagatggtgaaaccaagtacactcatgtagtgccttggtacatgtgtggctttgtgtttttacattttcctcaggtactgaaataatgactaaaaacaccctgtatttgcattgcatttaaaaaaatcactttcacatatattacctcattagaagttgagggtcattaaaagtggacaatgaacttgctttcaccctcacaaatctctctgaggaatcaagtcaattgaatacgtgtacttgagaaaaaaggtgggctttttgccaaatactttctggcagctcataagcctgagcttttcatctgagccaactgcaagcctggaagggtccagaaaagcgactcatctgctcagcagacctcactgcccctttgttgtggtgggcacggtgcctttcacacacagctgttggtcagtatgtggatcaccgactgcatcctccttgcaagaaggccattttggatgtttcgctaaggaatccaagagtgcaaggcagagaggggaggctgactagttggggacttcctccaggattttcccataggctccacccagttgcttcattccattgatggattcaagggtgattttccatgagactacacctaatggaaaaggaagtctcgggctgttcttatctaatttgccaactgttacatcagcattattgattcagagcccccaaatcagggaaatatagaacagatgggaattccctgcaaatgttttcatggaatcatttgctaggaaacccccaactagcaaaaagcataaacatatacctttttattgaagccctgtaaaatctaaccagaatgcttgctccaggaagagtctgttctcagaaatcatgttgtctgatcaagtttacttcttttgtctactcactgaagtccttaaatacattataagagaatatgctaaacatatgtcaaccttcaatcaataagcatagtgtaatgtctaaaggtcatgatttggattatcacaatactttaggtatcaaaatttataaaactgagcatatctatattatctgccaaatggaaccagattattttaaaaatttcttcatcatcttgtgttatttgaatgtaaaaaacctgaaggcaggctgtccttgtctacttattcaacacttagatcagtgcctgaaacatagtaggtattcaaaaatatttatagaataaatgaatatctgagaagctgagtcattctcaccacattgacattttacatttatctatagtcaaaacagtctcaaatttatgaagggaaattaatattagcaacataaaagtgttttcttttgcagatatatgacattaaattataattgtgcaaagtcaaaaagtaatttacaaattaattatggagcattattaagtgagtcaaagccattctataaataaacaatgcagtacttttctaaaggttgttactattatatgtaagcccttgggatgaaaactgggagtcctatctttaatatgttcatcacgttaattaatgaatgatataaacaattcatgcaaacacctcagtcaagcattactcttggggatcagggggctatttcagtaacaagagttaaaagcagggaacacaatcttggatttggtaaactcatctaaatttcttgatattctccaaagagtagcatttaagcaaaacctggtacagaagtgaaatatatagttgaagccaactttcccttggtaaggtaactatgatcctttcacattagtgagatcgtttggaccccatcgctaaactagccccaggcaacctgttcttggtggcattctccccacctcctcctgcacaattctctcctgcagagagaagggtaaaagtcttcatgctctcccactctccaatgatgctcatgaaaatttgttctcaggtaagattctaatctcacgtattcacactcacatacattcaaatcaccaagctaccttcccctgaagtatctgacttactggtttgcctctatgttaaaagagaaaaccattttttttatttctcaaaagaaattttaagacttagctgtcaggaaaataatgtcttttagtttatttcgttttgagattaaaggcctttctctgacattgaaatttcatatgtagactaaattgaacaatttggttatgttgtttcagctacttacaagaaactacacaactcattggctggttgtctcgctgtggcacttctctgtttatgttgccatggcttcctcgacagcctcattcctgccttcgtgtctgacacacatttctgacatcgtgatggatgcctctaccctgagcaccagcacctcctcaagggaaacgcagcctcaaccacactcatcattttctttcatcaaccgcctgtccttctggatcgcccagtttccagtcttgagagctccgttatcactgaccctctgtctcctgatcccattgtagtagttgatagtgtcaactatgttacacctatacaatgttttcagaaatgacctctttttctattttcccctccatgaatttagtttataatattatttcttaaaatacaaataatacttgctcattgtagtttttccctagggctgccattacaaaataccacagacttaggtggctttaacaatagaaacttatgttttaaaacagttccggaggccagaggactgaggtcaagatgtcagtggggttggtttcttcgggagacctctcctcttggcttgtagatggccatcttctcctcatctccacgtagtcttctctgcgtgtgcgcgtgcatcttaatctccttttcttataaagacaccagccttgttggattcgggtctaccctaatgatctcattttatcaaaatcacctatttacaggctcaatcttcaaataaagccacattctgaggtcctaggttaggacttcagcatatgactttgggtgtgacacaattcagcccataagcctcatgttttccctatggtatgtgctctcagtccagaatgacatttcttttccagaatcattttgataatctatagaaaaactgttccacagccacagagccatccttaaacaaagtccctctgttcagaatccaaggcctgttgccccatgttaaatttatgttttcaagttccctttcttgcaattctaataaaacacagtcactctgaatctctcaaacacaggcttctatttcctacttcttttgcttctacttaggttttctgtctccaagaatgaaattatccttcaacattctaatcaaatgctagcttactttagcgccagcttttctcagtctgagatatgttcttccaaacaatcatgattcctggttcttagatccatggcccatttacctggctctcctatttcatttacctttctctgtgggtttcccagttcaccaaatcataagtatctatgaatagagagctccttagagcatggctactgataaatcattcactgagttgactaaatccaggcagtatgacatcaatcatttcagaggcaatatgatgaaaatatttcaaacaattattatttattcttgtttttatcttgtaaacatggcataaatcagattttgatgaccaatggtcagtgatggttttttttggttatttttcttcccaaaacagcataaaatttttactttaaacaattacaatatgtatgtatatactttattgaatttttggtgacatttttaaaaactgagagaaacactgttatttttatccacattatgagatggaaagccctggggtccattatgagtgacatgcttgcctaatgttttgcaagatctggcttcaaggcactcttagataatgtctagtttattttccactctaattcaccctttccaagatttactctgtatttgatataaaaaatcttagttcttctccattttcctgtccttaagacaccttaacaaattgacattaggctttaaaaactatacattaatacaggccaaatgtggtcgacaatttgattggctagcccacagtcttttccaaacttcttcatccttgctatctttattaaaaagaccagaaaaccaaatgttaacttccatctttctgcactcaagatgaccatgtgtcatagttctggctaaagggctgtaagctctggggaagggctttgtgtttcttataagtggggtagatacaactttagctggccatcctctctcatccttcctccttccctctcactatctgtgacacagacatgatcatctggacgtgcagtagccatttgccatcaagaggaacaggccaagaaaattgtggagatgctgcctctttgcaaatggtgataacatcatgcaacagctgaaacacctccggtgccacctacttaaaagtaattcctatttgttcaagctattgtgagtccaggtttctgttatttacaattgaaagcattgaaaactgatataccaagcatatctgttggcagtttgagttttcctcaaaggaaaactcttttgtagccatagaacatactctataatcaaaatccagttacaaatccgcgaatccagttctctaggtcaaaaggaggcaaaagagaatgagttggctgttttcactataaatcactcaccactaaggggatctctgttatcttcttttttttaatatgaagggcagcatttttcttttccctcagggattgttattaactattttctggatatatcgagaagggggaagttacattaaaaattagacagaaaggggagacttttcacttaaagttgtgacaaccttcacttaaagttattgtaacatgcttcttgggaaggaagaaggcataggatggcatagcatgtcaaggtccatctgctttcttttgattttccctgtgcagaatacctcataactgtgatccatagttggcaagaatcccattcatttccaacagaaatccaggaagcttagtgtgtctctctccagttcattatcagagcaattaaaatcagcagttttaatgctgcttaaagggcttcagattttgtaatttatgtagcctaaggcaagattcattttttatggagagattttgattccatcctaaagagttctaattaaagactccttggggagtttttcttgatctgctggatttaagattctttagtaaataacctgctaagattatttctggtggggataatttatctttaattttcatatcctaattatatttcatacatatcttgaaacccaggtcagtaatctcattaagtaaatataaaatagtatataatatactataataaaaatgatgcattgttaaaagatgtatgcaaatctttaaacctgcaggtcttgtttatgaggatccaaagctgaaaagtctttactgctacttatttgaataatagctaccttcatatgcttaatgttaagttatagggttttcttttaggtactaagtttcctcataaaaggcatacaatcattatatctctgagtgtttttaaatttaatagtttttttaaattggagtctgatagcctttataggattggccacttgtttgataatatcagtgctaagggaagaaattaggggaaaaaagttggaagagaggatccagtggagttttttttttttttttttttttttttttggagatggagcctagctctgtcacccaggctggagtgcaatggcatgatcttggctcactgcaacctctgcctcctgagttcaagcaattttcctgcctcagcctccctagtagctgggactacaggaacctgccattatgcctggctaatttttgtatttttatagagatggggtttcaccaccttggtcaggctggtctcaaactcctgacctcaggtgatctgcccgcctcagcctcccaaagtgctaggattacaggtgtgaggcactgtgcccggttgatctagtgaattttatttgaagttgtgtttgtagtgtaagcatgttgattatacgtatttagcttttatgttagttgtgagtatgtacactgggaaaactagtgcctcccaaccaacccttggtaccaccattgttttacttaggtttgtagagaaagcaaaaccatattaatattggaacagaacttgaagcgggtcttctcctcacctccccattcctaaaaaaaaaaatcatttttatattctataaattaattacattctgtgtgtctcttccatggaagagatcaacctaataagaataacagaaatcatctaatccttcccatttcttcttgaaatgttactggtacatatgtttttccttttcctgaaacccatttgcctctgcttttcacttggctaattcctattcactcctcatttttcagcttatacactacttccttccagcagccttgatttcccatccatcatattaattggttctctcctttcctgggatctttacttcttcaatgcattttatctaattatgcatttaatcatgggctgatatgtttaatgtttttcttcgctattcctttggaaggctcatgacagcaggaaccatgtcggtatgtttaccactgtgacctcagagcacagtccagtcctggcatagtataggtgctcaataaatactagtagtgaagatctcagattgctttcctgtgcccagagcatgggaaccaactccaagaagcaatagcaataggagacttctgacagtaaaatctccattttgcagaggaaacagctatgaaggcagaaagtgcccataactcaggaaaagggaggatggcaaagaactgcatctatttcacagtcttgctcagggtcatggctgtggttatcaatctttgcctctaaaaatacatagtttttgcccctatgggtggtcactgcttagtcactgcaatggatttgaactacacaacctacatttatcacttttacccatttaagaccaacttaaaggcaaaaagaagtaaaagaatgatgaagactttttttttaagattctgcagtaccttcataagtgtctccctctcagggatgaagtaagaattgctcctttaaaaagtgtctttctgtgaaaggaccggaaaattcctaaagatagaaactaaaaagctagatggcagcagactgcctttcatgtccctatcaatgaatagattgctaactaacaatcaggggcattgttcatatcaataatataaatagttcaaaagactccagaaataagttcctaaggcactcccagccatttggaataactatggcttggaaattttcccatctttgtaattttgcaaaaaatgatctagactagaggtctataactatattcagatgattcctattcataaactgagaataaagaacagaccaacttcagtaacagtgacattgctgggagaataaattggctcaagaagtaacaacagcagcaaaacggttaaggcacttcaaggtaatcaatttagctctatcgctttttgctgtgactctgaaggaagttaattgaatctctgaaagtagtatcttgctgcctggaattggtacccacaagcttcaaataaactattccatgaagtttaagctgtccttgacagaaagaagggcacaatcagctccaagccattagggaaggtataatttcacaaggcaagacagccaaggaaagtgatcctcaaagggaaactttcgtagaaaaaattttgtactttcctgtccccatccatcagtaacctcaacagagctatttttggattgtttccctttattcctattgatgactattattatatttttgaaaatgtttttgttaatgttgttagaaactggtaggttaatgaaactttagccatggttgttgttgttagaagcaggtgtaattaataaaagtttagctgtgaaggccaggcatctcagggttcaaactttagcttattgactactttttaagctatgcaacccttagcaaactgcttactcacatgacctctgttctcacagctgctaacagaagtggtggcagtgataataatgttgagaattgttttgaggtataaccaaattaccatggaaaatgcctagcaaaagtccaggcttatagtatgagctaattaatatatcaaaatctcattcctttctttttttggctttcctttcttctacggccttctccatcttccaagacccagccttagtagcagatgatgacttgggtctcctgcctaccaagaagcccagtgcgctggcttcctgacacaagacatagccctgttagggagtcaggaatctatttactcaatgttcagttcatattagaatgcaaatgctcttgcaaataaaaaacattaactcatgtctaattgcttatctacactttcagcacttcttcatttttttaaaattttactgtgagcaggctctaaaaagagaatatagcaagaacaaaggttttggctttgatgaggaaaagtgtgtggagagaacacaaaaagaggagaaggatgaaggaagaagacaggaaggtctcaaaacctgagctcctgcagcagtcactccactgaactagcccattctgagcttgtccagttcttttgtaaaccaagcttgcatgcttcttaaattgtcaatggttagcttttcatggttcttaaaaaacttaaatttttaatgatgctggtataagtgaaaggcattcataagttcccccccccccaccttttttttttttttgacacggagtctcgctgtcgcccaggctggagggcagtggtgtgatctcggctcactgcaggctccgtcccccggggttcacgccattctcctgcgtcagcctaagttcccctttttaataatgaaggtcataaataggagcagtcaacagctaacatttttgcagtatttaccatgcagtagacactgtgctgggcactgtacatgattatctcacttaatccccacaaagccttatgagctattattattatttcaatttacagataaggacactaaacagagagagaatatacagctaccaagtggcagaatcagctaataggccatgtgttgatatgttctgattgcagagtttgatgcctctcctgggtgaactcaataggaccagaacacagttctactagaacatctggtatgatttcacaatgtcacgttgtttttgcctttgaagtgaattggggtattctgaatgggcatggggacattttaagaggtcatggggcacgagattaaacctacaaatgtcatgggagcctctccatcttgtgaaccctcttactaaccaccttcattcccatttaggcttttacaaaacacatgactgtaaactgattttctttggtagaagagaggaatgttgtggagaaaacacttgaaaaagttcataggttaaaaaaacacaagaactacttgtttcatacatggttttatgtaaatgtcaaagataacctctcaaatattctttaagtttccactaatatgtgatatcccaaaaatgttgcctcccgtgataatatcttgcattcttctgttattccatgaagcatatcttacttggttctcacagccaacaatcaactgaggtaataaggaaagataaccatagccctgctttatagaggcaaaagtgggatctcatgctatatggcacagcagaaacagaatctcaaactagtatttaggcccctagtcccagccaataacaagtttcattagcgcaaaagttctttacctacacacagtctatggctttcttggtgaaaatagtattcttggtgaactgaattttgcacaggaaacaatggactcagcatctcatattcttgtttagtgtatcttaggaatcatgtgcatgtccagtctaaagcagcaggttgtctaaagagtgttcggctaggcagtgccgaaagactgcacgtcattagcttttgaaagtcattaccattaagtccatgtccctaaattgtttctttctgtgaggaaggcagaggatcatatttgaatccaagatcatcgaagtatggtagacatgaaaggcgtgtggttagggcactagcagaactcaagagcaagtatgcactttccaagttcccagggggcaggctgatggcagaaatgtctaatttgaacaaaactgctaaataacttgcttttttacttaaattcctacaaaaatttcccactgctatagcaactattaatgaaagtctgtttttatgcttctcgatgacatttttagcataatttagagaaaaaacctcagaaaataaaaaaagtaattgtaagacatatgttatgaaaatatcttatgaaatatgttatgaaacttttgttcattatgtaaccagtgccaaatttgcaaccatttaggtctctgatggtgataacttatttatcttgtcattacttttccaaatcccaagtcctacagaactgtagcttcaactagaagccaagccctacctttgtcctacacaaaaagagacctagactgtgagcagcctcgctacagatttctttgactccctttggatcacacactatgaatataagaataaccaagacatgcatccaagtttatttttaaattctagttttgctttttctgatgtagcaaaaagtgagttatctgagcatcaaattacatattttcctgaaatattttatattttctcaaagccattttccttagtaactaataatgagagatgatagaaggcaatttaaggcatctcagcatttccaaatagcattctgtctaaggttagtttcagcatgcaactggtgataaatggcatatagatgcatgtgcaggggaggaggtgttctgtggcaaaagaagtttgagaaaaagattttaaaaagttaaacagttttttagcaattctcagtgcctttaatatgcaaatcaatgaatcatgtttaagacggtaacgatacatgcaacatttcttaaaatgatttaagtatagaaccattatttgcagagcagttgcagggaccagtgttccatgggcacacgttcggtcatgtgggctcaggagtcacacagacctgaattcctattacagctcagaggagctgtgcgtccttgagagaatgattgaagcacatggtaaatgttggtgtcttagcctcagtctcttgaggttaacaaaaggtcactgaattcaaaaatactaagaaaactacattatattcttgacattcaaatgcatcttcacaaatcccctaattcactaatatcactctagcatttacttttcccctagaaaaatttagtgggtttttttgttgttttgttttgttttgtttaaaaaaaaaaaagcaattctcattggtgcattaatccctgttgctttacaggaatgtgttcagtcttctcaccctctctggaatctcattttcatcaacagcccctatttgctaatgttttaattctctcttgatgagcacttttgcattgactggcacactctacagaaagttccaattttttttccctagaaacaagcacagagtgaactacgatggacttgctcataaaatttgatctcatttatcactttaaattttatccttttaaagaattaataattttcttagctgtttttgcgtagtgtctactgtctagatcaacgctgttcagtagaaacataatgtgaaccatgaatgatggccacaacatgtaattttaaatttttaaaaagccatattacaaaaagttatttttacaaccaggtgaaattaatgtatttactttttacttttgtgggtacatagtaggtatatttatggggtacatgagatattttgatataaggcatacaatgcctaataatcacatcagggtaaatgaggtatccatcacctcaataatttatcctttgtgttacaaacaatccaattatactctttaattaaaaaatgtacaataaattattgtgactgcaatcagtcttttgtgctatcaaatactagatcttaatcattctatctaaatatatttttgtacccattaaccatctccactcccacacccctgccactcactacccttcctaggttctgataaccatctttccactctatctccatgagatcaattgtcttcatttttacctcccacaaatgagaacatacaaagtttgtctttctgtgtgtggcttatttcacttaatataatgacctccagttccatccatattgttgcagatgacaggatctcattcctttttgtggctgaatagtactccattgtgtgtatgtaccatattttctttatccgttaattggctgatggacacttagatacaaccaggtgaaattaatttaaatatgttttatttaaccctatacacagtattagtatttaaacatgtaatcattatgaaaattacaaatgagaaaatttttactttttttcacactattatttgaaatcctttgtgcatgttacattaccagcacatctgatttggattagccacagctcaagtgctctatggctactagctctcttgttggacagcacaggcctagattagcagtcagcttccttctgggtggcatttttctacacaggtacaatgtgtttatcagttcagagttattacatttgcaagggagggtagagaataatgaaattatattgtgatttgaatacttggtggtgcatgggtcccttcaatagtttggtaacttaaatccacacgagagctccgttgtactttggatcaaattactccctgtcatgaagcatcagagtcccttataatagtccacaccacaaaagccaagggatttttgtaattgttttacaagtaggaaaagcaataacagtgatttgaaatttttacaaagttaaattctgtaaatatatgttgaatacaaattgtgtacttgacacttggctagttcttaacactgaaagttttttagatatgagacatccaattttcttggcaaaggtatgtatgtatatataatgcgtatgcaaacacacacataatatatccatatatatccaaaatacatatatatgcatgtatgtatgcatggcgtaactcctatctattttacagggtcacttggttggtgattatttccttcttttcctttgaatcatgggcactatagaaaagcataaaatcagtcttgtttcataaattaatttttctattcaaacttgcacttatctttgatggaaagaaatgtatagcctattcttgtgaataacgctagctgatgtgagctgactgtttactctatgccaggcgctagtttaacggctatatatgtattatctcatttaatacttgaataactctaatgatgtaggcgcagaggcacctgaaacagagcacacttaaggaatttcataaatgtcatacaagctgcaagtggaagagccatgatttgaactcaggaatttctgctcaatcatgaagtgaactactcactttaaatgcatagtattctaacactctctttttagataatgatttgttagctaacctgaattaggtccttaaaagcaattctcaaattatgattttacatatctttgaaggtcttaacggaaaggaactttgtaaagatagttttatacttagcataacctctcattttattttccttcaagacaaatccatgaaaaaattcagcttcattccttatctctgacaaataccagaatgcacaacacatggtgcctctgatctgtatcgtttcccctagcgcttgcattcatctttgatgttgatattttgtggtctagtggctcttgagagaagacaattacctatctcctttgaaccataaattaccatatttggagttgcttcttcatataatttttactagtcctttttatttctctcatatataaattgaaatgttgaaatgatgagatctatttttaaagtacataaattttggggaggaatgggacagagtttaaattgttgacaattatacataaaccagctgaatcaactgggcaagtaaacatgggcaagtaaactgggcaagtaaaccttcagtttcacattaatccatttgtgtgtaggcatcagggaggtctcattcttgtaaccccagaatataaaatataaagtcagaagtagtcttcattttcacacccctcctcttttcaaaaaattcatttaaaaatatttaactgacaaacattgcatacatttatagtgcgcaagatgatgttctgaaatacgtacacattacggaagagctaaatcaagctaattaacatatgcattaactcacatacttttttgtggtgagaacatttaaaatctactctcttagaaattttcttttttttttttggttttgttattatttaaagttcagggatatatgtgcaggtttgttacaatggtaaattcgtgtcatgggggtattaagcctagtatccattagttatttttcctgattctctcccttctcccaccctcccctctctggtatgctcctgtgtctgttgttcccccctatgtatccatgtggtctcattatttaggtcacacttataagtgaccacatataatatttggtttacaatacattgttcttaatgatagtcaccatgttgtacagtagatctcttgaacttattcctcttgtctaactgaaattttatatcctctgaccaccatttccccaatccctcctgttcccatcaccccctggtaacccccttctattatctgcctctgtgagtttgacttttttagattccacatagaagtgagatcatatacatctctccttttgcttatacttactagctttcagccagaagaacaatgttagcaaaagggtcacttttgaaagctgaccaacccctggttaaaacaacatatatcagaatgtacagcataaagtttaaggcttcataagtctagcagattatatactcaatatacatttgttggatgaattattgaattggatataagttcacagggacattgagctattctttgatatttcctgggcttggtgttgatttcatgaatgcatgcttgatgtatgaagaaatatttaggcacatatcttggatcatttacaattttctcatacctccataatgttatttctgtaagcttaaaaggatattgtaatatacagtccatacactcaatttcgaatgagaaggttgaggacccatgaagttaaggtaacttgtccattgttgtttaatgagccaagacaaaagtggaaatctagttcagccggctgctgcccttccatgcaaaaactggtataggtcatattatgattaccatttgaatgcaacctaacaaaatgttgtggtctgagacttcatttatgataataatgaaaatttatattaaaagcaagaaattacattttgcgtggtggattacacagtacatagcacataaatgaaatctggaattggatttgaatatttaaaagtacattatgccttcatacaagatactaaacgttttatgggggaagaggtttttcacaagggttataataaaaatactttttatctatgtagttgttccttagcagttcctcagtagttcttagtataaccaagaaatactaaaagatgtattggcccatgccttcccctttccccaaagtttactgtcataatggtaaagggtgagcgaaaaatgcttgaaaagcagcccatgatcactgaatgattccatttttagcacaagcttcatgatatgaatcgagtgactcttacgtaaaaattacatactttttctttttttcagagatgaggtctcactctgttgcccaggctggagtacactcctgtgatcacattcactgcagccttgacctcccaggctcaagcaatcctccctcagcccccagagtagctgagactacaggcaggcaccatcacaccctactaatttttaaattttttgtagaaatggggtctcactctgtagcacaggctggtgtcaaactcttggactcaggcgatcctcccacctcaccctcccaaagcactaggattatagggtaaaccactgtgccccacctcgtatgctttttcaaatttcacgatgtgaagtatctgtctggtaataaagtgatatattgtttcacatcatgaaacccttagaatacgtttgatattgctctaatgtttacttatgttccctcatatgccacaaagtagagagccttaagattggattttgaaagctttaagaaatgggacccacagttatcacacatactaaatttttcctgacatcatctaataattaatgatcacattttgacatggtacaaactgaaccaggtcaacaaactttatatgccagaagccggattgatatcatcaatcagttatggggagctttggagatgacataaaaatgaggaatatatattaccggaatcttaacattaaaaagacataatgactataatgacaaaaaagaaagaaaataaagggaaaaaaaccttctttaaatgcatgggtaaacaaaatcttgaaaaagcaatacacatttattttagcgtgacttacactgcctatgcatttactagtgtttttcaacaggttaaggtggtttaggaaaagtccaaaacatattttccaagaaataatgtacgggaaggaaaacctgatttaaagtgagcacgggatatatagcaagaactcaaagtacgacatggaaattttaaaacagaataaaagattatttattggtttttgctaacaatgattactattggtttgaaaaatgaatctggataaaatgtagaataacatcacatatttaagctgcatatggatcaaacagggaaaactctatttctgcatatcagatcgtttcttattttagtcacttaattcacagttacatagtattcatcatgaggagaaacagacagagtgtgaatggctcactgttacccacactattcctggaaaaacaggtcctaaagattaaaagactcaactgcataaataaaaggcatgatgacattgttattacaggcaaacattttttaagatgccatcactgaaaatggatgacctatactttggtaagaatgcagagaactgaaacatcactttgggggcgacataaatgtggcaaccagtatagaaacacatttggcaatatctaaagacaaaggcataacctatgacccagaaatcctacctcttgggatatacccaacctacgtgtatgcacaaaacactgcaacactacatgtacatttgtttactaagtgatatatccaataatgttcataatggctctaattcataatggcctaaaactggaatacttaactatccatcaacactagaataagtaaattgtagcatattcatttggtgcaatactaacaaaatgagaataaagaatgcacaaaacactatgaatgaatcccataaacacaatattgactgaaataaaataagagtttatattgtataatttcattcatataaaattcaaaagtagtcaaatctatgctattggaagtcagttagtggttatcttcgggtgcatagtgactggaaagaagaataaaggggtccccttgggagctggtaatattttgattttgacctagatgttggttatatgagtaaatatggctaagcatttttttctctcttactggcacattcacacccatcattttataccaaatagatccttgcagagtgctaagggttatctataaatagcaaagaaagagaatcctttccattttaaccaacatgaggaaggcaagactgcgagacttttttttttaagtcatgtagtgctaaaacaaacaataagccttttaaattcactccaaaatacaggataatttgtttcccccaccgataataatttcttctttccctttcttggcattttggtgtgtcagatctccctaaggtttatgttgtctcagtttacacggatttgctttaggaaaaaaacctgacgttccttgtatgagtatctcatccaaggggttgaaaagcagcgcatacaacagaagttgcacaaagccgtccttgtcatcttccacacaggaggacagagaacaaaaacgtcccaaccagtgagtggcagtgccactgaggacctcctgaacaactctactcaaagcattttgaactttataccaagaaactgaggaaagttaggagggaaaatatatagtccttttctagaaccagtaagatgtgagataaacaattatttgagcgatgaaatgttttcatcttttagttcatctgagatcagggcagtgatacttcatagaacccacaaataaaagcttttcgtcaggtacaacctgaagatggcagaaggagttttgttgcttgtttttttcctccactaaagtggccactctttcactagagaatgtactaacgtcatcaaattaatgtgattcttaaacaggacataaatcttccctttggatgggaacacaaatctgattcattaactttccattctttatctaaacactgccattatgtgaaaagaaaaattcctgaaaatcaaggatattttgcagttaaatccctcctcccagccagtctattttgttaccctatataaacaaactctgccattacattcctttatccatagcaacttccagtgggtaatccacaaatcaattaaaggcaagttaattgccaaaaagggatcaagtgacaagcattggaagcatatttatgggtgctattctcaaaatctgtgtgtcagaaaagtttcgtccagctagctttccttttaatgcaagatttaaaatttgtattatttctttgaaaataaaaaattaatctcacagttattcttagcttaaggtgtttatgttttgtaggcagacacagacacatatttcaaacaaaacaaggttcctactataggactattactactgctaccgatttttaacttccatttttctttgctttagtattttctacgtataaaaagttttgagatagtgtgaaacaatgtaatagaaagtatattgtaaactgctcctcttccccctacatcttcttttcatcttcctccttgttttactttccctcactgtatttttataataacaaagaagcaaaggtaaattcactcaagagactggagactgaaaacaagtcagtaatgaggtcaatatttatatggttccattgaccttgtgcagttctgagtttcaggcctagaactacaaatgtactcacagatgtatggaatggatatgcttgaacttatatgcaaataaattatcaatttctttgtaaaggtttccctggcttccccaagcagaacctctcatctcagtctctatttattttatttattgttaacttgtttattttctgtctttctctaccagaatgtaaacttgatgaaagcagagaccgcatccattttgtccctcactacattctgttacatttttaggagtatttataagtcagttgttaatacccaacagttattaaaaattaaattacataaaaatttttaactataattaaacaaattatattaaaaacaatggaaataagtattcaaaactcataacttctgaatgatttggctacattttgtattattatgtttttggggcaacttatatctactgtatctatatgatagaaacactgtatagagtactatgtctatgtatctcttgccaactccacatttagtgacctctgctgtttgaaatgggcaggtgagagaattttttggcacagaaatcagcaaatactacaaatagtgcccttcccctcccccatagagagctggttgtgaacatttaccacctgaaggaataatcttttacattctgttctgttcatttttgaatgtttaattcattgtcataacaattttagggttttgtttttatagagtttatttctttagctcaacacaaagcttatctttttaaagcttcacttcaaagctttttttttttttttggaatgtggcttacatacttgtcccctttgaactgtcctttgcatttgattggcttaacataattacagtaatatatatttactctattcacaatccatctttcctctttatcattttagtttttctcttccaaatttacactattaccagctaatgaattatataatttgagccatgtgccatggctcatgcctgtaatcccagcactttaggaggctgaggtgggaggataacttgaggccaagtatttgagacaaacccgggcaaaacagactctaaaatatatattttttaagccaggaatggtagggtgcacctgtagtcctagctacccaggaggctgtggctggaggatcccttgagcctaggagtttgaggctgcaatgagtgatgatcatgccactgtactccagcctagatgacagagtgagaccctgcctctaaaataagtaaataaaataatacattcagacaagttttaaagtagcatatagtattcttcctttgccaatggatttttcctttgctctgattcaactctgtgtgcttatataacccagccttacggaaaatcagacacctctcttcagacccttgttgaaattaaaaaggcttgtcaattatagtttgaaagtagaaaaaataatggaagttaggaggagggagagccaaggtagaaggtgggtatatgactgtggcaaagaacatgatagaagctgaggcctccagaacaaggagtaccaaggtaaagtgtatagaattgaatgcttcctcttttgtaagaagtattccttatttgctctgcccagatcagacaggctttgatccagctgctcagtcaaggtactgtctcttaaaatcacttgatgggggctcatccacttcatgacttaaggacaaatggcactcgttgaaaatcataaaatcaacattatgaaaataaatagtataaattttataaactactaattaagcataaatattcatacctattacccattcaaaaatggtatagttttaactatagtgaaaaccattaacacactgatgatcagaaatatccacagcatgattataaacccttggcagtttggagtgtcttttcttcttttgtcaccttgatttttttgtacatctcctggcattccacatttgccagagctctgtgctggtccgtagcctgcaggccaccttataaaaccaatacctttatatttattgcagagtttgtaatctttctgcctgtggttgttccatgtgctgtcatgataatacagaaaacactcaaactgtatctcccctctctatctctgtttctagtctacattgataattgagcagattcttttgaatgtttgagatggggctttccttcaattttgaaaaaaatgcatataatgcattctacaaaaatgttgtttacaaagtggtacttccttacaaaaaccctattgtagctgttgtagcaagtgatttttagacttgtaagtaaaatgtctgaacataattttacttggataagtctttctcttattcagaaacctgtccttccatggtcattgcccaattatggctcttatacactctcctgtctgcaagaagtgtgctctgaatcattcattcattttgctgccttactgaaagcactgaattagatggcatatgtattgaagtgaggggtgggacattggaacaaagattttcacagaagcacacagagccagggttctagctctgaccaggccgctatcaagttgcatgaccctggggcctttcaaggtcttcaagctcttcaatgtaagacaaatgagtttgaacaaatgaaccatcaggttccttcagctctaaccccctcttcccatgaatgtggcaaaaggaagcagagtatcctcacacttgccatgaatcggaacacatttgctaataggttcattcattcaatacacaaacgccaagcacctaatatgtaccacacactcttccaggcactggccatacaaaggtggaaaaaaggacaaaaattgctgccatgtggagcttacattctattattaataatagctgacatttattttagtgttgtctatgtgccaggcactttacatggctaacacacttaatcctcataatactccattttacaaatgaggaaactgaggcacatgaagtaacttgcccaaagtctcatagctataagtgataatgtgaaaatgtgaacctcagcagcagtgtggctgtagagctagccagctgtcaatcattcctgcacactacatttccaaggtgagcctgggttgtatgtgcaagttgcttataaggtaaccatttataagccagctctattgtactattctgtgaccaagagtggtaccaatgatgatagtttatctgaaaatgtatttcacaaaagaagcttcacaaaatttgtgaaatgttagtgaagacttggaaaatgctatgaaagagttggcaggtagtcctgcattcacgtacatgctttcatctaatctgcacaacgaccttatgaagtagatattttaattttctatttatgtacatggaaatggctcagagaggttaggaaacctgcccaatcaagaaagcagcagagttggcactgaagctgggtctgtttggctctagagccaaagttctcctcctataccatgctacctcttcctacaatgtgcaatggttgttagtagtattgttattcttagatataaatgttgtctataatttctttttgtcaatttagccaacattactcacaatttgaaatatcattaagaaacctagtttaatagtcaagactatgccagtagaataaatagacatgacacaggatggagttgacctctcgagctcagagaatcttctggctcctctgaacagctggccaaggagtaatatttggcagtaaaatacaaccacatgaccaatgtttttggccagatgaaatgagccagatggaagcccatgaagcaaaagccaggagggggcagaagcagacaatataaaataacggattcattttcctttttcttctttttaatataaaaatacctctattttgatgcttttgcttagcatttctttaaaccaacatcaattaggttagaggacagtttagatattatttaacaagtttatattttaactgattactaagccctattctataacaaattacgtggtgttctgtcttcagagaaaaattcagagttaagtagaggaagatagtacatctgttagaacaatacctctcattatggaatttttttccttgtgtgctgataataggatctggtgaggaagctggaggtgggagagggaccaggagtcctggttctaacacagacttccagaattcacacctgtgcaggtttcttaaacttgctctgcctggtttcctcatttgtaagataaaggtaatgctagatccacctcccgaggctgttttggaggatgacatgcatgagctaatgcatgtatgggattgggaatggttcctggtgcatagtaagtgtccaatacaaactagctctactgttcttactttggactttctaaccacatatatgtgtggtctctagtccctgaaccttcaattcttcttctcttatttgatactaattacactcatctttttcacttaccctaaagaattaagtgagatgagctgtggcacactaaaaacaacagctgtcacatctgttacatctgaaaagctttgaaaactaaaaagtgctatgcaacaggaggtattcttggggtatgcagaaagttacatcccagtgtattgattcactggtggcattcacttcctttctaagatgtgggtttgagacagctttttctaatgggaattgtgcagtttggttgggcaatcactgatgtgctaccactcaggttttggtagtagcaaagagtagctatgagaccacactctcctatgatccctgttcatatcagctactatacaatttccagatcaaagttgtagatttggtctttacttcctaataatataggaggtaatttagggatatctagatcttcttgtttgggcaaatattgctttatcttttcatagcccagataccatttgtacttttgtttgttgatctgactgtcattaatccttccttctactgttcagtctatgtcatatcaaataaatttactcattagaccttctacacgaggtacaagcatgcacatatgtatttaattaatcacctgtttggcagctctgctaaaatgctgggaaggaaaagatgttgaaacaattggcaaaaatgagatttggagattttctgagaatttctatcccatgacccctattactataaagggcaagaaaactagaagacactttctgtttctggcctgtggaatgctatggaataatctctgccctacattcaaatgtaccttgagtgactttctcttctatttacatagtacctaccccaaacttgtcacataaaatgttccttttaacatccttgtgatttgttctctttggaagacagaatcatctcaagaagagtaattttctatttaaagtttccttgaacactactgtagttttaagcaataatatattttaaatcacaaaattccctagtgttctcttattggagttgtcagggtccacaggcttgctaaatctttgctccttgattctttctttacttcccagatcgtttttccccatttttttttttttaggtactatgtttaaacaaccaatataaacttctccacattgttttcttgagcacatcattctcctctttcttctctataatacttgggaggggcgttgctctaaagtaattaggtgaatctttaaacatgtgtgccagaacctaggcagataaatcagcaccttgccctcaaaattagtactcatctttgtaagtggtgccctaatgctaacactgatcccattactgaaaacatggttggcaatctcttctgggctcacagagaaaaagtaccttccttattatgtaaccctctgctttctctctttttctcttcctcactcctccttccacggccctgctcccctcctctcccctgcctttccttccctctccctcttcttttctctttcaatccttctttctgcctcaatcaaacttaataagctatatattaatcttttcttataaaaatgtattttacccacataagataaaaaattgtcacagctgaaaaactttcacatctattttgagcattgtaaaactgtttcagattgtatttctcaagagtcaacactcattaaatgtatatgatttgctattactttaacaaatcagacactaattgaatttcatatcttgtacacctggctttcctttagcctgaatattaccaggcagcaaaagccatgccaaggaaaaatattccagttaaagctaagtgtacccccagtagcatgcattattatccattcaatagccaaagaaaaatgacactacaataggcacatttgaagattttacaagataaaaaatattgctcataaaaaaaattataagggagaaattcaatgaagaaatgttgtccaatgtccagttctttcagttgcttcaataatggaatcagatccaaagcctcttaaaggtcaagataagcttaagttactttcaccgcgtaaggattttgtatattttttaaaaaataagaaatgcaaaaacaaggctgtgacattatgagatattttacatgtttacatcaaatagtttaacacctttaattccaagaatgctatgcaataaaactatgctcttcagaagataattatagcatttaactgtgcgtgcatgtgcctgtgtgtggtgtgtatatgtgtctgtatatatatagagtgactcatggtgcatttgaggtattatggtatgataaaaattttaagttatatgatatgtaccttttttcattattgtcagtacattgtcgtggctgaatgcgtaatctcctttggatacatgagggacctgcagaaatgcaagagccagtggccaactgccttcctacctccctaacccttccactcaattcaacttatgatagatatgatcatatcaagttggctatgccaataaaacattatcgggtgatgccaaataagaaagggtaacagaatactttatcaaataggcattactggcatttttgctgtatgtaaggaaacttctaacctcaaagagtttgcagtgcaactggaaagataaactagaacctccaaacagtgaaagcagcacatataaaaaaattaattattctgtgggaaattgtatattcaaattaagaggaagtaaaggaaggactgagcctctcaagcttccgaaggaaactgactcatgatggatatttgagatgtcattctcacctcttaaacttgttacaaatgaaacttgttaaaattacagatgtgaggtattcaaatacatgaaaaagtcattcttagctgctaatgcttatattttggaaagggtcagaacttgaccaaaggaaccttgaaaaaatatatttatcatatagctttaaattgttacaataccataacacctcaaaataaaaatatctttgccaaattgagaaggcaaggtttataatatatttgcaaactacacagaagagcttaaactctgcatttcgtgagatttctcaaattcattagtcaatcaagctattgcttttactttattcagcagctggagatttatgatattaaggagcttgttatcagatctagtgatgaagagagcctagaagccaccatatgttggaaatatgcacagtaatgttagcaaatcattgatgttaagttctaaatgtacaatttagcatacaataagcatgagaatcacatttaacaaaatgcaaagcacataggaagcatataatttaaaattttcaactaaattttatagctgtaacaaacataacaaataaatcattattttattttgaaataaaaataaatggagttaatacctatacctttagctggcaaattatatttacctcttgccaaagtttgcttatgcattgttatacaaaatttttaaatttgatttctctgattttatagttccctaaaaattccaaggacattatcttctttagtgtctaaagcaaataattaatccttataaattattttaattcaaactttgaatgttttatatgcaggcaaatcagaacacattttaattcagtgttaatatatatttctacataggcttggcagcttccagatgtgctgcatttggtctaaataagaaagaccttatatccaaaattttgcaaacaatgtcacttctatttactattgattaaatagatacctttcagtgctatagattgtaatcaatcaaaaacagaaaaggttttctttctaaacaataataaagaataatcaatcttctctttattaacacctagaatactcaaatgaagaaggaaatccaatattttttaagtgttttctttctttccagttatttggttaaaataagctgattttgttgtaaaacagtcattgacagtttagtgaagtcatgaggtcaagatttttaatatgacttccagaaacaaaagattattaaaatatttagtttgaattcatgacatgtaattctgctgggcaagatgaacactgaattactacctgaaacagcattagtttccattttttcatgtgcatgtgccctgaaacacttatgaagaataatgtagtgttttttttgttggtcaaacaagaacccttccctaacatttagagttgactgtattaagccattagacaagttaatacactgtttttcaggtggcagtaatatgaatgctttgttaagtttgccatttaactctcagaattagcttttaaagttagtcaacttccttcaacttctgcacgtacctacatacccctatttcaaggtttacatcatcttcttggctcttatttaatatattgtcaatttaacaagcattaggagttagaaggtcaacatagggcaaaggcttatttgcaaggggcctaaggcagttaaacaattcttcctagctacaaaaggaaaagagtaatacctgtaggactttgagaaacgcaatcttgatttggctcttgtagatggtcctggcaccgtggctcccagaggatcccaaacaaaagccatttttaaggacgatgccaagatccccaggaaccacgagaagtcagagctggtgcggggctctggggccctgaggccccgcacggagcaggaggcacttgtagctgagtgagggcatttcctttgtgcagtggtatgcgctgacagagagatggcaggctggctgaggcagggctggaagggatggccaggacttcctgctgcatgacacttggcctttgcgacagagtttgcttcactcaggccttatctcataattaacgtgagaaacactccctcgaaaatttgtttttaaatatagccctgattaaacagcatagtcacatgccactcctgaaaagcacaacacacacacacgcatgcacacacaacaaaaggtgtgattgaagtgggtaaacctttatatcagtgtgaactttaaaaaatgtaaacccacagggcttcgttaaaaaattttaaaaaatacatgcctatgactgggtcatctgacaaagattactaaatttcacacagctaactgccaactataattttccttatttcaacttctcttaaaaagagatggatataattcttagccaaccttccacaggatgtaaacaggatttactcgtcttgaaaataccagcgcctctctaaaagtcagtgtgagaaaaaaaaacaggcagatcactttcagaacttttggcagctttgccctcaaggagatgctgcgtcaccttagagagtgaattacaatgcatgactctgacaacaaagatcaattatcttgtccattttctattccctagaaacatttcttaactctgataaatctgttaaaacaactttctttcaaattaaataaatgatgaaagccaaatagaatccttcatatattttatgagtccaggacattttgggaaagcatctatttcaagaaattgtacccaaggagtcaaaggaccctagtgccgtcatcggtcctcaccactgagtggtattcaatgttaacaatgcagcataatttcatcagtctgtatccaaacactgccccgcgggtgacctcaactgtaaaccaagggagagcgccacttcttcaggataagattagagaggcttcaagtgcccaagagtgaatttaaccctctctgaactggacaaaattgaccaagagttgagctcagtgaacatcaccatatctgcaaattttgagacctctaaagctcaatctgtctcttgtacaccaagggagtcttgaatattcatataatttcaataaaagctcaagacattaaacattatgcttgttttcacaacagcatccaggacaccaggggttcttaagaatgctacaggtttcatatcagctttggagacgagtaatagaaaaggtttttacagtttcacctctttcttatcagacatgagctcaaagaaagtgggtgagtgagaactgccctgaacagcagcaaccttggaggagcagagagttcaaaaataaacacaacacattctccctgaatcaacttgcaatattgtaacgcttcacaaactgtctttttgcttttgtatagagatccaaatttcgcatgagcaaaacaggtagccactttcctggtgttctcaaagaaggactgaaaaggtgcttacactgatgccaatctgcccttctggtgtatgaaatgccaccattatcatttaattctttcaaactatttaatttccattttcggcagctcttaggaaatgcacacattcctggcagagttagcactgagctgaacaacttggtgcttattagaatgtcttcatctgagactaaagccagacagtgtaagataactggtgatctgcgtaaagaggggaggagtccctaacagctggtggggtgaggtggcttggtgtgaaagggagggggagggaggccacaaagacaagcagaagagtagaagggatgttgctggcaaagatggacttttttcaccctccaggcaacacaaagctctcattttgtccagtggtgtttaaatttttgtaggtgaaacagcatcactgatttctaataaaagctacagtttatgtatacgactttggaagcagaaaaatattttcattgttatcccaattttactgatagcaagataaaccctatctttgtattcaggctaaagccagcagtatacattttcacaaataattaactgcctttgcttacaaatttacctttttaaagggatattcaaatttaatggatatctaattgataagctacaaggacatacgaataatctagaatgaatctgctagggaatgtccaactttttctaaaaatgtgcaaggaaggagaactaatcttgtctttttcattactgtcaaaaacatttcttccttcttttccccctgctttgtaaaggcagtcatctagaacagttaagcaagataaaacaatggaactgtaaatgtgaaattatgaacaagaaaattgaaactctgcttcattttcctagtgtgaaatcagttacagacacaagaagtgtctgtcaatattaatattattttttcttaaataattacttaccgcctccttttcatttcttccacacagttacacataatccttcttaggttaccaggtctcagtaaggtcatagaaataagctacttatttctgagattaatcatgagcaaaattaagccttgatttcaaatagaaatatcaatattgtttttgaagaactggctaatatttcacagacatgagaatttagacatttggaaaaaataagaaattaaataaaatgattttctaggatgaatctttactagcatttataatacaacaagctgtttataatttttacttcatgggtatcaaagagtataaaagaacaaagaagacatcttttgaacattctaattactgtcatttattaagcgtttatttttccagatgaattttagtaaaagcatgattcaatagcaaggagagatgttccatccctgagacaaattattatgtttacaagttgtgcacactaattttatatgtcctagggaaaaccagattcggaaatctaaacattgctccaatccaattgttatccatgtaagtcctaaccccactaaagtatcagcaaagtgcccgtctcctgccaataacttagctcttatgttctgcagagctctaaataaggcatcgtttttgcctcttgaatatttctgggattttggttccaagattccagatgttacaaatggcaaatttgggtttcggtgtctgacacagaaactcagaatttcctttataggagatagctactatgaataaaaatgaaactcccaaatttgagagtgggataagttaaacgtaatccacataggcattcaattacttgcgcatcaagtctctagttaacaggcatacggaagagacgagggttgagctgaacttcagagaaataagcagttacatcagtggggttgcgttaggttgaaagacattgcttcaggaaaccagagcaggcagatagtgggtttcaggatagtgctgtattttgaaatagtctctggttacagactcaaagccagcagaagttaatgtggaagcaaataacagactgttatttaccatctacttctgatgagggtgtcgttgtaattctatcttcagaatgatacattgcaaaagagtgtgacaaaaggcagtttgataacggggcttgtgtactccttaaaactaatatccattcagtacaagtaaatgtaaaaaatgatttttattacattacttatcaaaatcaactataagttatttctcaaaatggaagtgttgcaaaataataccaaaattttctttgaattgctttcaaatattcattctaaaccttatatgagtctacttgattgaaaggtcaattattccatgttctgaaatgggagacaattattttaagacttggcaacagtaaaacattaacagaattgaaggtaccccatggtcttaagaacactgggaaagcatgctctgtgttttaagcttctacaattgcatccattactcatatatgacccaggacacaaacagacacaaactgtaattaaagagctaaaatcaggatatagactaaaacaatcaataagaggcatgcttaaatataatgataaaaaatcaatatgactatgattgtgaatcaaaatgttttactagacacttaaggtttccatctacattaattttaggattttttttagcaatttggaaaacaactaagtcaagcttttctattcactaaactaacaaagctccttctaaagctttgttggataaagcctacttggataaatgggattgaaggaaagaaatcatggaggaagaaatggaaggaaaagaaaataaattttatgtttattgaatatctactaaatgactgacaagttcctaagagatttttctaactattcaaaaaatatttctagactcaaattctttaaaaatcttgaaatcaatgtagactaatcatttgaaataaataatttgacacaattttctaacaagtgtgtaaaagtcttctggtgtcactgattgtcttgttcaattctctgtatatgaagattttaaaagtcataaaaattctttctatttaatattctactcatgaatacagtcttaaataaaaatcctacttagctattgactggtgagtgaaggagtggtggatataggattacatcttgaaattcacttcctccggaagtcttccctgcctccccataccaggtgaggtctccactgcactttgtacttcctctttgtcaatgtcatcacattagtaatgacttatttggtatctggctcccctgatagacctaaacactatgagaacatggataacatctgctttccctctgggtactcagtgcttagcaaacagtctagagacataaaaaccacaattatgtttgtttaataaatggacaaaccaatattttcagggcatcttaaaaataagatggagcatttacattatattcttatatgtgcctaaataggggcagaaatttcagaacaggtaatttaggtagggcttatttagtttctttttcctatttgattgattaattaatttttttaatcaaaataccattgggcaagttttcagggcagcactgtataggggattagagattagagtcacagttatgccatgaacttgccatgtgaccttgaagattgttgcctgaccttgctgagtttcagtgtcttacccatttggttctcatttgagagccattgcaaagagttttggagagggctgaataaggcaatttatataaaaacattctgaaaactggacaaaattttaggcacacactactgatgtttgtaagcttttgggagaggtaggaaaactatttttatactgttagaaacatctttaagttctaaaaattgccaattggttacttcatgagcatggtaaataggcataccactttatcagtttcaaaaagaatatcagtcctcagttttgatagataacacttttctctatttgaaatctttatatcccatgtgtgtaagaataaaatattagctgttatatcttgaaggttaatcatatgaagaaatgttaatgttttatttgcagcattaaaaccctctaagaactttgtttacaagatctaaaaaaaattaggtggcaagaaattttacaaaaattaggtgatagaatttctcgattgctcaaaaccctaagcttctcctaaatatagaaatgtttctacttattttttgaaaacttatgggatcctagagacaggttgtttaattgggaaaccagttgcaacactgactccaactcatgctacccttattgttggccacgtaccaaataaggacagaaatggcttcttacaactttttagaattatgcttacaaataagcaaaagcagtgatgaaattgctaggctgagaaacaaaatcactcccttgggagaaagaaaaaagacccccaataccaagaatccctaaataaaaatctcatgtgctaaattttggtgctgtggattttttccgtgactgttcaatatcttgctaaatctggttatccatttgttggagccaacagtcataaactttcccattcctgagtacctgtcatcctcagaccccttccttacttggacacttcctgtgcactgaatgagtttgtgaaccaaacatcaccataatgtcgggttaacttttctaattcctcattttactatgatgatatcaaccacttatttggtgtttattctgtggtgtttattgaccttgctgagttataatgtcttatccatttggttctcatttgagagagagccattgcaaagagcttttgagaggactgaatagggtaactaacatgaaagtgttctgaagactctgcacagaattttagggtatactatatattatcctcataataatttatctgtgtgctttgtgttatttttattctgtatcaccactgaggaaacgaagacttacgaagttgaagtaacttgcccctatgatcatacagccaatgagtagcagatctgaggttaaaattgaggtccctcttaattgcaaaatgtatatcttaaccaatacatgcctggaatataagtaaatacaggaatgaaaaaggtcaggtcaccttccttgaagaattaaatcataagagaagttttgaactttcacaggaaaaacaattggtgtcaggtataagatctacatgttacttaatcttccaactcacgagcagacattattatcaccactttatagatgagaaatctgagactcatagaggttaaggaacttggctaacaccacagaggtaatatatgacagacatgtgagtccaagtcagttttgcttatctctaaatcttgtctccattgtggctggcttacctgagatctttcaattcctaattccaggacaaaattggcctgtgagcctggggtgggactgaggctgcaagtaggggctgagtgggttcaactgtggtaactagagagagaggaggcctagagtatagttcagcttgaggaaaagtgatcctgtcaatgtttgtatgcattgtgcactgccctgcactttccctctgaatattctacataggagaaaaatcacaacacttttcagtccatccaaccaaaggtaacaatgtgctaggggctacaatagaaatccagatgtttgagtaacagcaaaagaaaacagcttattgttgttatttgtttttgttttgtaacagaatatataaaacttagggtgccatttactagctatctctcagaaccagctaagaaatttataacagacatttacacaattaggctattattaataagacaattggactggttctggtttttgctttcagtgttaccactaattttatttctactggttcagtggagttaagtgaccttcccaagtttggaaagtgctaaataatggggccttgatgaaaactttagcttacctctaaattttagagaataagccatttttatattagagatttttaattaaacttactaccttaaaaatgtagaagtaaatttgagaacacacaattgttatttcattggtcagatgatatccagtaaaatcatttatccagcaaaattctgagttaaatttgacgtgtttttgtttgatatatatgctataggtgagtcttaagggattgaatttatatttgaaaataaaacaaactttggtcaaagaaacaaaattataactatgggcttttaggtctcaccaggcactggatggtgaaatgcatgaggcagcaagtatttttctaaatattctataagtgaccctaacaaaaacacacaaagctttgaaataaacagagctaaaagatatagactagtaagctactttctatatggaattttgttcaacagctaatcaaaccaaccagcctcccttcctttttttcttcctccctctctcttgcccacccacctaccttccttccttccttcctacctaccttccttccttccttccctcctttcttccttccttctactcacaaatgcatgtttagcatcacctcacatgtcccaggctatgccagctgcctgctagtagtcaatggtgaaaacaattcatgcccaaagagaacttagggctgaatgaaccaaaaactgaaactcaagggtaatacaaaatttgactgggcttaggtttatttaaagtatcagggcaataagaagagaaggaatataaaatatttatagaaataaaaaataacatgagctcttatttaagaaaaaatgtatataattaagaagaaggtagccaggtatgaagctcatgcctgtaatcccagcactttgggaggccaaggcggacagatctcttgagcccaggagttggagaccagcctgggaaacatggctagatcccatctctacaaaaaagagaaaagttagccaggcatggtggtgcatgcctggggtcctagctacttgggaggccgaggtgggagaatcacctgaacctgggaatcgaggctgcagtgagttgtgagtgtgccactgaactccagcactccagcctggctgacagagtaagaccctatctctaaaaacaaacaaacaaacaaaaacaagaagatgatttttcagatcatcaacattaaaaacatatcaaatgagttatttttggtgaaacgccagtttgtaacactggcctgggggaaatatttgggctcaaccagtcaattctttctattctgttaaagtggaaagagcacaggagagatacatttgtacagaagtttctatttcagcccagtgtgggtctaaataagggctccgtggctgggggtacagagatgggtcctggtgcctccttacaaaacttgcaaaccagcaagaatcttacctcggaaaaatatctctgtgatctgtggcagtaagctttttctcaataaaacatatcagtagtgctcacacattaaaactgacaaacggtccctttgaatccttcttatacacataaagaaaaaaataagcatgccttagtagggcaatcagtcctggaatagtccagaatgagctgaattagggatgtctaaaatataaacttgatagagcatataagatctgtttcagtagaatatggttcttgccatgtcaaaaagaggctttttccccccaagatggtattatgaacattttcaaaaatacagaaaaattgaaacaagtttacagtgaacacctgtgtatctactgtttagattccaacagtgacatttaagaaactgcttcttaacaggtgattatcatattaggtgagcaattattcaggtaagactcatctgaatactatttaggattgtgcctatgtttaacctaagttataagtctctatgttttcttctggagtctattttgaagggtggactttgtacaggaaagacaatttgtttttttctatgtcatataaagcacaaaataaatctgaatttctaaatcttactaacaaaaataaattcaggataaaaagtaaatctaaagatatgctcaagattatgagttatccaaatcaatacccatttaattgataaaagctatcaaccatgaagttttattccaggttagtcctaggtaatatgtttttgggattctctgaaataagaaaattgttggtaagttatgagtcagtcaagcacttgggaatgagataattgggagctttccacagttactgatattgtacaaactaaactataatatttataaatcaagagatgttttaataggtgagttgtttttgggttttctgtgggttttattattttgttttcttttgatatattttaaatgaacattatataaatgttaggccttgtttgtcatgaacaagacattgtacttttctataaatgaaaaaaattcaacttcaataactctatttttaatcaattatttctgatgtgcctagtgtaaaagtcagcttgctaacttctcagcaatttgaaatgcaggtcaaggtcagatgacattacaagagtgacagagaaaacctaattttagtctccatgaaactgaagaactcaacacaaatgattactgaacactcagcccatgtttggagttgtacgcttacaaaggcatcctatcaggaaggagcaagtactgcagaatcgtggaagaagctagtgtgttctcaggtgctccaagagctgtggaaaatctcagattcagactatcgactcctcaagtacattcaaagaacgtgtatttgcaactctagtataaactcattacagcagaagttctgagaaaatagccaatacagctataagtagcagaaagtggcattttccaaaaaagttaatgttaatactttgtttaaaagcatattataaaattgtcaatactaagtagaatctaattactcctgaaaagcatttctcatttaaaaatctattcattaaaatatgcaccaaaatgttgatcaagttatttctgggtaatagaatgatagatgtttttaaattttattttccataatgtttatattttctacaataaataaagatgacttttataatcagaataaatgaaatacatgttattaaaaaactagagtagtcaagtttctttttttcccaccaggaattttaggtttttagttgattagacttcaaacaaaggtcaagagtaaagacttttgaatcatattaaattaaagatgtctcatagatattttacacattggtgagatgtaaagtagtgagagagaagtcctgagaagccagataggcatacacatcatttaacacctatgatggtattatttaaaatcaaatcattaatagaatcagcatgatgcagtttgcagaagcataactagagaagacaagaagtctgccttacagagcctaagaagaggcatggcaaggaaaaagcaagagagagagaaagaagcagagctcttagtagatgtaaagaaatccacttcgtgccagtttgcaaggaaattttcctttatgaagagcagagcacttaatagatgtaaagaaatccacttcgtgccagtctgcaaggcaattttccttcacgaggagctagctgtttgcacagcgccctcttgtgaagagaggttttcgtgactgtaccttcaccccaagagccaaaaacttcaagtatccttccagagcaattgcttagctttcatcagctgaggattaacttccaaggctttttgaggatgcatgtatgggtatgagtaacacacagacttgacatccgaattctctattattaaatgtgcacataaatattccacagagttgtgcttcttaatgataatactttaaaaagaacttcctaaaataggaaattagcatctatgtttgttcccatgacttgtgaaacttgctcttttgctctgatgaatgctgtttctccattcggtaaatgaaaattgaaaaattgaaaattggggactacattaaaaatcaaaaattgtccattcatcttaaaaatatggagacatttatttataaaacgttagtatgcttatgagtgccatttgaaaatgcattaggcacctgaaatttcatatgatagtcactgacaaaaatattgccatttgagtaatataagaattagagacatttggtgtgcttgatttagcacgttaattagaataaaaatctttattcatgtaaatgattccactgatttgcaattatctggataactgctcagcaggaaaaaccaaattttggatacttcttgcaaaaaagtaaattactgtggaatatgatacaatgtatgcaggaagagttgtgctttatgtgatattctgactcaaaacaggagagaaaatgatttcttctcacattcagttgaacaattgattgggaagtgattacaaacttcactttgcctgtcagtgtctgtgctatgtatttattgaggagctcattcattgctactcactttcctaaccaaaccatcatgaaaaacatgcttagaaccctgagctaggtaaaatgagaatgtgtggcttagcacaaatcataattaaaaagcaatggcaacaccaaaggatgggttggggtgcccctccataaccgctacaaggttttccaaacccaccacaaataaatatgtgtcaaacataaaaacgatgtgctttctatgtaaatgcaaattcaagacaagtccccaagatcccttagcttccaatcaaattgtcatcacttctcaatctactactatctagaaattctactgtggcctttgctgaaagttcagagcattcattgatgagtatcattgtattcatgtggaagagatgacatgaggcagacaaggacggtaacaagtctgtgtaggaatctacacatatctagtgcttgtgcaatgggcttttgaataggcttgtgaaaaagactaacgcctcccaactgtatctccatccctgacattttgcctggttttcagaatagtatatcaatctccttcttggagattgacatatgggtatttaatagtcttaggtttaattccttccagggagactgcaaaatattggagtgcgtagtttatttggagaagaggcaggaaggcgattctaggaaatcaaagttaggtgatggagaagtgggatagcaaaggaagaaaagttaatacagtgtgtattaataagcaggggcagatggggcccaatctccccagggaccttttgtgggaccatatatacacatgcctcaggactgtcccactggagaatgtggaacctggggtatatgagcaccaactctggaccctcaatgttggagtgttgccactgggaatgttaaaaaattctgtaaacggtctcagcaggctcctttgtactgcagaaagcccccaggtgcctgagatgggaaactgactgagtctgccatagcctcaggtgaactctatagtgggtggagggaaatggggcagcactccaagcattttccacaaacaggactatcaaactcaaaatgctcaaacagaaccaccccaccactaaacctactcctcccttgaactcctcaagctcaataaataaaaacacacatttccaatttgttcaggccaaaaacccttgaattatctttgactcatctctttttctctcactctatgtaaaaatccgtcatcaaacacaattagctctggtttcaaaacattgccagaatctgatcacttctcgccatctccactgccatcacccgggtccaagtcactactgtctccttccaaggctattgcagtggcgtcataaccattttccctgcttctactcttgctcctactctattcttcacagagcacccagagtgatcctttgaaaatgtatgccatttctctgctcaaaaccctttactagtttccctctccatttgggataaaatccaaactcttttccatggttttcaaaagccctctcctctctttatggcctccttttctattctctttcttgcttactcagttcccacaatactcaacttcttcctgttccttaaacacaatgtgcctcctcctaaggagctttgcacttgctatttctttttcttgaaacactcttcctttggaaaaatgcataattcactcattttgttaagatttaaatgtcagtttaacagacagggatacctattctgactttttaatctaaaatcacactcgtattactatttctttactctgcactaatttttttcatagaactaaccatcacgacacacattttgaatgtgtttatgtatttcatatattttgtactatcctccccacaaaaaattaaattctttcagaggagagacatgttgattcactgctgtttggccaacaactagaatagggccagatagtggtaatggttcaatatatatttgctaagtgaattaattcactgttctgagagccatatgagataaatattgatacttattaaacacttaaacgttatgattgatattggcctataaaaagtgtaagcagcctctgctcaccagaagtatgaatatccaaggtgtagtgaaattatcagagtttagacctgtaagcttgtccaacccgtggcttgtgggctacatggcccaggatggctttgaatgtggcccaacacaaattcataaactatcttaaaacatcatgagactttttgttttgtttttgctcatcagctatcatattggtgtattttatatggggcccaagacaattcttccaatgtggcccagggaagccaaaagattgaatactcctgggagggtatattactgtattatgaacaatgatagttaggaaaagaaaggaaagaaaggttgagactggactgtgaaggaacttgaatgatacgttaggagtgggacctttgttccatttagaagtgaaaacttaccaagtttctctgaacaagggagtgaaataataaaagcagaattaatttcagaacaattgatattttgattctacttgcaaggacttgagcaggaaagattagaggcagagagacaatgtcgtgaactttcccccactcgaatcctcctttttcccagtattcaagacactggcatatgtactggcatatatgtactatttgcatcttttaaacttagtttgaagactactgtatcatcaaatatttttcatactcagttaaggtggtttttgatcttactgcgatgttaaactaccacactttgtttagctgaaaaaaaggtctgtccatggtttctctggattggaagtgaacctactatagatatgaaaagctcatattcattcttcttcaggttacctaaaaactaataactaaagtattagaaaaagataagtttcggtatgaatatactataggttatctggtgagacacagttatgagtcaacgggaataaacacgtcaaaggcatctgtagtgcttagcaaagtttctttacatctctaatttgtttcttacccagggcaaaatgcaaactgcagtcttcttttctctaaaggagtattgtaaagaaaaagagtggtatatgctcatgttctactggactctgaacctcctggggctgtataaccctgggactgcccagcacagtaggagtgaaataaatgtatgttaaatgaatccatcaaacctcttagaagacagactccagggaaatttcattattttgttctaaattatgctttccctcatgtaatgaatatttaattctgttttgttccagaaaggactcaaggcttctctatttcctttagtaattagcttaaataagccaagtcatccatttctctacctacccaatggacaacagaagaagcttacgtgtctcatagctttatctgtaccttgatatgtttgagaatatttcatatacataaaccagcaatgatcatttgaggaaataaaccagtaaactttacaagcaattgtaatttgaggatataaactttaaactctagaatgttggacacatctttgaaaataattccaaataactaattgaatctattagtttatgttacaagccaatttggttcaaagttttaaaatgaagaaaaaaattgtataaattgaagttttaagcatagtttaatgaaatcagctagtctaaattcaatattttcactcagttcatcaaattatttgaaaagtaaacacgtgggctgtacagagaacagtgaatcctcccctaccctgagctatcactcctgcttgtggggcacagagaaggcattcagacctgtgcctgccaccaccctacccccagccaacaccacctccagtgtgactgtgcacacaggctccagcaagggcctcctgcccacctctgtaagctgcattgcctctgccactctggtgaacatctgcaaggaggcaggcacccccacacccactagcacttcactgcagctgtcccatctcagcacccctagctgagtggattccaaaacttgaagaatgagaagacaaagtttgggcctcatacaagtcccccagagttagtgcacacagtccagaagttgggagctgagtgttggacccctaaaatcttccagaaatgaagccaatcagctgaatccacctaataccacaatcaaaccctcaaggtcatcaaataggataaaaggaaaaaaaaaacattcaaatgtcagcaacctcaaacattaaaggtagaaaagtccacaaagatgagaaagaatcagcacaagaaccctgaaaactcaaaaggccagagtgccttttttcctccaaacaaccgtgtcccttctaaagcaagcttctaaaccaggctgagatggctgaaatgacagaaatagaattcaaaatatggattggaatgaagatcattgaagtacaggagtatgttgaaacccaacggaaggaagctaaaaatcatgataaaacaatgcaggaactgacagacaaacagccagtatagacaagaatgtcaccaacctgatagaactgaaaacattattagaatttcataatgtaattacaagtactaataacagaacagcctaagtggaggaaaaaatctcagaaatctcagagcttgaaaactggctttctaaaataagacagtcagacaagaatagagaaaacagaatgaaaaggaatgaacaaaaccgagaaatatgagattatgtaaagagactgaatctacgactcattggtgtccctgaaatacatgaggagaatgaagccaacttggaaaacatatttcagagtgttatccatgagaacttccctaacctagttagagaggccaacatttaaattcaggaaatgcagaaactcctggtaaggtacttcacaagaaggtcatccccaagacacacaatcattagattctccaaggttgaaatcaaagaaaacatgttaaaggcagctagaaaggtaaggtcacctacaaaaggaagcccatcagactaactgtggacctctcagcagaaactctacaagccagaaaagattgagggccaatattcacaattcttaaaaagaaattccaaccaacaatttcatatctggccaaactaagcatcataagtgaaggggaaataatatcctgttcagacaagcaaatactgagggaatttgttaccaccagacatgccttacaagaactcctgaaagaaacactaaatatagaaaggaaagaccattaccagacactacaaaaacacactgaagtgtacagaccaatgactctataaaacaaccatataaacaagtctgcaaaataaccagctaacatcatgatgacagaatcaaattcacacataacaatattaaccttaaatgtaaatggactaaatgcctcaattaaaagacacagagtggcaagctggataaagaatcgagactcactggtatgctgtcttcaagagacccatctcacatgcaatgatacacataggctcaaaataaagggatggaggaaaatctaccaagcaaatgaaaaacagaaaaaagcaggggttgcaatcctagtttctgacaaaaaagactttaaaccaacaaagataaaaaagacaaagaagggcattacatcatggtaaagggttcaattcaacaagaagatctaattatcctaaatatatacacacccaacagagagaaacactcagattcataaagcaagttcttagagacctccaaagagacctagactcccacacaataatagcaggagactttaacatatcactgaaaatattagatatatcatcaagacaggaaattaagatattcaggacttgaacttagcactggaacaaatggatctgatagatatctacagaagtctccaccccaaaacaacagaatatacattcttctcattgccacatgccacatactctaaaattgatcacataatcagaagtaaaacactactcagcaaatgcaaaagaactgaaataataatgaacaatctctcagaccagagtgcaatcaaattagaagctaaggctaagaaattcactcaaaaccatgcaattacatggaaattgaatgccttttctcctgaaatcctgaatgccttttgggtaaataatgaaataaaagcagaaatcaataaggtttttgaaacaaatgagaacaaagatacaacataccagaacctctggaaaatagctaaggcagtgttaggacagacatttatagcatgaaatgcccaaatcaaaaagttagaaagatctcaagtcaacagcctaacatcacaactaaaagaactagagaaccaagagcaaataaattccaaagccagcagatgacaagaaataaccaaaatcagagctgaactgaagaatattgagacacagaaaaccattcaaaagatcagtgaatccaggagttgttctttttttgaaaaaattaataaactacatagaccaccagctagattaataaagaagaaaagagagaagattcaaataaacacaatcagaaatgataagggggatattaccactgaccccacagaaatacaaacaaccatcagagagtattatgaacacctttatgcacataaactagaaaaactagaagaaatggataaattcctggacatacatactctcccaagactgaatcaggaagaagctgaatccctgaatggactaataaaaagcactgaaattgagtcagtaataaatagcctaccaaccaaaaaaaccccaggaccagactgattcacagctgaattctaccagatgtacaaagaagagatggtaccattcctgctgaaactattccccaaaactgagaaggatggactcctccctaactcattctacaaggccagcatcttcctgagacaaatacctggtagaaatataacaaaaatttaaaactcagaccaatattcttgatgaacattgatgcaagaatcctccataaaatactggcaaaccaaatccagtatcacatcaaaaagcttatccaccacaatcaagtaggcttcatccttgagatgcaaggttggttcaacatatgcaaatcaataaatgtgattcatcacataaacagaactaaagacaaaaaacacatgattatctcaaaagatgtggaaaatgcctttgataaaattcaagatcgcttcatgttaaaaactctcaataaactaggtattgaaggaacagccctcaaaaaataagagccatcaatgatatacccacagtcaacatcatactgaatgggcagaagctggaagtattaccattgaaaatgggcacaagacaaggatgccctctctcgcctttcctattcaacattttggaagtcctggctagggcagttagataagagaaagaaataaagcacattcaaacaggaagagaggaagtcaaactatcccagtttgcagattacacgatcctatatctagaaaaccacataatctcagcccaaaagcttcttaaactgataaacaacttcagcaaagtttcaggatatgaaattaatgtgcaaaaataactagcattcctacacaccaacaatagtcaagctgagagccaaatcaggaatgcaatcccattcacaatcaccacaaaaagaataaaatacctaggaatacagataaccagggaggtgaaaaatctctacaaggagaactacataacactgctcaaacaaatgagagacgacacaaaaaaatagaaaaacattccatgatcatggacagaaagaatccatattgttaaaatggccatactgcctgaagcaatttatagattcagtgctatttttaataaattaccactgagattcttcacagaactagaaaaaactattttaaaattcatatggaaccaaaaaagagcccgaatagctaaggcaatcctcagcaaaaagaacaaagctagaggcatcatgccacccaacttcaaactatactacagggccacagtaaccaaaacggcatggtactggtacaaaaacagacacatagacaaatggaacaggatagagaacctaggaataagaccatatacctacaactatctgatctgtgacaaacctaacaaaaacaagcattggagaaaagattccctattcaataaatgatgctgagatagctggctaactatatgcagaagattggaccccttctttataccatatacaaaacttaactcaagatgtattaaatagttaaatgtaaaacccaaagctataaaaatcccagaagacaacctaggcaataccatcttggacacaggaacaggtgaagatgtcctgacaggccaggtgtggtggctcacacctgtaatcccagcactttgggaggctgaggcaggcagatcacgaggtcaggagatcgagaccatcatggctaacacagtgaaaccctgtctctactaaaaatacaaaaaatcagctgggcgtggtggcgggcgcctgtagtcccagctactcaggagactgaggtaggagaacggcgtgaacccaggaggaggaggttgcagtgagctgagatcatgccactgcactccagcctgggtgacagagtgagacacccatctcaaaaaaaaaaaaaaaatatgtcatgacaaagacaccaaaaccaattgcaacaaaggcaaaaattgacaaatgagatctaattaaactaaagagctcttgcacaggaaaggaagctgtcaacagagtgagcctataaaatgggagaaaatttttgcaaactattcaacaaaggtctaatatctagcatctataaggaacttaaacaaatttacaagaaaaaacaaccccattaaaaagtgggcaaaggacatgaacaggcacttttcaaaagacatacatgcagccaacaatcatatgaaaaagtcttcaacatcactcatcattagagaaatgcaaatcaaaaccacaatgaaataccatctcacaccagtcagaatggctagtattaaaaagtcaacttatacactgttggtgggagtgtaaattagttcaacaattgtagaagacagtgtggcaattcctcaaagacctaaaaaagaaataccatttgacccagcaatcccattactgggtgtatacccaaaggaatagaaattattctattataatgacacaggcatgtgtatgatcattgcagcactattcacaatagcaaagacatagaattaacctaaacgcccatcaatgatagactggataaaaaaaaatgtggtgcatacacaccatggaatactctgcagccataaaaaagaatgagatcatgtcctttgcaggaacatggatacagctggaggccattatctttagcaaactaatgcaagaacagaaaaccaaataccatatgttctcacttattagtgggagctaattgatgtgaacacatggacacaaagaggggaacaacacacactagggcctaccagagggtagaaggtgggaggagggagaggatcaggaaaactaataggtagtaggcttaatacttgggtgacaaaataatgtgtacaagaagcccctgtgacccaagtttacctatataacaaacctgcacatgtacccctgaacttaaaagttaaaaaaaagaattcagaagaagaaaatgaaagaaaagtaaacccgagtgtatagtcctccatctcctaggttctaaggattaaaagctccaagaaaagtgttagaaaaatacatagtgaattaagaaaaaattattccttatagttccaacgttgtgtctttgcttatactatgttcacccttttaggtatgtttgtacaaaatgaaaaaggaataaaaaccaacattttagaggataattcatgctactcaaaacaatcacgaggaaaagctgggctgaaactagtgacaagcttttgcattgtgccacattgctgtcacatttttgcccatattatttatgagatttcttcaaaatttttataccaggtcattcttaaggaattctttgctcaggaaaaagtccaagttagcatccttcagacccctgctgtctctccagctcctctccacacacatccatttatagggaaaggcaagggcagaaagcagatttagaagagaaaaaggatagaggagcatgagtgtgtgtgtccacgtgtgtgtgtttgtgtgtgtgtgtgtgtgtgtgtgatgtgtcctgctttaccacagtccagggagcttacagggaagtccatgttcaatatcagcactgcaggcctctccagcaggcccttgttccttcctggtcttcactgcctagtgcacggcaactaagccacaacacccaaacctgagacaaatcatcccatcccagggctaaaaaagtgactctaatgatgtgtctgcgtaacaatcaataattcatttaaattgattgcctgatacataaataatttccttataaccttctgacttttagcaccactgatctaagaatcacacctaaaaaagtgctgtcagaatgcaaaaatagttttctgtttgaataatacttattttttatgaccatatgaatgatgaatattcatgatagaaatttggaaaattcagaaaattaaatttttttaaaaatcatctataccgagaggcaacttgtaaatctggctcattttctttatttttatatgtatatacatatatttacgcatctaattttaacattcaattgagatttgatgtacataatttttggattctgctttgcattcatggtttactataagccattttctctatcacttaatgtcatttgaaaatatatttaatggttgacaagattctattggctgggtctaatatgaaaatttatttaaacattagttcatgtgaaatacatagaatatacctaggttctcaatattataggtatttttacggtgaatatctttgaatataaatattttaatatcccaaattacttccacaatccaaatatctacaagcagaattactaaattaagaggtaggattttaaaaatatcaatgtttattttagatttaggggctacatgtacaggtttgttacatgagtatattgcgtgatgctgaggtttggggcagtgctgatcccatcacccaggtggtcagcattgtacccagtaggtagagtttcctcccttattcccctttcccctcctggcttttggaatcctcagtgtctactgttaccatctttgtgtccatgtgttaaagggtaggagtaattttgaggcttcaagcttctgctgatttttaagcatttttctgaaataaaactttcaaattagttcataaatcaatgtaacagatgacatctgtcaatatacattattatatgcataaatcatatgcataaataacatgcattattttattatgattttataaaagattgacacaacataattcaaaataacttatttactacaaataggactcaccacatgaaaattagaatctaaagcaattaaaaaaactattaggaaatgaaaaaaaatcccatcatataaatcctcaattttggccatattttatgaaagggccaaaagcaatcaaaaaaaaaaaaaaaaaagagagagaaagaagtgagaaagaagtaggaaaaaaagaagaaagacatgtggctattattacagcaacatgaaggtggtcaaccacttcaagtttttgtggtcagtgaggtcacaagagctacaggctgacatttcaaacaaattatgcacattgaggtcacatcgctctacttcaggcagtttctcataattgtagtgttctgtttacaagaggtccttgacttaaaaatgtccttttgtgccctctagtgtttaaattcatcaaagcttttgagaagttcatatcttgtttctgaactccagttgaacaacatttcattcttagaccaagtgtttatctgtatctgaagggggccaacatacatcttgttccaaaatctctaaagtttacttaattttttttttatttcaaagggagctaggtaggggttggaaaactaccacagagcaaatcctgcccactactttttttcattttgtaaataaagtttattggaacatattatgctcattcattacagattgtctacagataactgcatttgctctgcaacagcagagttgagtagttactacagagttcttgtggccccaaaaggctaaaatatttactatctggcttgtcacagaaaaagtttgctgaccctggagctagagctctgataattagattggatgccatgacattttacaatgccctttaattccactccctttccatcaacccccggaatactagttaaaacaaagaccattgtaggccagtccattagctttgtggtccaggtacaaactttgcagttttagtgaaaccatttgttaatttttatttttctaatatttacttagcttgataatatcaactccgttctgatgacttcgatattaatatgattatattggagagaatataatgagatcaaatcgctttacccatcaagaccaggaactgaagaacttcttcctcctttgctacctcatctcttagctagaacttaggtgagtagattagtatcctcattcctctttatttttatataattaataataatatttgcaattattttgagaaacatatatctttttttgaataaagtaaacataccgtttataattaatatggaatttagtttaagttcatgcttgatttaaatctcacacaatcacctcttttatatactaatgaaagcacggtgcacaataataaagccgtggtcctatgtggtcaacttacaggctaccttctttcctcagtgcaaatatcacgtctttctaagtccctctaatattttatcctctcttttgtgtatctagaagctttactgaaacttcctactccttatctgaaatagttgacatatagttaataagagcttttttccaggaagtggatctattttattgctttctaacttaacatgtttcagaatagttacagccattttttttattcaaaggtacatgtcagcaatagtctggccagaaattttgcacaataataggagaaaacaaaaaactaggggcttagaaaagtgaatgaaaacagttttcagttgattattttgttcctgaaaaggcatcttttcctcatgacatgcattcatggccattgtagattacatgcctggagctgcccttctcagcctttcaacctctcattacatgcatattctttcctctgttctttacagtcccccatttccctgacacagaccccgcactacaatcctcttccttatacttgacacagaaataatttaaacacaaacccaaatacaaacactgcatagatttaccatatggaatcacatatgtaaaatttctgaatcaaataacgcaaacccacaatgttactttccaaatatatacaacaacaacaaccgaatgggtggtgaaacatattacttatgaaaggtgctcaatgttaaaagcaattaaaataaaattcagaaaaaagtgataccatacctctattccacaagcaaaaaaaatttccaaacttacctgcaaaagaaaagaacaataaatctcaaatcagaggatattttatttttttctagtaaatttggcaaaattgtcatcataaatatagttatttcttaattatcactgtgtatatcactctctgtaaataatgcttattggttcttatagataccaacagggctggcagtgacattctctaaaggccaattctcatagtccatagggtcattttccatatgtaatctgcttcataagaaagtttttagaacaaaaacttaaacaattccctggacccaggaaatctgcattacaagacatttttgggggtgctaaatccaaacaatgaaaaaagaaaaggttttggggtcagactgacctggactgaaatcctagttctactgtagcctggtaactcaagccattttatgtctgttgagcctcagtattttcgcctataaaatggggacattatatttatgtaattcaattattctaagcattgaagtcattttgtggcatgctgtagacactcaaaaaatattgccttcacaccatcctgtaagctttattttatgccaatactttgctgaaacataaatgcttagtgcggtatctaaagcatggaagagctttaagcaattaataatggatagaaaagtaacaagttttacatttccatcttcatagtgtgaccaagttggtttacatgaaatattaatcatcttctagatgctgggcaatttatttcccggtgtaaattcaagtgtttcactcagagttcaatcaattaactgagagtatggcagtctttagcacggtctctacatcccatatattcacatgatgccccctattatgtccccattcacgatctcacttatgtcccctcactgcagcctcactagccttccagccattcctggaaaaatcgcaagcctgctccagtctcaggatatttgcattccctgcccatttgcccacgaatctatccccactccccttcaatccttgcctcaaagggccctttctaacctgatttccctattgcaaattctaaccatattctcagcctctgtattgaactcccctgctattgcactatttgttccctagcactgagagccttctaagacgctacacaatgtatttatttactatgcttactgagtctctctgtccctaccactccatataagctacacagaaataggggtgtctgttttgttcactattgaatacccagaacctggaacaatgcctggtaaatagaagctattcaaaaaacatttgtttaaggactcaataatacacatatgaaaaaaccaaatataaaaatataaattatacatatataatccatatgtatatttgtttatatacatattttgcttatatacctacatatttatcacacaaatatttacatgctgattatccataggaatttttaatttttaattaaatttttagctagaagtaaaccatttttgtttttgtttttgtatttgttttgagatagggtctccctctgtcacccaaactgaagagcgagtggtgcaaacacggctcactgcagtctcaacttcctggactcaagcaatcctcctgcctcagctttccaagtagctgagactacaggcccatgccaccacacctggctatttttttatttttttagttttttttattttttgaggagacggtgtcttgccaagttacccaggctggtcatgaactcctggactcgagcaatcctcccacctgggcctcccaaagtgctaggattataggcgtgagccactgcgccaagccctattttatttttacttaacaattattatgagagaaattgaggcaaccattagcgatactggctctctctttgtagctctccaccctcaggacacatgtagatgcacttaataaccctcttgtagttgaatggagccacgtgactaattctggccaatcagcagccaagcgttgattcgctggtgtgagactctccatctcttcccctttctccttctgccagaaggatcaacaaagtccatgatggtaactctgtcagtttctgtaccagagtgaggaggctgtgcagcagagctccctgtcgatgatatgtagtatgggaaacaacaatcactatcatctttgttgttacaagatttagaggttgtcagggcaatttaactcacccatcaggataaatagagaaattatgcacatataattttaaaattatactgaaaaccttattcaaaaaacagtctgcaaaactatactatatatattcattgtgaatgctctttctcaagtcattttgtttctgctggtaattaactctataattctaagtaatatgcttatactgggtttttttttcttgattttcatttttttagccattatctattcatttcttatcataataaacatttaattatcttatactgatctccagttcccttttttcacctagttacatcacaatttttagttaaattaacaatcactgtttacatatttttactatatataaatcttatttactatgtatgtaatatatacatatttgctttacggctcaacttctgttttgctagtagttaataattgctttggttcttttccaaatggtactcatatctgccacccctctcagatgctctagcaaattggataatctatcaatttcattttctcttttcagcctcctcctcaacaccttgtactcttgcttcaatctgtacttctcagctagttgctttctaggcccgctagaaatctgacatcctaagcattctttctgttatttcccgtgttgattattggatctcatgatttcctttttgatagcttcctgctttttgtgggtcacattttatagaagctcaagtggcaaatgaagtgaatagtattaatattttacattttttggatcttgcatcactaaagatggctttattctgtctttacactagttcatagtttgacttgctaaaggagtctatgttgaaatgtaaattccttcaaaatattgaagccattactctattgtactccagcatctatttttttaagtaatttatcattaatctgattactttcattttaggtagagggtggggtaggaggcaaggtttcagcattcatgatgctgactcttctggatgttgaaatgcactgcccagaatcccctcagcatgtgtttctccagtagagggtatactgctcttgcccaagattatacccatttatacagagcagtctgcagacaatggctatttgataaacgggaaggagatagtatagagtcctaaccccttcctctaagttttagaaaccccaactgaaccagaagaggcctccattgagcctttaaccctgttcctactcttcttcctgtggtgctcacactgagaacatttccccacaaacaccctgcatcccaatctctatctatctcggagtatctcagggaaccagatctgcaccacagacattcccttcattccttgtttcagccccacacctcatccctgcagggtgctacatcttctctctcagagtcctgaccctttctgagaacatttctctagaaaataaatcttgggtatttctgtggtagggtgtgcgggtagaaacaggagccttggataggatgtggggaggcagccttctcttccattctcacacctttccttttaaattcctccatttaattacagataatatgaacatatggtccattcactacaattgattaggagtccattcttttagattgttggttcatctctgttggcatgaattaaaaacaattttatctattaaaagtagaaaaggtataagaacattttccaaactgttacattgaatactagtttttgagatgttaagagtccagttgaataataaaaacaagaaaaagactagagagtcaaataatttgtaaatatggcttcaaaatcttaaagaaaatatttctttttattacgtgacttctaagagctttaaatatactaattggaatgtgactattctagaaggtggagagcatttgcagagtaattagaccattcccctgtagacggcagttaatatcagagtaagccatgttttagaatatgacttgggcctgggcatggtggctcatgtctgcaatcccaggatttctgggaggctgaggtgggaggatagcttgagcccaggtactccagcctggggcacaaagcaggaccttgtcaagaaagaaagaaagaaaaagaaaagaagggcagggcagcgcaggaggaagggagggagggagggagggagggaaagaaagagaaagagaaaagacaaaaagaaatatgccatgggaattgctgcacaaagcatcttaatctaagttttatactaatcacagggcttctattactcctacaagaattcctttaccttagctggagaggtaaaatgaattgctaaacacttaaaaaccagcatgactgtaccaaggaataaaacatgttaactctgtttcaggtgagtgctttctccattacatcaaattgcctgcttacttaaaattaatcataatatttgaattaggatcacgtaatgtaaaaaaatctcatttcccagaatattctacactagaaatcaatttctcactatcctgctgaaatttgtccaagcaatctgcatatatttttaaatctatcttttttatctctagttcagcatgtgccataatgttctctgtggagcacccaaccccattactctgtaagcaaacaaaaagttaactatttaataaagtttggaatattttgcctatgtatctccttcctggatatttacaatatttatttagcttccagtaatatatcagtttaattttatgaagctcagcttatttgaccatgcaaccattttgcaggtagtacctgttgatattagcattccacaaaacctactttgggaaatactaacctaggttactaaggttcatactagcaagagatgaataagactaactattataaataataatggagaaaaaaagagctccaatgatctgacacagagaaatggattttatgaagggacatgatttctcaatgagaaagaaagaggaaacagaaaactaatagttccattgtatttccatagttagggtggcgtatggttaggattctttgttcagttttataaacctcgtactgtcatgacttcattaacccaaggctaagctgtaattctaaaaggtatatatatatttaaaaattgacaaataagaatgtatatatttatgatgtaaaacattttatttacatagatgtatacattgtgaagtggctaaatcaagctaattaatatatacattacctcacaaacttatctttttttgtggcaagatcactaaaaatctactcttttagctattttcaagtatgcaatgtattgttgttaactatagtcaccctgaggtacaatagatctctggaacttattcctcctgtttaactgaaattttgtgtcctttgactaacattgccccagtcttcagcccccacccatcagccctggttaacaaccattttattctgtttctatgagtttgacatttttagctttcacatttaaatgagatcatgtggtggttgtcattctgtgcctgacttatttcacttaacataacgtcatccagattcatccatgtgatcccaaatgacaggatttccaaaatatataaggaactcaaaaaggtcaatagtatgaaaacaaataacttgattaaaaaacaagaaaaggatctaaacagatgtttctcaaaagaagccataccaatggccaacaggtatatgaaaaaaatgttcaacatcacttaataatcaaggaaatgcaaactaaaaccacaatgagatatcaactcatacctgttagtacaaaaaagatgaaagatggcaaggatgtggagaaaagggaagatgtttacactgttggtgggaatgtatattcacatagccattatggaaaacagcatcgaggttctttaaaagctaaaaatagtactaccatattatccagcagtttcactactaggtatatatccaaaggaagtgaaatcagtgtgtcaaaaagatatttgcactcccatgttcattatagcattatttacaatagcaaagatacagaatcaacctaagtgttcatcaacaatgaatggataaagaaaatgtggtacacacacacacacacacacactcacacactagaattctacccagccctgaaaaagaaggaaatccataataacatcttttattttggatagaatggacatcaagggtatttgtgacagatataccatgaatgacatgaacctaatattaaatatttatttttgttgatgtaaggaacattaatagcctagaaactataagttttaagatttagcttaggaactcaaacgatgtagcaaatatatttcatcatgatttgatctatctatatcaatcttataaaattgtgtgagcatgaggttttggggatgaagagataatggaatcaaattttagcttttacccccaaaccttctagactttaattgtatattatgtaaaatgtaagtatttaaaatatgaagttcatgaatgggttcatgagtcaaccgcaggggagttggtgaagcccctgaaactatatgaaaaattgtgtgtacatttacatttttcaagagagatttgatctagtcaaattttcaaagcaccctgagatacccaaaaagtgatagaccccttaaagagataatctctaagaattctgtctcctttttcattaacagttttataagctttcttatgaaaagtatgtcatgtttatgatatttagtaatttctttgctgagccttcatttttagctattcaagaaatttaaaagtaaattgtaaatattacaattagtttctaaggattgtttaaaatatcattaattatataaaattttaatatatattttcagttcttcagctaggacagacagagcctctttaaaagattttatttgatgctgggaagggtgctgggaaaagagaactcctatacactgacgatgggaatgtatattagtacagccataatagaaaacagtatggaagtttctcaaaaaactaaaaataaaactatcatatgatccagcaatcccaccactaggaatttattcaaaggaaaggaaatcagtatattaaaagtacacctgcacccccatgtttattgcagcactattcacaatagccaagatatggaatcaacctaagtgtccttgatggaactggaggtcattacaataagtgaaatgagccaggcacagaaagacagatatggcatgttgtcactcatatgtgggagctaaaacagtggatctcttggaggtagagagtagaatgatggttaccagaggctgggaagagagaggtgggatgaaaagaggttagttaatgggtacaagcatatagttagatagaagaaataagttctagtgttcgataacacagaaaggtgactatagctaacaataatttattgtatatttcaaaatatctggaagagctgaagtgttcccaacacaaaaaataataatcgtttgaggtgatggttatcttaaataccctgatttgatcatcacacattgtatgcatgaatcaaaatatcacatgtacctcctaaatatgtataattattatgcatcaatacaaatatttacagtaaaaaggagatttgaattgtaagaaaaaaagagaagaaattctatttttgcaacttataatagttattatttgtgtgagatactcacttgcccacaagatggcgctctctaattttggatatactattttcccaaaccaatttctcaagaagttatttctaaagtgttctcttccctgaaaaataatatttacaataaattattcttcactactgtttgattttcatgcttgaacatctaacaatgcatgacaaagtatatgttaatgtttttgtgtgagtggattgatgaatggatgtttcagacattcacagaatgtttactaaatttctgctgcataaacagctttgcacagtggatttataaacaaagaaacaaaaggtgttaaagtataaagagcaaatcagggttactatttttcaagttaatatttttatatccaagagtttcatatttaaatgaaaaatgattgttatagacatgtaaatgtacagcaaagagaagacatcggttcagttaggtaaaagaccttataagttgttgtgacttatgaagaactttaaggtttgtatgagaaggaggtaaggggaagatatttaagaggcggcaaataacataagaaatagcttgaaattatgtagtcatgccatcccaaaataaaatggcctcccattagataaggctagatgagttacagagggtggtaaaagtcactccaagaggaagaaaaggtaactaatatttactgagaacataatataactcatactgttatttaatgatctttccccacccttgaaaatacgtggatgtgcctcttattagagtgttagaattatggtgctatatttggatattttgagtaggttgcacttccctaaatgttgtactaaatcccagtatacagtcaccagaggaatagagatttcccagagaggaaatcagagttaaggaggtgagccttaagtaagcataggaggagactaaacttctctgtcttgattctcaatctcttgagtaatgactatgtcttgtggagccctctcttgtgggaaagttaaagatggcctctgctgtccagtgtgaagagggagtcagaagaagagtttctcctaggggacttcatttgaataagatatctcctatgatagaacaaattatctagtttcatgttactttgattctacatagtttgtcagtaaagtgttgctttaaaattcctgctttgtctcagctgttaaacaaagaaaaggatttttttaaaacccacatttagatcaaattgacttaaaaagagtacctgtctgtccaaaggatgatggtagtgagaacaacaatgagaaagaccctgaaaaaaagaattctgcttctcactgatctctctttcttcccttattcccctaaagtcatctccaaattaggagtcagagggatcttgttaacatctgtttaaaggtctttgtttaataaggcaaagccactagtaagatgaatagagctctgagtccccttctgtttcatctccaactttttcccttattctccactttgctacttcactccagccaccaggaccttcttactgtccctccatgatggcaggaggactttttgtacctccttcatgtttgctcacatgctaccttctgaatgaggtctttcctaacaccacttaaaattccaccacccaccacacacacattcgttaacctcttctctaatacacttttcttcatggtatttatcacaaaatcttccccatacatatttttaaatatagatatataaataaatatatatttctatatattacatatatatataatatataaattattttcatctttcactcccagctggaatataaactccacaagggtagaatttttgtctgtttcattcactgctgtatttttttttacagtacagagaagaaagctcagaacatagtatgccttctgtgataatcctgagtgtgaacttgagtggatggaaggatacaaagtattgatcctgggtgtgtctgtgagggtgttgccaaagaagattaacatttgagtcagtgtgcagacccactcttaatctgggtgggcacaatctaattagctgccagcgctgctagaatataagcaggcagaaacatgtgaaaagaaagactggcctagcctcccagcctacatctttctcccatgctggatgcttccttctctgaaatattggactccaagttcttcagttttggaacttggactggctctccttgcttctcagcctacagatggcctattgtggaacgttgtgattacgtgagttaatacttaataaactaccctttatatatatgtgtgtgtgtctatatatatatatatatatattccattaattctgttcttccagagaaccctaatataccttgtcatatttattgaatcaactttttaaaagtctaatttctgtgttctcttgaaaaatcagaaagcctgccaaccctggcctatattttcacatgataacaactgtgaggagctcagaagtcactgcgcatgcaggtgaggatatatctataccctccttgcccaggatccccctgccttctccatttgaatagctcctggctcctgcagatatgtgagttgtgacctgctggaagagtcctgaaagggagagtgacaggatcaaatgaagactttcagtaagtcacctggaaatagtgtgtaggattaatttaacgagtctggaggttgatgcctgttagtatctgctgtcgaagtcctggcatgaatggatgaggacctatgtgatgtgaactcagctgaagaatgaaagacaggggaagtagagtttgaagaaaggattaattgaacctgaggatggattggatattaaaaatgaatgaaaagaaaaagtaatgatgactaaaatttctagactggataattaggaaaatgttaatttctgatgtaaaagggaactcaggaaagagtcaacctaggacaaaaatcaaaagacctacatatggaaagaaatatactgatttgagtgaacccaagcagagtttgaagacacagattcaaaggtatttgacaacaaaaaaaggactttgagatcaatgccagagatggggactcaattttgcatactgcttatatactgcctacgtaaaggcactttatgataaagaacatctcaaaaaaataacatatagaacaaggggcaaaaataggggataaaagagatgattcccaattattggtcaagtggttggagtgagaattaaaggcaaaattcctcttctccccctcaaaattacacacaactacacaaacatatgtgttaatgattttagtgtgttgaatctggctgcttccacactgcatgcatcctacctttctccattcacacctgagataatctcattctagtgaagtcttacattataaatgacaacaccaatatttagggacgttcctcttttttcttcactgactttgcctttccaaacaatatactttgtgaatcctctgagaaaaaagaaagtagtttgatctgctggtttttaggacaataatttttaaaggacttgttatttttggttcagacaccatgcaaaactcatcttcaatcaagggcaggtgccaggtacagcatcaagaaagtaacaggtggtttctcttcctctcctttcctctaaaacatgaataaaacaaaagttttagcatttcagaaataatctttttaattaaaagtggaagataaatgtgataaaagttttctttgagctcttgaaaacaagttcattctataagggttagaaatagtattttttatctgtcactagagccattgtactgtggggcctaatgtttcagattttggatactcatttctttcgattgaaggtgtcatcaggtgttttccacctttagtgatctcaagtggttccccttcagttgctaaaatatactgtgtcgtttgagcagtccaagacccacagagatctgctatctatattggcagataaatgacagcagatggaattgaggctgtgttctgtctcatcggcaagcctgcagccttagaagaagagatgtgcccctgaagcattatgcaggttgctcatccagaatcagtgtcactgtcatagtttgtgaaagggaaattggcaaatctctatacataataggcaaaatgcaaccctctcaattctcaaaggcatattctcttcactcacatttttgtctttttgctgaagggaggtttctgggccaagatgttctgacagcctggtattttctttttttgcccaatgtgtaagaagataattaatgttaccattaatgcatgcaatgacattagtatcaattcccttagtgatatatatgcactaggaaatgaacacaaaagttaattaacaatttattgagcatatactatattacaagtttactatacaattgtgctttattactattggtgaaaataatgaaagatggcacttttctattcttcaccatatacaaggcacagttccaaggatttaaaatctatcaactttatgaatctttacaacaggaggagccaagatggccgaataggaacagctccggtctacagctcccagcctgagcgacgcagaagacaggtgatttctgcatttccatctgaggtactgggttcatctcactagggagtgccagacagtaggcgcaggtcagtgggtgcgcgcaccgtgcacaagccgaagcagggcgaggcattgcctcactcgggaagtgcaaggggtcagggagttccctttcctaatcaaagaaaggggtgacggatggcacctggagaatcgggtcactcccacccgaatactgcgcttttccgacgggcttaaaaaacagcacaccacgagattatatcccgcacctggctgggagggtcctaccccacggagtctcgctgattgctagcacagcagtctgagatcaaactgcaaggcagcggcgaggctgggggaggggcgcccaccattgtccaggcttgcttaggtaaacaaagcagccgggaagctccaactgggtggagcccaccacagctcaaggaggcctgcgtgcttctgtaggctccaactctgggggcagggcagggcacagacaaacaaaaagacagcagtaacctctgcagacttaaatgtccctgtctgacagctttcaagagagcagtggttctcccagcacgcagctggagatctgagaactggcagactgcctcctcaagtgggtctctgacccctgacccccgagcagcctaactgggaggctccagcaggggcaggctgacacctcacactgcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaatcagagcgcctctcctcctctaaaggaacgcagctcctcaccagcaacagaacaaagctggatggagaatgactttgacgagctgagagaagaaggcttcagacgatcaaattactctgagctacgggaggacattcaaaccaaaggcaaagaagttgaaaactttaaaaaaaatttagaagaatgtataactagaataaccaatacagagaagtgcttaaaggagctgatggagctgaaaaccaaggctcaagaactacctgaagaatgcagaagcctcaggagctgatgcgatcaactggaagaaagggtatcagcaatggaagatgaaatgaatgaaatgaagtgagaaggaaagtttagagaaaaaagaataaaaagaaacgagcaaagcctccaagaaatatgggactatgtgaatagaccaagtctacgtctgactggtgtacctgaaagtgatggggagaatggaaccaagttggaaaacactctgcaggatattatccaggagaatttccccaatctagcaaggcaggccaacgttcagattcaggaaatacacagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattctcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaataaccagctaacatcaaaatgacaggatcaaattcacacataacactattaactttaaatgtaaatggactaaatgctccaattaaaagacacagactggcaaattggataaagagtcaacacccatcagtgtgctgtattcaggaaacccatctcacatgcagagacacacataggctcaaaataaaaggatggaggaagatctaccaagcaaatggaaaacaaaaaaaggcaggggttgcaatcctggtctctgataaaacagactttaaaccaacaaagatcaaaagagacaaagaaggccattacataatggtaaagggatcaattcaacaagaagagctaactatcctaaatatatatgcacctgcaggagcacccagattcataaagcaagtcctgagtgacctacaaagagacttagacttccacacattaataatgggagactttaacaccccactgtcaacattagacagatcaacgagacagaaagtcaacaaggatacccaggaattgaactcagctctgcaccaagcagacctaatagacatctacagaactctccactccaaatcaacagaatatacatttttttcagcaccacaccacacctattccaaaattgaccatttacttggaagtaaagctttcctcagcaaatgtaaaagaacagaaattataacaaactatctctcagaccacagtgcaatcaaattagaactcaggattaagaatctcactcaaaaccgctcaactacatggaaaccgaacaacctgctcctgaatgactactgggtacataatgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaagtaaaagaactagaaaagcaagagcaaacacattcaaaagctagcagaaggtaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaacgatcccacagaaatacaaactaccatcagagaatactacaaacacctctatgcaaataaactagaaaatctagaagaaatggataaattccttgacacatacaccctcccaagactaaaccaggaagaagttgaatctctgaatagaccaataacaggatctgaaattgtggcaataatcaatagcttaccaacaaaaagagtccaggaccagatggattcacagccaaattctaccagaggtacaaggaggaactggtaccattccttctgaaactattccaatcaatagaaaaagagggaatcctccctaactcattttatgaggccagcatcattctaataccaaagccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacacaaatcagtaaatgtaatccagcatataaacagagccaaagacaaaaaccacatgattatctcaatagatgcagaaaaggcctttgacaaaattcaacaaccctacatgctaaaaactctcaataaattaggtattgatgggacatatttcaaaataataagagctatctatgacaaacccacagccaatatcatactgaatgggcaaaaactggaagcattccctttgaaaactggcacaagacagggatgctctctctcaccactcctatttaacatagtgttggaagttctggccagggcaattaggcaggagaaggaaataaagggtattcaattaggaaaagaggaagtcaaattgtccctgtttgcagactacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaacacctaggaatccaacttacaagcgacatgaaggacttcttcaaggagaactgcaaaccactgctcaatgaaataaaagaggatacaaacaaatggaagaacattccatgctcatgggtaggaagaatcaatatcgtgaaaatggccatattgcccaaggtaatttaaagattcaatgccatccccatcaagctacccatgactttcttcacagaattggaaaaaactactttaaagttcatatggaaccaaaaaagagcctgcatcaccaagtcaaacctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaacggttctgggaaaactggctagccatatttagaaagctgaaactggatcccttccttacaccttatacaaaaattaattcaagatggattaaagacttacatgttagacctaaaaccataaaaaccctagaagaaaacctaggcattaccattcaggacacaggcatgggcaaggacttcacgtctaaaacaccaaaagcaatggcaacaaaagccaaaattgataaatgggatctaattaaactaaagagcttctgcacagcaaaagaaactaccatcagagtgaacaggcaacctagaaaatgggagaaaattttcgcaacctactcatctgacaaatggctaatatccagaatctacaatgaactcaaacaaatttacaagaaaaaaacaaataaccccatcaaaaagtgggcgaaggacatgaacagacacttctcaaaagaagacatttatgcagccaaaaaacacatgaaaaaatgctcaccatcactggccatcagagaaacgcaaatcaaaaccacaatgagataccatctcacaccaggtagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaacaacgatagactggattaagaaaatgtggcacatatgcaccatggaatactatgcggccataaaaaatgatgagttcatgtcctttgtagggacatggatgaaattggaaatcatcattctcagtaaactattgcaagaacaaaaaaccaaacaccgcatattctcactcataggtgggaattgaacaatgagatcacatggacacaggaaggggaacatcacactctggggactgctgtggggtggggggaggggggagggatagcattgggagatatacttaatgctagatgacgagttagtgggtgcagcacaccagcatggcacatgtatacgtatgtaactaacctgcacaatgtgcacatgtaccctaaaacttaaagtataataataaaaaaaataaaaaaataaatctttacaacattcctatgagtttagcatttaccaactgcattttagatatgagagaaaatgctaatagttattattcatagtaataccaacaaaaataatagctaacatatgagtatttgctaagttttaggtaccattatgtatgttacataaatatgcatgtatgcatatatacaggttgagcatccccatccaaaaacctaaaattcaagatgctctgaaatccaaaatgctccaaagtctaaaactttttggtcactgacatgagatagtgactcctttgctgatggttcagtgtacacaaactttgtttcatgcacaaaattatttaaaatattgtgtaaaattaccttcaggctatgtgcacatggtatacataaaacataagtaaatttcatgtttatggctgggcatggtagctcacacctgtattctcagccctttgggtggccaaggcaggagaatcatttgagaagaggagttcaagaccagcctgggcaacatagagatatcctgtctctacaaaaattttaaaaattagctggacatggtggtgcacacctgtagacctgcacacctgtagatcgctggagcccaaacgttcaaggttacagtgacctatggtcatgccactgcactccagcctgggcaacacagactctgtttctaatacatatattagagactatctatctatctatctatctatctatctatctatctatctattttgatcccatgggggagatcactcctttaataatgcaagagagtgaataagatgggggagggtggcgtgcaattgagagatgagctttatactggaataccaagtttatggtgtggaactctggggtattacactgaaatgttaggggttctcagtgggttatttgtctctttctattaaactccatttacatttagctctgctgatgttgctcttgcagcaattggttttctcaattaacagaaaagggagagggaacagcttaaagccttggctgttgccgctcagcaagggaactgtgctgctctggagagaaaggtctggacattgtgagtttctgtttatttactttgtttctgacacacctgtctttcaggaagcctggcagtcctaagctgaatgaatagcatgctggaaagcccttcttttgaactaagttcagggcttttcttctaaactgaggtgccctcacaacacatgttctgccaaccacccgaaggtcaaaaagattttctggatgtttttgagacaaagggaattcaaaatctgcaaggaatggcctggggcatgataattctgagagacaagattctccaggctatgcacagaaaaccaactttttatgttagtatttaactcaagtagaatcaacaatggcatggaaattcgttttattttgcttttcctaaggaggatcatctcgtttaaagtgtgaattcaaaaactcactattgtgatagagtgacctcttttcatcctaattattttccataagtatcctgcttgctagtgaaaagactgaaagtgaagaatactagttataaatcatctttagagtgagagctgaagtgagataatttaacctgaacagcacaagctgtccctgacatctgcaacttcactcatcaccagcagtgaatctgctggtctgattggccaggtgtacatgtctcctctcccgaacggtcaggggtagccagtcacacttctgccaataaagagcacgacaagtccctactctacagttagtgaccatgttaaacctatcaaagattaaaggggaaatggggtattccattcaaatgttaaaaaattccaatccaagatgtctacctattatcatgataatcaacacaggacatttatatccagaaatttggttgctttggttccttttatatttacaaaataattattaaactaacccacacaccccaaattgtatgcacagggcttagaacaagttgcaggagtcttttgtgccaccctcttcataaggctctcaaactatttttttttaaattccatatttctaactgactttctattatgaatgatgaagatttcacactctttcaccatttcacctctctacttccctctttctatcctcccattacagttatataacaattattggctaaataaacattcagtgttctattgtatcatccctgcaaagtaacgtttactgataaaccaaatgatgtgccataattatgttttatttatggaacaactttttgttttttctggagttatatattaccttctttatttgattatgtgacattatcaccaatttttctagacgtctccaaaacataattttttaaattttaaatttctgttggtacataataggtaggtaggtagacagacagacagacagacagacagacagacagatagatagatagattgattgatttatggggcccacgagatattttcatacaggcaagcaatgcataataatatcagggtaaacagggaatctattactgcaaacatttaccctttaagttacaaacaattcaattatattctcttagttattttgagatgtatgataaactactgttgactgtagtcaccctgttgagctatcaaataccagatcttatttgttctatctaattatatttttgtacccattaaacatccccacttcttacttcctcccatccactacacctcctagcctctggtaaccatcactctaatctctatctccaggatctcaattcttttaatttccagctcccttaaatagtgagaatacgtgaagatgatctttctgtgcctggataatttcatttaacataacatcctccagttacatccatgttgttgcaaatgacaggatctcatttctttctatggccgaacagtactccattgtgtatatgtaccacattttctttattcattcgtctattgagggaaacttaggttgcttccaaatcttggctactgtgaatagtgctacaataaatatggaagtgcagatatattgatttcctttcttttgggtgtatacctacctagaagtgggattgctggatcatatgggagttctatttttagctttttcgaggaacctccaaattgttctccgtagtggttgtactaatttacattcccaccaaaagtgtaggagtgttctcttttctctacatccttgtcagcatttgttactgcctgtcttttggataaaagccattttaactggggtgagataatatttaactgcagttttgatttgcatttccctgatgaccaatgacattgcacaccttttcatatgactgtttgccatttgtatgtcttcttttcagaaatgtctattcaggtgttttgcccatttttaattggattatcagattttttttcctacggagttgagctcctaatatattctggatattaatcccttgtcagatggatagtttgctaatattttctcccattctgtgggttgtctcctcaccttgttgactgtttcctttgctacgcaggtatttttaacttgatgtgatcccatttgtctattttcgctttggttgcttgtgcttgtggggtattactcaaaaaatctttgctcaggccaggcgcagtggctcacacctgcaatccatgcactttgggaggcctaggcaggtatatcacttgaggtcaggagttggagaccaacctggccaacatggcaaaaccctgtctcaactaaaaatacaaaaattagcccagcatggtggtgtgcacctatagtcccagctactcaggaggctgaggcacaagaatcacttgaacccaggaggcagaggctgctgtgagctgagatcacaccactgcacttcagcctccagtctgggcaacagagtgagactctgtctaaaaaaaaaaaaaaaaatctttgctcaggccaatgtcctggagagtttccccaatgttttctttcaatagttttatagtttgaagtcttagatttaagtctttattccattttgatttgatttttgtatacggcaagagatagaagtctagtttcattcttctgcatatagatatccagttttcccagaaccatttattgaagagactgtcctttctcaatgtatgttcttggcacctttgtcaaaaatgagttcactgtacatgtatgaatttgttcctgggttttcatgccagaaccatcctgttttggttactatagctctgtagtgttatttgaagtcaggtaatatgattcctccagttttgttctttttgctcagtatagctttgagtattctgggtcttttgtggttatacatgaattttaagatatttttctatatctgtgaagaatgtcattggtattttgatagagattgcattgaatctgaagattgctttgggtactatgtacattttaacaatattgattcttccaatccatgaacatgaaatatctttccattttttgtgttctctttaatttctttcatccgtgttttatagttttcattgtagaactctttcacttctttcagtaagttaattcctaggtattttatttgtagctattataaatgggattacattcttgatttctttttcagattgttcaccattggcatatagaaatgctactgatttttatatgttgaatttgtgtcttgcaactttattgaatctgtttaccagttctagtagtgttttggtgaagtctttaggtttttccaaatataaaataatatcatctgcaaacaagaataacttgacttcttcctttccaatttgaatatcctttcattctcctgtctgattgctcaaggggtaatggacatccctgtcatgttacagatcttggaggaaaaactttcaatttttccccattcgatatgatactagctgtgggtctgtcatatatggctttccttgtgttcaggtatgttccttctatcctcagttttttgagtttttatcatgaagggatgttgaattttatcaaatgctttcccagcataaattgaaatgatcatatgtttttgtccttcattgatatgatgtatcacactgactgatttacattatgttgaaccatccttgcttccttgggaaaaatcccacttggtcacgatgactaatctttttaatgtgttgctgaatttggcttgctagtattttgttgaggatttctgcataaatgttcattgggagtattggcctgtagttttctgtttgcaatgtgcctttggtctgtttcggtatgagggtaatactggccttgtgcaataagtgtggaagtactccctcctcctctatttttcagaatagtttgagtaggattgatattacttctttaaatgtttggcaaaattaagcagtaaagccatcagatcctgggcttttctttactgggagacttttcattatggcttcaatcttgatggtattggtctgttcaggttttggatttcgtcatggttaaatcttggtaggttgtatttgtctaggaatttatcatttttttaggttttccaatttatttgcatatagttgctcctagtagcatctaatgatcctttgaatttctgtggtattgcttgtaacgtctcccttatctttccttatctttccttccccccccccccccccatagagtcttgctctgtcatccaggctggagtgcagtggcacaatcttggctcactgcaacctccgcctcccaggttcaagcaattctcctgcctcagccttctgagtagctgggattacaggcacgtgccaccacgctggctaattcttgtatttttagtagagatgggatttcaccgtattggtcaggctggtctcaaactcctgacctcatgatctgcctgccttggcctcccaaagtgctgggattacaggtgtgagccattgtgcccagcaacatctcccttttcatctctgattttatttattagcatcttctttcattgttttaaattctaactctcttttgttcttacttgataattttgtatagtatccttttgtttcattaatgtgataacttgtcatctgtctagggctacgaagtttattttttctgaaacgtctatttgtttcttaaactctttttatatcaacctaatcatcatcattattttcatttgtttgcattaggctttttgttgaagaatttcctcagagttttgtggagacttggctatctattcatattcaacagggagacactaaaatactgactgggagccttgaatgatttaactggacttgtagagtcttggggttcattatagggtggtgttccttgaatgtcccctccaattctcatgttgagatgtaatcctcagtgttggaggtggggcctggtgggaggtgtctgagtcatgggagtggttcccttatagctttgtgagcaagttctcataaaatctctttgtttaaaggtgtgtaacaccttccttcccgctctctctcttgctccccctattgccacgtgagatagctgctctctcttcagcttccaccatgattgaaagctccctgaggcctctccagaagcttagcaaatgctggcattatgcttgtacagcctgcagaactgcaagccagttaattttctatttcttcataaattacccagtctcagatatttctttattgcaatgccacaacagcctaatatagaagactggtaccaaggagtggggcattgctataaagatacctgaaaatgtcaaaatgacattggaactgggtaagagacagaggttggaagaattgggagggctcaggagaaggcagggagatgaggaaaagtttgaaacttggtagagactgattaaatggtcatgaccaaaatgctgatagtgatctgcaaagtaaagtccgtgctgacaaagtattaggtgtaagtgaggaacttattgagaactggagcaaaggtcacccatgttataccttagcaaagaacttggctacattatattcatgcccagggacctgtgaaagtttgaacttaagagttaatgacttagggtatctggcagaagacatttctaagcactgaagcaattgagatgtgacctggctgcttctaataacctatgctcagatgcagaagcaaagaaataacctaaacttggaatttttacttaaaagggaagcagagcttacaagtgtggaaaatttgcaacctagctatgtgatagaaaataaaaggccatttttggggaggaattcaagcaggctgcaagcaatcatttgctagggaaatttgcataactaaaagagaacaagtgctaatagccaaaataatgggaaaaaggcctttacagcatttcagagatcttctaggcagctcctcccaccacagtcccagtggtacaggaggactaaatggtttaggggataagcacagggcaccactacactgtctacctcaggaggctgctccttgcatcatggtccatccagtccagccgtggctcaaagagcctcaggtatggctcaggttgccactctggagcatgtaagctgtaagcctttgtggcttccttgtggtattaagccttcagatagaaagaatggaaagagtgatcctagtctctgcctagatttcagaggatgtatcagaaagcctgggtgtccaggcagaagcatgctacagggacagagtcctcacagaaaacctctactaaggtagtgcagaagggaatatgggattgaagccctgcccacaaagaatcccccctggggcattgcctagtggaactgtgggaaggaagccattgttctgtgggtcccagaatgtagatccactggcagcttgcatcctatacctgggaaagccgtaggcactcaactccaacccatgagagcagtcatggaggcttcaccttgcaaaagctgtagaggcagagctgcccaaggccttggagtctacccttacatcagtgtgacctggatgtgggacatggagtcaaaggagattattttagaactttaagatttaatgactgtcctgttgtgtttcagacttgggtggggcctgaagtcatttcttttggctgatttcttccttttagaatggaaatgttggccaggcatgatggctcatgcctgtaatcccagcactttgggcggctgagacaggtgaatcacctgaggtcaggagttcaagacaagcctggccaatgtgatgaaaatccccatctctacaaaaatacaaaaattagctgggcatgacagcgggtgcctgtaatcccagctactcaggaggctgagacaggagaatcgcttgaacccaggaggcagaggttgcagtgagccaagattgcaccattgcactccagcctgggtgactaagcgagactccatttcaaaaaaaaaaaaaaagaatgggaatgtttacccaatgcctgtacctctattgtaccttggcttggaagtaaataacttgttttaattttacaggctcataagtgggaggaactcatttccagacaagattttgtatttggacttgggacttttgagttaatgctggaatgagttatgactctgggagactgttgagaagagatgattccattttgccatgtaagaaggacatgagatttagggggccaagggcggaatgatacagtttgggtgtcccctccaaatctcatattgggatgtaatccccagtgttggagatgggccctggtgcgtggtgtctgggtcatgtgggcagatcccttatggcttggtgagtgagtgaatgagctctctgagatctagttgtttaaaagtgtgtgctaactcccacaacccccttactcctgctctcaccatttgagacacctactccccttttgtcttctgaaacaactacaagttccctgaggcctccccagaagctgagcagatgccagcaccatgcttgtacatcctgcagaactgtgaaccaattaaacatgttttccttataaagtacccagtctctcaggtatttctttatagcaacgcaataatggcctaatacatggggtaattgaggaataaagacccttggcttctttattgggcaaccatctaatgccagtactataggtcttttctctgggtggtaattccatttttctgaagaagaattcttcttggttatttttatttttaattttaattcttatgagtacatagtaagtatatgaatttatgggtcacatgaaatattttaatacaggcatacagtgtgtaataatcacatcaggataaatggaggagccatcatctcaagcatttatcatttctttgtgttacaaacattccaattatattcttttagttgcttttaaatatgcaataaattattgttgactgtagtcaccctcttatgctatcaaatactagatcttattcttcctccccactacccttcccactctttgataaatggcatcctactctctatctccacgagttcaagtgttttgtttgtttgtttgttttgtttttttcttgagacagtctcactccatcacccaggctggagtgcagtggcacgatctcatcacaacctctgcctcccaggttcaagtgattcttgtgcctcagcttcccatgtagctgagattacaggcatgcaccaccatgactggctaatttttatatttttagtagagatggggtttcattatgttggccatactggtcttgaactcctggcctcaagcaatctgcctgcctcagcctcccaaagtgctaggattgcaggcgtgagcccctgaacctggcaagttcaagtatttttattttagttaccaaaaattagtgaggacatatgcagtttatctttctgtacctggcttatttaacataatgtcttccagttccaactatgctgttgcaaattacacaatctcattctttttttatggctgaatagtactccattgtttataggtactgcatgtttttttgcatccatttgtctgtcgatgggacacttaggttgcttccaaatcttagctattgtgaatagtgctacaataaacatgggagtgcagatatttttttagacaatttttatagaaaaacaatttttctatctcctctcttggcattataaggctaactgacagagttcttattcccaggtgctactagagaagtcagaacttcactattcagttgatagactttcatttactctctcaccttccaatgtgcctagtatccccaggttaagacttctcttatttatttttatagcataaatttccattctaatgaggataaagtggcactggtctcctagctgagcagggtgagaggagaacctatggaggactccccttcatatgcagatttctcatccaccttcccccctttttaagattcttggttcctcaattgccatctttcaagattttgacaaagggaatggtttgctggttttgccctcctctgtgggcactttgtaattagcattctcaactttgttgattttttcctctcctttccatttcctaaattggtcctctcacatctctagttgtttcttctcgtcaccctttattactgacactttattgtcttctattctttaccgtcatttgacaagagggctttcaaaggtagcaaataaaaaagactgtattaattttccagggcttccataacaaaataccacagattgggtggcttacacgacagtaatacgttttgtcagtgttctacagtttggaagtccaagatcaaaggcgtcaacaggtttagtttctctgagacctgtctccttggctttcagatggctgccttcttaccatgtgtttacatggttgtctctgtgtgcatgtgtctaatgtctctttgtgagtccaaattccctccctttataaaggtatcattcagattggattaggggccactctaaagacctcattttaatttaatcacctctttaaagaccttatctccatggttacattctgaggtaccaggggttaggacttcaacattttgagaggacacaattcagcccataaaaaagatcacatttaaaacattttaaaaaattcttaacactacgccaaatgtattgcaagtattctctatccttttacttaatgacgctgggaccatctatctaaatgaacactgctctctgaaatagcactcttttcattaatggattcgctcacttattaaatatcaattatcgtgcatctatttttgcaaggttcttggtttatcagcacaacaggatacagaggtaagccagactcaatatctatatacaagagggctttgttgagaaggataagaacaggaggctttttatttctgtgatgaacttttataggatactttaaagcataaaatatttgtcaactccttaatggtggttattctgaaaagaacttgaatgttttcaagggttgtactaatgcagtcatcttttacattaaatgcaacgttttgtacttttattttttttaagtcacttctgttacccagaagtcaggcacttataaaggctacttctgttactttctcttgtcaccatttcatttcaggaaatctaacagctcaactttcaattgcagaagagaaagtgaagaattgaacaacataaaaagcatactcccctctgcggtagttacacatccacaattacgctctgcttagggcaagttgggagcactggagtgggggaagaactgattatagaggggagctgagggtctgtagctcatggcacggctcccaacaatctggcccatggctgttcttacttggcaagcacatgaaattgaagatcactgctgcatctcatgcttctacagggtattgatccatggaaaatattaatgattaacttaagcaatacaatgagaggttgttactttgtactggcaatctttgacttgatcccctatacaaatcacatgcagaatgagtataaagcaaaaagaaaatgattgtttcatttactggtaagttattctggtccttcaccaaaatatgggaaactattttggtctaacatgagactactcaatgagaagtcataactgatatccctgaattttttataggtataaggttaagcttaagatgataatttatccgaagtcttctgaactctgtttttcttaggcagttttctgtatcttggcattgctggtactatattatggtagatatgaaatcagccaaatttaaacttgtctatcttttgttagaaagcatttggaggaaaattatctacattttaggattttccagttataacactgttgcctgtggcaattgcacttgctattagactcttcctgccctttttcaggaaaaagaaactcaagtgtcatttgttattcttgataccaatgctgagtgacctaacaaaaaatgccatggttggctgggcgcggtggctcacgcctgtaatcccagcactttgggaggccaaggtgggcggatcacgaggtcaggagatcgagaccatcctggctaacacggtgaaaccccgtctctactaaaaatacaaaaaaattagccgggcgtagtggtgggggcctgtagtcccagctactcaggaagctgaggcaggagaatggcgtgaacccgggaggcagagcttgcagtgagccgagatcgcgccactacactccagcctgggtgactgagtgagactccatctcaaaaaaaaaaaaaaaaaaaaaaaagaaatgccatggttgtcttgttgcaggtattctgtatttgcctaccatactatgcagtgtccttcttacaaccacctaacctttctccctcccacaatccctgaacctgggtacaattgcatgtagataaagattgacagatggttagcacatatattgatctaggcagataatctcacagatgtgatatgcgggaaataataacatcaaacagctttggaaaagatgtgtaaacactgtgaattttttgcttctatcactttaagagttggactgatttgggaaggactcaaactcttcaagtctagagtcttcatagataaaatagggacattttcaacttcctcctagaatgatgctttcttgtggggactgaatgaatcaatacacatgaaagtgcctctctcccttgatatctacaaatacatgtgcacacacacaaatatacacatacacacacacatatatatatctgtgcatatctgctcagaattctattatgcatttgtttcagtccagacacttgcagtctagtttagaaatcaagcatgaattgtatagcaatccaaatgacaacaaaatcttacaatgaaagacattttagaagctacatgattacatatcctatgactgtactgaaagtaacagagttcacgtgctccatctgaaccctcactgaatgccagtgcacacgttattcttaatactcaagatagttctgcaccttatgttttgttactgtgatttcaaagatatggaatgtgaacctcagagagggtaggcaacttggcggaaaacagaagaaacagatccacttggaccccaagcctggcctccttccatcaggccacccaatcctgaatttgaaacacagtgaattgcatcatgctccgcagtcttcatcatggaagagggagggactggaccttgaagaaagggtagaatttgggcagatcaagaagaatgcagggacacttcagaagaggagaggatgcgagccaaggcatggagacacaaacattggggacatatttgtgagacagtaatacaccagtttgtctataccagaggatctgtgtggatgaaaagcaagagaaggagccagaagagtcaagtggagctaattctgaaggcctggaatgccagacaaaggaatgtcattcactagctcatacagaaaatgagaaactgtcaagaaaccactgtgctctgttacagagatatcaagatatcgaacaaacaacaaaacaaaacaaaaataacaacaacaaaatagtctgtgtagggcttagagcccatgtactcctatatgtggactaggactctggggctatggcagaagtctgtgtggagggccatgacagcacaaggaagggagttgtcatttggatctggcatggaagttgtcaaaaaaggtttcacagaggacatggatttatgctggaagtgacgggcagtgaagaaatagtttgaactgtggagagtatgataaagataccattttcagaaaatgaactcagtagcagcatccagagggcataatgtggagtgatggctagagtctggagactgaggctaattaaataggagatcattgcagctatccatgcaaaaggagagggtagtggcagtggaaatgaagtcacaggaaagcatgagattttacagtgtacatctcagaggacttgaccttctggcagataaagctgatgagggagaggaggattcagtgatcactctaaggttctgagtttaagtggaaaaatagcaatgtcctgaagaaaaatacgggattttcttcaggagagcttcttcaaggaaaaaggtgtgctcaggtgaggaaactgaagcataaaaagagaaaaaacttgcccaggttggcaacaacttgccaatacagtcagtgagtggcagactctgagttcaaacccagataatctaaatatgaactgtctaatacggcagccaatggccacaagaggctgttgggcacttgaaagggggttagtatgactaaaggactaaatttttagtcttacttaatatttatgaattaaaagactgatagttgatttaataatactatatttggaacaacttgggaagtgaatctatatttctaattgtaaatcttatgagatctaaatgtccaataaagatccagtataattgaggacaattgggcatccaaattaatatgtgatgtaagtaaaaaatacatacaggatttcaaagacaaagtatgaggaaagaatgttaaatatctcattaataattatatatattgtttacaagttaaaataatctgatacagtgagttaaataaaatatatccttgaaataaattttacctatttctttttaccttttaaatgtggtaccagaagacctaaaattacgaagtgtctcataatatttctatactccagcgttggtctatatcctgagaaatacataaatgagaggtcacctgcatgagatgagtgacgtagttaatgggataggctattcctttcctaactctaaatctctattttcggaagatgactgaggagaatgccaacattgtcttaattcagtggcacagtgggccctgaacatgatcacattgttaatctccctactctcttgtccgggtcaacaatttcacagttgtcagaaaatgaacaactcaaattcccctttcttggtatatcttacatttttttatgtctcaaaggagaattatttcattcacatctgtttctgtctttcaatgaccagctctatcttcacgtcagtctcaatctaaagccaattttatcagagaatcccagagacaagcccaaagaggacttcttggatctggcctgagaaaatagtaaccagaaaaccaggggctattcaggatctgggtgtagcctgtatgcctgaatttttttccatgggggttcgttcgtagtctgatagtgaaatccaaatggtgtgtttgagaactgttgacaataatccagatgtttgctctactaagagtcatatgtgtaataaactaaaggtggacaacttcaattgaatggaataaaaggtcagagctaagcacttgtaactctctaggtattgcaggaattcgggtagtatcatttataaagaaaaagaatctaaaattctaccaattttcaggcattcagtgcatatgaagcaatgtgtccccaaagttagatcatccagatgttttatgttaatcagagtaaacatatgattcatcacagattcaacaaagtcaaaggcagaaaattcacatctacttgcaagctaaggggtgtagtgctttttccattttctatgccagctctcttgacatacttagcacttacccatagaataattgaggtcattggatttataataaaatgccattacaagaaatgctaataaaattatatgttctgtacatatagatgtatacatatacatatattttatataattctgtgtgtacatattgcatgtatgtacatacaatacatatatgaagtatttcacccaagagatattcccacttttcgaaatattgtgtatgaagtcttagtacaacagataaactattctactttactcctttttaatttctaggtattattttaacatattggctgtatatcctttgttaacaattctctataaaagaaaacttaagcaaaaattatctataacttttcatttatacattatatttggtatatatcatattaaaatgtacagaatgctaaagtactatatctattgattatagcaatgaggtgctcacaccgataaggcaaataaaaagtaacatctccagccaagagcattggggaagagataaagaaatccattacaaaggacattaaatgcatttgaaacagcttcaataaaatacccaagctcctgggaaaataatgtatctaaagataaaatggttttcagaactactgaaagggaataacacacaaatatccatgtctagccaaacaaaacaactgtacacctattgaacttccagtaagaaatgtttggttaaaaagaaaaagctgttaccttttttttttttaataaacaaacaacataatgaaaaatgatagagcactcaagctcatggctaactttcactgtgtggccttaaacatacttctttccagtgacagagtactagtactattttttgttggtttcttctctgttctcctctacaattccaaaattatgtagttctatccacagccaacaaatctctaacaattatgccaaactttggctgatttctggcaattgtaccacttaaacattcatatttattgctgaggatgtaatagtagggcagatcagtccatcacaatgtctctagcaaacattcgccgctatctactttattcctagcatggaccattccacgttaggccctaattacctgcactttttgaaaagcaaaaacaacaacaataacaacaaaacgctttacttttcctgataggtttgcatttagccattgcagaaacatagaacttaaaagaatacaaaatttaatattgtaatccatcatcttgtattagttaccaccttattacctgcaaagcaaatgattgctataagtcccctcattagtctccttactctagtcttctggtattccaaggtgtgtcttcattgctgccacttcattctttcataagcaaagctatgatcataggactccctctcttcaaaatctttaatagctcaccttagtttagaaaatattcctttgcttaattttcatgaccctaaaaatatagtctcattctccttttcctgttttatctcctatctacatgattgcctctcaagttcaataaattctgaccacactcaattttttttctataaacgttcatgtattttcctacatccacacctttgtgagattgttctcccagcctgaaatgcccttcatcttcaactctgcataactgaatgcaagctgcaagaccaaatgtcattttatctacaaagcattctctgatactcccagttgaaagtaaattctcccttctcagagctgccaaaatattttactcctgctttctccatggtacttaacagaacacatgggacaatatttagagaacagatgactggtgcctgggtcccaactccaggatttacctaacaattttttttttgtttttttgagacagagtcttactctgtctcccagggtggagtgcagtggcacgatctcagctcactgcagccttcgcctcccaggttcaaccaattctcgtgcctcagacacaagagtagctgggattacaggtgcatgccaccacacttggctaatttttatttttggatttttagtagaggttttaccacgttggccaggctggtctcaaactcctggcctcaaatgatctgcccaccttggcctcccagactgctaggattatgggtgtgagtcactcactgcacctggccacatttaactaactttatggtcttcagtaagacctttgaatctgctgggtctcagttttcttatcagttgatgtgatagtcaaaggaaacaatatatgactatctactttgcaaactgcaaagtgctatgtaatgtgagttcattctctgccagccaccctctttttaggcactgcctttcaggagagtacttcatcctctttcatgaccttatttgtaagataatccctgaatagcccagctggtggtaggtgtttggtctaatgtactcctagaggactattaaagtccttatgtagttataatttatttttccctttgaatttttgtctgagcagttcgactttgatttttttgaaggctaagaatttttctctctcagttttgcattcctagctgaaaattttgaaatcagttcctattcagtaaatgtttgctgcacaagtgaatgtatgagtgaattaaatgaatgaatgaatttactgatatcttaatgttgtggacagttatttatgtttagcacttatcatctgtctttagattttaagctccatgagggcaggttctttgtatgatccatgtttgtatccttatagttacatgtgcattatataaaataaatacttgcagaaagctgaatagaaaaaggtagctgagctggatgacatggtaggaggctcctgtgcatagagtttcctgtacaacagtttttttactgacgtgcatgcaatcttaacatctgtttaattcacaaatgaggctaatatttattattgacattgaaatttcttttcaaattgaataaaagaatgtctgtaaacatagatacatcttttgatggtagagtaacacaaacttcagtggagtcatctcttagattatgtggcaagaatctgacatagtcacttttaccgtggagaaccccttgaatcacccaatgtaaggcaaaatgttcacactcaacagttcaccaaaggaactgagatgggaagagtggtagatccacatctcctacctcaatcacacttactagtgaacatagatccattgcacgtggtggcagatggggcatctggaattgctctattggaatttttatatctcccttgctctatctctcccattttacttagcacgtgtatttgaatttgcatcggtaagtccttggatggtgaaactgtactgaattgctcttttacagtatcaggttctcctcagtcacagtacgtgtaaaatttctcaatagcttagaaagattaatgggtctgtgtaaatctcattatcccttaagtaatttaaccccaatgatccccattgtaacccaaatcctagtctgacttggagaatccagtgtggtaagtaaaaatggcaatttacctttaaaaactgccagtgatgtgcaggttaacactcatcttcctactttattttgagatgactttgaacatatactgaagtcagagacaacagcaaccccagggctggaatgtcctgcttccacaggactcatcatatgggattcccagcatctatcagccttagaattcaagtgggtttttccccagagggaagactttgctgacgaaatgaaacatcagggagaagcaaaatctcttgcaaatcaaaatggccaagaactcccttgctagcagagtatgaatcctaccacaagcaacagaaggagaaaattagattgtgttactcttgatgtcatagccactggattactgcacaagaaaaaaaaaaaaaaaaacaagaaaagaaaatggaaacttgaagagaacaaagagctgctggtattcacagtgttcttgctatatacatgatggattgccatggtaacaccagtatcatatgaatcatcttacatcggataccggcatacattgttcaaaaataacagcacaaaccagagcacatattttcagtcagggtagcagggggcaggagggcgatttaggaaaactgtttacctatcataagggtgagttaaataatttattatcgcacaactgactttgagacctccgtacgcgtatgtgtttgtgtatttctaacttttgcctgaattaaaaatcaatgagtaaatgccgtatgcttcagtaattcctcatagactatgacaaactgaagtttatacattttgtgagctggtttattgtgaattctcatacaatcacaagcttggatttcaagaaatcttaggagaattttgaacgttttcatcatgaaaattaggcaaattcattgttttttgattcaaccattgcttagaaagaaacatcagagcagtagaatttgtatgtttatactcgaggtcaattataaaacacagtacgttttagtgtaatttactagtactgcagaaatgtgaatattgctatagcaatgaaaaccaaccaacaaacacaaagacctttggggtggattatatgaaaaccagcaatgtggagatcacttcagaggctcttacagtagttcacatcagttggcaatattaataaagacagagtggaagggactcatataagaacattataggtaaaagaagacttgatgatgagagacagtgttaagataaaggaagatgactaaggtgactcctgtgtttctagtttagataactctgtagtaatcaatccaacaaagaaatagaagaaaaagaccagatggtaagagtaagatgatgagttcaattttggccatgagaacaactgaaataatttccaagcagttagtaggagtctaaaggggaggagtggtcagagcttgagatgtacatttggaagttgctgaaagaacttttttttaaataaagaactcattgcctgctaatggaatgaatttaatgtttctccaaaagggtacacatatatttactgtctgattacttttgtactctcagttgaaaaaaaatgaattttacaagaatttattgaatatctattatgtaccaggacccagacaaagcaccagacacataatggtttaaaacataggcttcaaccttgtttccatggtcctatgattgaacgtgggaggaagcccttaggccaataaaatacataaatatgtaattgcaattgtgacaactgctcaaaaggagacaagaacccagtaagagtacaaaaataggcacctaacatagtctgagcgtttggagaatatttccctggggatgatgaggcctgaggatgagtaacaacatgctctactgagaaccacatgaatgaagcactgaccatcttttcaaattcaatgcacattccatcttgtctgaggagctgattaccttttccttagacacctgtaacatccttctcatcaaatttcttcccttaggggcccttctctccatcaccactaaactattttccttcctagagcaaccttcttagggcaatatgaaacacaacattatgggccaagtccaaagtcctgactattgtttcaaaggctgttagtagattgttcaccttcttttgcctttgaaaggtgccatcctgagcctggaatgctttgtcagcattcgccacttcatttatcatagtttacaaagtacgataaaaggtgataacagaagctttccgtttgtagttcatccatgtaataattttcttcaacttaagagcaaagccatgaaaaactaaaaagaaagttccaaagaattattaagtaatttaatgtctcttattggatatagaaatgggactatcatataaaggtcatcaagattgtgtagtgtcttgtactttgctgacagtaaacattccaagtactctaacaattctcattccactccttttggcaagcgagaggctgcatggttgggtgatggataaatgctgaactgattgcagaacaaaggtcaacatttatgacagtttttattaaactctagcagttgggaatagatttgaaaactgacctttttcttttttaaatctcagttggaaaatattacctattgtttatttcaatgttttaaaaacctcaatgataaataagacacaaagaatatgtttttaaattgcattgccaatgaataaattaataaataatcacttgtttctctccaaaatgaaataaagaattattgggttaattagcatgtaagaaaacagtagtctcccctactcatcttctccagtttatttttgccactctcctctctgcctcattacacttcagacaccttatccttttagtttaacacatcagggcttcattcatgtggttctcagcagagtatgttgttactcatcctcaggcctcatcatccccagggaagcattctccaaacactcagactatgttaggtacttatttttatactctcactgggtccttgtttccttttgagcagttctcacaattgtaatcacatatttatgtattttgtaattgtaatgaaattgtccctgtcaggatttcacactgcttccttctgttggtgtagggattcattcttttccattccaattaatgcagcattccattgccaaattttttctgaaacaactctttccatcatgccactcttagggaggaggaaagatagaaaatatataaattaagatttattatgatagtgcagtaacagacacagaagaaaagaaaaacagctagttaaggaggcacttccatttggaaatagaaaattatgaaaggtcttctaggaaagatctgtggaatgatgggattcatcacaaaatgaggagagaatggaactctaggcaaaaaataggtatagctagtagttatttatacctaaaatacacagtatacatgggtgacaagggcaatttacaaggatgcagagatgtggaagggaatagatcatgatggctgggaatgtaacctttttttttttttttggtagccactgaaaagctagtggtataagcatggaagcgtcatgatggcattttagaaagtggatctgtggatgacagtcaggaagaggatgttgatagaacagagactagttataaagttagcggttttcaggcaagataacatgagggttggacccaagatggtagcagtggagatggcatcaaagggtgaggtgaaggaggaagagtgtacctgcaactggatagtggtagagtggttaggctgagggagaggaagcacttaggaggacttccaggtctgggccataagaaaaaaggacatgggagatggggaaggtccctgggtaatttttgtttcaaatctattgagtttggcagcactacatagagaagagaatggggaactggagatatacattcaagttaaatctgttactgctaataatttttacccagaagtagggagaattagaacaaattctgaggataatttgaagttttgtttaaagtgaaaggaagggcctctcatcaaagaaagtagtccctttgttttcaaagtttttccttcataaaacgtgttctttgctgtattcgtctgttctcatgctgctatgaaaaatatccaatactgggtaatttatatagaaaggatggttaactgactcacagttccacatggctgggaaggtctctggaaacttacaatcatggtggaaagcaaaggggaagaaaggcatcttcttcacagggcagcaggaaggagaaagagtgccaacaggggaaatgccagatgcttataaaaccatcagatttcagagtactcactcactatcacgagagcagcatggggaaactgcccccatgattcaattacctgctactagggtccctcccacagcatgtggagattaagggaactataattaaagatgagatgtgggtggggacacagccaaaccatatcatttgctattaggatgagctggttatgatgaaaacacacaagtagtcacacattcacaatcgatgggtccatgcatttaggcaagagttcagcagagcttcacataccaggccaacaggatggtcgcttaatatatgtaagtgtatgtgtaattttgcctagtattttcaccactacttgaaaagcatatctcaatgtttattacctagtctggagctacaataatgtatttgatcatttattcagctatctttaatgaaatcttagtagtctccctactgaaagaataataagccctgaaaatgcagtaaagccacactaattcagacaaatcagaagacaggatggtttgaattactgaatgctttatattattttaaaagtgtagcagttgtccatttttaaccaggcaagaaagtgttatcttgtgcttaccacaagaaaggtaaaagaaagtattttcatgaatacctaaaaaatatcaatcatctagatataaataaaggtcttaaaaaagctctgaagttctccctgatttaattgattcacataaggttttttccaccttagcactactgacattctgggtcaaataattttttgttgtgagaggctgtcgtgtgtattataggagatttaacatccctattctttacctacttgaaatcatcagctacttcccacttattacaataaaaaaagtccctagacattgccaaatgtcccctgcatgagaggtggagggtagaattgcgtcagttgaaaatcactacacccctcaataataattttaatacctccactcctcttgataaaagctataaaaaagcaaatgttagtctaggccacgtttgaatgattatagagttcaaaataaggtggttgaatttgataaagatttattgtttgcaatgtgtacttgtttttctttggtacagaaaatgggacgtattcttctccgcaatgcctccctcgtgcaggttcatgcccattattgagtccacttttatgaacatgaagccactaattattcaggattcacagtcggattactatctctctccacaatcattattagtaaatcatttcatgagcacaatttgttatgggctgaattgtgtctaccccaaaatttgtatgctgaagccctaaataccagtatctcagaatgagactatatttggagataggaccactaaagaggagattaaaatttaaataagcctttagggtgggccttaatccagtctgactgatgtccttataaaagcaggaaattttgacacatacagagatcccagcgatgcctgcgcacagaggaaaggccatgagataacacagtgagaaggtggccatctgcaagacaaccagagtcctaaggagaagccagacctgctgacaccttgaccttggatttcacagcttttggaattgtgagaaaacaaatttctgctgtttaagccaccaaatctgtagtattttcttatgaccgtcctaacaaattaatacaccatttgagtaaattaatagcttgatgattggtcataaatctaagtgcatgaccttgtgatcgttccacaagaagagagcaggctggtttaccttcactcacacttactgtattccttcctgtcttctggatcttcgtaccctgctttttttctgatcccagcgataatagggagagcaagcctacctaaaggatttagaaaaacagaggccagagagtataccagaacagctgcatcaccagaaagagggagcacagagcaggcagcaagggaaggaccctcaccagcactcccacaagcacccccctaccaccccaccctgccccgacagtaatggtgtcaagccaccaaaatgcagggaagaaggcggctgggtgaggtaaaacatgacacccggctgtgaaaagtagtgctcaagggcacttgctttccattgccttggggtgccagtggctactgtctcaccacattcactgctactagtttttattttccattttgattaaaaaaaaatgtgacttttacattatagcaagacaacagaactggggcttatatgtcataatttttataactgattttatgaaattttgtgcttctatcaaatttcttacattttcttacagttgcagtattgtttccctctaggaaattcccctctgccacctcccacagtgactttttctcctcctttctacaacttgaagctatacacacacacacacacacacacacacacacacacacacacacacacacacattacatatatacaaatatatacttttatgaatacagaagtgaattatttcaggttctcctttgctgacctggtaatgacaaaatgcatgatccccaaccacttaagccagtaatctaaagtcagtgctacatgcagtttctacagggaaacaaggaaagggaatttaattgatccaaatgaataacagaagcaaaaatcttgccaaagactccatactgtggcatacagggaagtgattttatacacacacacacacacacacacacacacacacacacacacacacacgcccctatgccaaaatatgtaccatgcattttctaatcatttatttattaaacaaacatttattatttaacctgttctgggctctatgctggacactggggaagtaacaacaaccaagacgtgatccacacactcaaaaactttacagtccaattgggtgaggatgggttagaagagccagattaaatctgatttttaaatctctgtatgaagggccaggcttgattgctcatgcctgtaatcccagcactttgggaggccaaggcaggagggtcatttgaggccaactgtttgagaagagcctgggcaacacagcaagacccagtctctctaaaaacaaacaaaaaaattagcctggcacagtgacctcaactacttggtaagctgaagtggatcatttgagcccaggagttctaggctgccctgatctatgattgctactgcactccagtctggccaacagacacagaccctgtctcaaaaaaaaaaaaaaaaaagaaattgctatactaaaattgagacataaaagcttcataaaattgaaagaaaattatatttcttacaaaagaaaaagtgggacagtacaatttacagaggctaccaaaaattaaaaggaaaacatttttaaatcgcaaatatagaaagtaattataatcacagatggtagggttgtcattctcgtcaacattgagtttacttaagatttagtatgttaactgctttcttgatgtcttcattgctgctcttgaaataaaaattgagaccaattaaatgatcatgtggtcatgtgtctaatctaggtgattttctaataatttgggaattatttccctgttttccaagaaaaacatgctgttctttcaagaagtcattattttataaggatatacttagctttaaatcgagctatgttttgcacttatgcatttgatttcctacttcattttctctatggattttcgtgaaaagccaattttttttatcttttattttttgtcccgcaatctctgcttctttgggtaggctgaaatatcaactcatagctactcttctttagatgtctttccctccctcccttccatccttccttcctcagatttttttaagtaattagaaaacaattttctttctgccaaaaaccacaaccgagatgatatgaaaataaacataaacatgctactttagataaatcttagtcccagcaagcattctgaaaaagaaccattcaaaacttaggtagattttagtgaatctaagatgatgactcaccattccaagtgtattgttttctcaacagattcaaaagaagttgaggttttaaaatttacaacttaagaaaatgagtaacagaataaaaagacaacctctatgatttggatgttcttccattcattcatccacccctctaactattgttttcattacatgtttgttgtcatatttatcctttcgtagaatgaaagctccagatgtaataagttaactttttatataaaatttatttaattgatttactagccataggtaagtaatgtattctactgaaagaaaagatggatctggtatttttacaaatcccaagacctatacaattaaatactaattattgtaaaatgcctttcaaatatattttcttgtaaaatacactgtgatgcccaattttaagcctaaataggtatatgtctgaaattttctgggtctatgcatatacacaatatacataaaaacataatttgactgacttgtacaaaaagttgattactttaaagcagaaaaattaaggtaatatgaacagggacattagatattcatgtggattttgcaacttgtatggatttgtagtatcgtcccaccaactaaagaagggaatgaggtaactgacagcaactgagccatgttgggtgtcttaggacacacttttctgaatgtattttaaaatagttgcttggtgctgctagccggtcataaagtcaaatagtgatagagctggacagaaaagccttgatactctggagaaaagaataaaatattgtctcacaaaaatcagaaagctttctgaaggtttagaaactttttaatcacttaaacatcccttcatgtttataataaggtgaaatctggcaaaatgcatgctttgtgagtttgtgtagatataattagaaaaagaaaagtagaagagtaagatagtaatgacagtttccaagtaaaatacattgcttttagaattttggattttcattatgtggattcataaaattagggagaaatggaattttcacagagagaatggaacatctttataaatgcttctgaagttcattgttaattgctgaagaaaatgacgttgtataaaaccaaaattgaggggtgacttttggacatattagttaactatatcatcgctattctgatactacataaaaagggtgggtcgggggtagaacacagatctaaaatgacaacttttttataggaaaaatacataaccttgttcttccctccctagcaactacaggaaaacaaatgtttttgtagaattataactcatttattgcattaatgtgttatgatgcattaaggaatgtcacatgtagattatgagttactgggcatctggtataaacagccatatagccatcaataaatatatccattatttggctaaatcctctttcaaattctcatcatgggtgattttgatggcaatacaagcactgacaatctctcaaattcttaaaatctacagaccttgaaaccagatcagcttttgctaaatagctaaactatttccagctttcctctctggttaatttttttcccaactatccagtgtgttgaataaaaactaacttctcaccctgaccctcccatttcagcagacatccaaagcagttaccaaagggcaacaaaacacattttcactgacaaacaactagaggaaaggaaagcagttaccgtctcctctgtggcttaatatcaattggcatgttgatcgcgtatggtgatccatgaacataagcgcttcggaatctagccaccttccccagagtcaggtactcacagctgcttggcaaactcattatatccaaaaggcaagaagtaaaagcaaatctgagtagtcagaccagcattcctgggaaggctggaaagaacatgtcagataatagatttcagacatatgctgctcactggttgcccggtgcttctttgcttcaaaagtaaacgcgtgtttctcggaggctaaatgtactaccttgttttctgttcattctgttcatggatacaagaagctttttgcttatttctaaccaggctcatgctctgaccaattattggctgagtagataaagcagaaattctgtagctccacaaaagcctatttccactcagaccaaatctctgagtaggcagcaaggttttatccatttttgtctaacgttgaaaagaacatcaacctaatgtaatagtagtttggtaatcagagttatttacctgtaaacaaagcatgcatatctgataggaaggaaataattatttgctatattttcgaagagggaatattgttcactaaactgttatagatacttagaaaatgagatgggtatatggaaatgttatgggcggttttccaattctctggtaaaaaaattgtgggttcttattcataaattactattcatgatagaactgaacttagcctctcaggaacataaaaacggtaagcaatgtctttattcactaaaacgttgatgatgatacacattttttttcctcgtttaaaacactctttgagaaatgcaccttctacctgcactttgaacgaagatctatggaatcattgatagtgaatgttactaattctttgtaagctgttttttcataacagtgaaaaataagttggagaaattagaaaggatattaaataattctactgaaggcagcagggtcttagagaaatgctgtatctttatcccacagtttttctagcctttatgccatttgctagagttatagcaacaaaaccacaagtgttcagggtaatgagagtagcaggtgttcagagtattctgtgagataatttttattttgaaaaattatttcttatccaggatttgaatagacacgccagtttatttaagcatcctgggacctgggtaaacatacagtgtgctgaaaaagggctacattttattcttcagtagccaaattcagacactgtttgggtttaaacagcagacactgttaaaatccagaaattttaagtttgaaagagtagataattttccttttttttaaatcttgtattttaggtttgggggtagatgtgaaggtttgttacataggtaaacttgtgccatgggggtttgttgtacagattatttcatcatccagatattaaacccagtacccaatagttaccttttctgcttctctccctcctcccaccttcaccctcaagtagaccccagggtctgtgtccttccttgtgttcatgagttctcatcatttatctcccacttgtaagtgagatcatgtggcatttggttttctgttcttgtgttagtttgctaaggataatagcctccagttccatccatgtccctgcaaaagacacgctctcattcttttttatggctgcatagtatttaccatttctattcaataattttctttcttatattttaggtttcaattacaaaattatacatgctatttttttaacatgccaaatgacacagaaatgtgaagataaaaaagattgctgtcttttcccttccttggtaggattaatgggagggaaaagacagcaaactttttatttatacaaatataaatataccacacacaatacacaaaccctcacacatgtatagggattctccttcctttttgaataaagtgggctcatactatgtataatcctttattaatattaagtcaatcatgaaaaaattatttttgtgaatgcacagagacctagtgagttcttttcaatagttatataagattccatggcataaatgtaccattatttattcaatgagtcctttattgacggacatataattttggactcatataaacaataaacacatttgctaatatattcttactgattggtgcttgtatttctgaaaatggattgctagcttacaaattgtgaacatttttccctttaataggctatggcagttcatattcccacagtcatgttggaagatgtcaactcctccacactcctgccaagactatccattgttattcaagtttatttctttatagtatgaaaataaggtaggcagctctctgaaatatccagtgattgcatacagttccttgatgaaataaaactactattaaggtgtcgcaaaagtaagaacagcctttctgaactgaaatatatattgggacataaataaacagcttagaaaggctttgcacaggtgtacaaaaggcagaagtctggagtctcatcagaatgagagaacactcaatgcaaagttagtaaatagtaaataatttttattaatttgcataattatgaagagaataaatatagcaaaaattctgttatgtttttactcttcagtatatttttcttaatgggaataatatttcataatttgggagaaacatcactaattttacaatatggatgtaatgcctaatgactgccaactaattgtgatgtatgactggggtgtaatttgtagattttgcataaagaggctctttggacatactccttcatttgagagtctgaagaacaaaagctcaatgaagcattttcacatgccagctaatttaggagattgcccagtagaagagaataagatttgcttcacataagaatttcctaggaggggtaacaatcagaaattgaagaataagatataaacctctatggtagagacctatgtgtcctatgatgggtaaaattccagagttttcttagcaggggcatttttgcttgtacccaggtaattatttaccaaaagcctggcaggggctcctggggattacctgtacttaaatttggatgagagaggattactgttaaactccagcctgccaagaattcagagtctgtgagaactctggccaactagcaggaggtggcccttaagggaagaaaatggaatctttctatcgtcaacaattccctttctctggggctggagagaggtagttggggacttgatctttaggaaaataagaacacattggagagtttaatttcatctaaagattagagctaccatccataccaggcctacctccaaataaggctcaaatcttattaaggaatggccatgattacccatctatgttttgtttgtttttgcatactgggatttctatggaagacaggtatagagtctagcaaaaatctcacttatcatccccatgattctatgctcttgagaacattaaaagaaaaggagaactcacatgaaagcatctggaacatcaattttcatcactatgctagacgttgcaacgttaataatgccctgcacagcaattaaaagtaattgccagcaagcagcaatttcaatccataggacttttcttctaataactggaataatacatattaattaaggttctttcagcctttaactctaccctggcctacgtttagcaattttaaatgctggaggaacttctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgaggttatcatctgttaatgaccacatcagagcataagaattgactgaacgatttcccctggcttatggcttggaagactccttccctccccaaccctcgtgttttctgctcatacctggactggagacccacaaaaattggggtttgcatctgctctcaattcttggagttgttcttgattttgatctctacacttactggtcaatgcatccaatgaattggctttaaatattctttatgtgctgaaaaactcccacctctttattcagagttcacatttttctgctgttaccatcagctgcacatgagaaaattccacttgtaagttccatagctagttcatttgagcatttataatgtaattcaaatcaactgtgttcctcccctcctccactccctctccccacatttcttcttatattccctagtactggccaccattcagccaataaccagacaataactgctaatcaggtcacaaaccctagagacatgaatactattgatagtaacaataatattaatagtcaatagataatagctaacactgatcagatgcattcaatgtgctaggcactgtggttggcaggttgactaattctcataaaatatgagttgggccctattattatactcatttttcagatgagaaaaacaagacactgagggataagatatatacccaaggtcacatagagtgttaagtggtggagtcagagttaggaaccaattcatctgattccagagaccagactatatcttctacctctctacacattctttaatctctctcaattatctttccccctatgttttgcctagagttaatatttccattttttcctcctcaaatctatccttcacttacctaccaagattatcttaaaatggaaatcttagcaaactcatgcaaggacatgaacatgtgagtcctttgcttgaaattatccaatagttccacattatttagtaatgaagttcaaaatttaaattccaatactcagcacagagatgctctattgttttgctctcccttcctctcctgtatcagccacaaataacacttggtagtgtctttcctgtacacagtctgttcttctggcccactggggcttcccaaatgataggtactctggcaagaacatttttctctttcttctctggctggctaattccttttaagcgtaatctcttccaaaaaacattcttcattcctcagttttacttagaagcctctcatctattttgccaactcacatgactttaccacactgtttcatagctgttcatgcatttacaactcttccccatgacttttcttgagggcaggaattctgccttctttgaccttgtaatccaggaacctaaaacaacatttgcttattgaacaagatagctgaaattgtaaggtcctgatgctccaaagaactgtccaagtctttcctgaactcccttctcagttactttcccaagaataataattataaatatttgacaactgaaatacattggaagtagtggagctattcatcatatgcaatcaaacagaaatactttgcaaagagtgcccaaaggaacatgagagcaacatcttttctcaggaagcaagggatgaatgtggattttaattagaggtgttggagatgtgcctgcctgggctatcagtttcagttcagtaaagaaaagttatccaaatacttgaataagctcagtataatgccattatttaatcaagctctgtgttttgagagtgtactggcaaattcaaaattaattaaacactcttctattaagggtcagctacttatgttcatacattagcttttcttgttaatctactcttaaacactgcatatattacactttgcagtcttacacacaatggctacagtcagaaggaaataacagtgcaaatgaagatttaactatcatgaaggtcatcacagtgtcttacaaaataataaaaagatgtaaatatctttaatgcccaactacttaaaataaggaatagccaatcaatgtgaatatcatgaatccattaaaataatgatattgaaaaacttccttggtatttatctaaatgagttgaaagcttacatccaaacaaaagtcttcatcaactgaaacaaacatactattctagtaaaagatgttaacattcagatggataagtagtttctcagaaattttattagcatgacctaatctctcagattgtaaaaactgttgagactgaattgtatgtcttcttcgaagttaaagaacataaaatcccataaatcagctagtcagcaggcccacttaattttataacaaggataacttttgatcaaatcaatcaactgttttgtttttataagcaggtaagtttgagatgaatgaagcataaggtctcatctttttaaaaatgctttattctccagctaatggagcctctttgagagcggtttctctcaaaatattattttactattaactgtcattgcctccaaaacccaacagaaacccgttggtcacataaaggcaagtttattaaacctacttaagtaaaggagaaaaccacatggacggataccttagaagaggaagttagtgaatcaggtatctaagtaagttttgtttgttctgctttgttaaatacaaggacagtaaattaggcctggtccaagtgccatttaacaggtaccggaaattatgctggtttcaattctcccatccaacaaaagcccttagctactggtaatcttatctcaacaaacctattatatatccaaagtttaggctgagctaaagcagcaacaaaaccaactgaataaaatgatgctcattcattgaaatttcaggtaggcccacacaattcatatttccaagctctttataagctgtttgaatgttaaatggagtggcattttgctttagaatgtatagaaatggaaacaaatgagtttaatatacacaacaggctttgacaacatgacttcttcgacagatgtcctatactacttcccacactttcatccttaaaaagcatagtctacttgccaagatacaaacggttgccaatattcagctgcaaaagaatttccaacagtaggaaccagtggaaagaattaaaacactttaaacttatttccaaataaccaaatgtatcattataaagttgtaagataaaaaataatcatgctgcaagttcttactctgtcaactagctagttcagcaaagaggaggggtctttggcaaacaaggctctatatttggttgccagatgacttttttaaatctatcaattcatttttctaccccaaccagccagccagcattaattgagcatgtactatgtatacacacaagaagtagatggcataactcctatctaggaaaaaaaaaaagcatacaattcatttgatgtgcaattcatgcatcaagacaggactgatttcaattgacaatattatgagatagaaataaaagtggtacagcatcagcgtattagtctgttctcatgctgctatgaagaaatgcctgagactgggtaatttataaagaaaagaggtttaattgactcacagttttgcatggctggggaagcctcaggaaacttacaatcatggcagaaggcacctcttcacagggtggcaggagagagaatgagtgccagcaggggaaacactagaagcttataaaaccagcagatctcatgagaaactcactatcacgacagctgcatgggggaaactgctcctatgattcagttacctcccaccgggtccctcccacaacacatggggattgttggctgaactataaaattggaactataggaattatagaaatgaactataattcaatgggaactaggattcaagatgagatatgggtgggtacacagccaaatcatatcagtaattctgttggaaaccttgtggctggctaacatcacatcaagcttaattcagcttgcaccatcatttactgctttttattgtatttttaatgttctctgtcctaaagtgaattctgaaccacaagataggaagatatatgacttgtctttaaattcaccacagtgccctgtacactgttctatatatattgctacagtgcctagtatgtgtctctgaaaatagtagatgcaaggtaaatatttattactaaaaagatgtgcaagcatattttacgtttgtcgagtttttaaactaggggactttactcttcagtttgtctgaatagtatacagctattgccctggaatgatgattaaatagtgcctccttttacttttgcaatattattgcttggattataaattatctggttatcttctggctctggaactgcacacttacaatgttgcctcaaccacttctgaatgcatctcagaggcaaagactgaggcttactcattattgcttctccaaatctatttctgtactccacctcttctagggtctgcatcaatgatccaaggaaaaaaaaacaaataatagagaaactcataataaactaaatcagattgaatacatctagaaaagaaacaaaagtgatccacatggagataaattaggcaggcaaatattgacctgaatgttctcctaaatgtaaatgatacaaaagttgtctccttgtatttaaatccatacagcagtgaaatatcattgtcattgtcaaatatctctagatccctgagtttattcagcataatttcaaagttatttgcttgcagggagagatcaagaatgaatatgttggggctgggtgcagtggctcacatctgtaatcccagcactttgggaagccgacgtgggtggattacttgaggtcaggaattcgagaccagcttgaccaccatggtgaaacctcgtctctaccaaaaatacaaaaattagctgtgcatggtggcacacacctgtaatcccagctacctcggaggctgaggcaggagaattgcttgaaccctgggagccagaggttgcagtgagtgaagatcgtgccactgcactccaacctgggtgacagagcaagactctgtcaaaaaaaaaaaaaaaaaaaagaatggggatgttggtttcagagccaagtgactttgggtcacaatgctgcgctgccataaatggcttcggtaaccctggggaagaaataacacctttctggtatcagtttccatgacacttaggccttattcactcattcaacaaatatttatcaagttactattctaggctctgggtacccagtagcaaatagaacacatgcaaatattcctgcctttatggagctgacattccagtagagataggtaaatggacatagtaagtaaaatatataagagaaatgataactgatacagaggaaaatacagcagggaaggagcccaaggagttcagggatggggtgagaagagggactgctttgctgccatggagcccttggggttgggatataggggacataggatgactgagaggctggtcttcctgtgatgactgactcaaaaagggataaaagggtagaaaacactctgtagaggtaagcagctaggtgcaggcatgggcagtggttggtacactgcttgttaaataaattaggaagtgagtgaatgaatgaataccttcaatagatattagctgccatcctaagatgtagcaaatctgtcacctgagaaaataatccaatgaagctaacgtcacctagagcttaaccattaagattctgtaagtttctaaactgaaacatctctcttaattaatgaaagagattcattttttcggtcatgattcattcctttcttgatagactattgctacgttatcactagataatttaatatatgcaattgtgatttagcagtcacttaaagttttcatattaaatttgatgaattaatcccaaatctaggtaacatagaatgtaaaggcaataatggaaaacataaagtggtgacaaattaagagtaaattagttacaagtagcctaagaccttactaactaccttaattatttagcaacagaaaccggtgctaacattttaaacacctttacttattcccatccaaaaaataatcagttacaaatgcatagaatagtcactactgataacaattacaactaatatctattgaacatttacttggtgccatcaagcactattctaagaatttttcatgtaacactggtcgcggtggctcacacctataatcccagcacttggggaggctgaggcgggcagatcatctgaggttgggagttcaagaccatcctgaccaacatggggaaaccccatctctactgaaaatacaaaattagctgtgcatagtggtgtatgcctctaatgccagctattcaggaggctgaggcaggagaattgcttgaacctgggaggcggaggttgtggtgagccgaggttgcaccactgcactccagcctgggcaacaaatgcgaaactccatcttgaaaaaaaaaattttcatgtaacagatcctcatagttaaaaggttcattagaagccatgggaaattcagtcttcccctaatgcatgaacagccttgaaggaaaaacaaatatctggttctggcatgaggagccctgcttcatggtatgcttatctttgagcagatttaaatgcttatctttgagcagatttaaatatcgaaaatttaaatattgaaaagtttgaagatttaaatattgaaaagttctttgtatcaaactaaatttcacctttctaaaagtgctattctttgatcatagtcattcaaaaacaagcctgagtcttatttatttatttagaagcagggtctcactctgtcacccaggcagaagtgcagtagtgtgatctcggctcattgcagcctccacagcctgggctccagcaatcctcccagctcagcctcctgagtagctggaattacaggtatgggccactgcacaagctaattttttaaaaatttttaggagagacagtgattcaccatgttgcccaggctggtcctgaactcctggactccagcgatacacctgccttggcctcccaaagtgctgcgattacaggcgtgagccactgcacctggccctgaatctttttaatatgaaaacctcagattatctaaacaggagtttttattctctcccttttccaggccacatcagtctcggttcttttggcagttccgaagacatcatgattcccagatgcttcaccatcctggcaacacccttctggactgattgctccttgttgatttcctcttaacctgtggtatctgaaatgaatcccacaccccaggtgtgatatgacgattgcagggcacagaatgtcagtcagcttaatttctctgctgtacatctatgaataaggcttaagacagaattcctcacatattcttcatttacatgccatcacccttgggcctctaccatccaattctaattaactgtgcacttgaaattgcagtcatttttattagcaagcttaaataactattgactctgactttgcattccagtgtatttactatctctttatgtttctgtatatttgtttgattggatgaacggtcttccatccaggcaaatatttagtctttactcagtattctttatctatgttgttcaactaggaaaaaacacacttaatagtatttttatccaattcacacatccattatagctaccacaagatacttttgcaaatattttaccaaaataaaaaatacactatttatacagcatattcctgagttaccagacaagtgatagtgagattatggctagttttgtgtaaagtgggaaatgcaaatgataacaatgggctttgggaccattttttattaatgaaagataaggctttgtgagagagaagtaaaagaaattataggcagtatcttggaagatcattcagatattaaattgactttgtaatatagaaaaccaatttagttgagaccaaggcagtgtaacttgtggggaacatcaaatagtgaacacagactggggaatgaaaatgtggtttgacaacatccaagttttcataatagataaactagggacaaatcagcaagttaacagcttaatacaaactcaaggaggtcaagttgcaacatcagggtctttgagctcattttcccttgaaagagattaaatgagagctcatactcactgtgaagagtgacacccagagaaaattcacaggagcacataatgtgagtgaacaaatatttaaataagttggtacctttttgcctggaggtaagaagacagcggtgatttaacaacatgttttggagactttctgcaaaaattaatgatgcctattacattctaccttctcttaggaaatataaaagtatgtgattttaaagaaaagcagagggaataggtgcagcaacctaggaaggttacctggcagtagagggtcattaagcactgggttcttgttggggaaattttcaaaatatcttcaaggacccatttgtccacacccaattgccatagaagttcacagaggaaaagcccaagctaagagtatatcatttatatcaccgaattagttgttggtagaagtcattggcccataccatcttgctacgaaaagcaactctttttaaccttttcccaccactatacaacattaaaaagtcaatcacttaattctaatttattttgaccttagaaaaacccagcagagtgggaaatttcaacagatacaagagaaaaataaaatggcccctgtcctcacaaagcttacaatactttttagaagaaatgacttaaacacaataaattctcagtcaatgtgagatagtacctactgtgtggctcaaacataaaatgttataagagttcagggaatgtaaaatcaatgctcgcatgaagtaaactaattcagtttacacaacgactcttttgctaatctcattccaggcagacgacagaatgcctgaaaaaaaattgattgcgtagtttctagaatatgaatttgacaatctgatcatttttcttatgaatagacacaaagaaatagataaagacagcaaatgttatactcaaaggcttacataatgttaccttcaaagatggcatatgtttgcactttattttttatttccataaaagaaatggcagaattcctgaacagcatgttccatttagaaataaaagcatgtactctctcgttctcctttccaatactggaaaatcaatagtgtgattatatggagacagaaaaggccgggtcatctgaactaacaatatcattgctattattaataataagagtgcagtatctagaatttatttaacgtgattattttgccatcatgaacaatgttaatccccacaagaacagatggtacaaccatattttaaattattcaatgaagtgtgttttttaaatcacaaatgtgtatgagcagagtggatgcatttgaaatttaacccttgcttatatttttgctgtcatacagtctaagagataaccagtcaatggagaagtggccttttctctctcttgaccttttggatacaatgatgatagaaaataggtaatgaggggaaaaaaaatcacagaatttcatatggaaatttttttaaagagagaaaacaagagaaataaatgacttgtttagggtggtacaagagggtaacactaaggtggcagtctcttctcagtgagctagtaaacattaaactattgagatcaaacaggaaggtatctaagcccactctccagtgcttttctgcaacgacacgctcttcacagggaactataattttagcgagctccatgaatacttagaagatcatgatagtcagggtacttgtcttttttgctttgggctattcatacttacagcatagtgagaaaacaagagaaagcttctctggggtttttctaaagatatcacatgcaaaccctgggcttggctacagaccttgggccttgctcatagatatggaaaaattggaatatgacattaatgccgaaagataacaaaggaaaatgctatgacctgaaaggtgtaggatagagtgggtaaattggtcctccttggatcaaatatggacagcaggcctgagtttgtccaacatatttttaattttgtttttccttttgatccaacatttaaagcacacagaaaatgtcacattaaagttgagatttgggcttcttttgaatgtttaggaggtttaaaaccttcagttcccagtcgggcgcggtggctcacgcctgtaatctcagcactttgggaggccgaggcgggcggatcacgaggtcaggagaacgagaccatcctggctaacacggtgaaaccccgtctctactaaaaacacaaaaaattagccgggcgtgatgtcaggtgcctgtagtcccagctactccggaggctgaggcaggagaatggcatgaacctgggaggcggagcttgcagtgagccgagatcgccccactgcactccagcctgggtgacagcgagagtccgcctcaaaaacaaacaaacaaacaaacaaaaatacctagagttcccctccctacatattgccagctatctccttcagatggggcaagcattctccagtttgacaatccccattcaagttctgtaactcagatacatttcttcctggttctgtaagtatttaatctgaaggcctttcaagtaaaactgagttaggaaaaagtaaatctgctaccacctggtcaaactcttaaccaaaacatctctaaaaccaagcacttttagagaatgtcctgtccttcccaccacaatttacttacctaccaggaactattttcaactctttacgaagcactaaacctgaattccaatcgatctggaattacctcatttgttatgtatcaaaaattctctaatatattatgaaaaaacctaggttttatttaccaatgtatgcctatatttaaatcaagataaataagtcaattttagtgaaggaagaatcattcagtaccacatttttcatgcattcaagaaacatatccagtttatgctggcaaatactcccccaatggtactgacatatattgttcatctggcttatggtgacatatctgaagtttctgataattctgttcccaacatttatatggtattaaattgaccctatgcaggctgaactgcctgaaaatacagattctgttgcaatttgtctgtagttgtaaagaaagtcgattatttaatcagaatttaagaagacttctacatgaccttgataataccaatgatttagtcaaaattatttgacataatacagacaaaaataacacagttaacagaatgtagcctttttgagtagtttccggcaacttgtaagcatagtttaaatccagtcttaatcaaatgcttcagattagcagaaattcatagtctgggaattatgtcatgttgcttatatagaatttatttatttatttatttacctacctatatggggaaacaggatataattcacttttgaaaaatatattactgccatctgcctcacaatataatttctttttgatggctagaaatactaaagaagaagaaaaagcatgatacacatcagtgatttttaaagcagtcttttgtctgccccatggtcatacatacctgagtgttgagtagctataaatgaattcccatggttggtttaaagatagagtccccagtaactaaataactgagctaatataatttgccagttttggcttctgatataacagaggcaattgtttaagaaagcgtaatgtgaaaatgttttaattaaaaatagctgcaaagacaatttaatttggtcattgtgctatatgtatacacatatattatataacatatacaatcttttatgtataaaaatatatagacaaatatcaatggatcattttatttatattcattataagtacttaagtaacttgataattttaacacttataagtgttacctatatagtaacaagagtgattcttcaaacatgtataccatatgcaaattcaaaccaatgtttcctaaatatttatttcaatgaaaaaaatatagtgaattctattaggattaaagacatttttgacattctctttgggaattatcattacagggcacttccagtgtgcataagaaaactgcctcttaattttatagttacttctcattttgactcaaaatagcattcgctaactggatcatcaactttaatcatcaggcttaatgccaaaggacttttggcagcttcatagaactagataaaccttcaacagatggagatttgtcatcaatgaatttcaaaaacatgtagcaaaggctcttttgaaggtaagttcaagaggggaatccctgaaatgtttgaacaatggcaatatccttgagatattactagtacggagctccccacaggcatcattgagaaaggctcaaactccattacattaatgggtaagttctgctgtgttctagccagtctttctgcctcttttctcttcggttcatgtgtgtttttaaaatagtaaaacaaaatgtgtgtaatttccagagtcaatgtcagaggttcacgctctgtttagactttttggttgtgcagattttaacataattgctaaaatgtctcatcagaaataatgaaaaatagttatcgctttcacattcctttagtgcacattcctttgcagcatccatgcaggtgcattagagatttgatttttggggaacctaatgagggtcagactggtcagcctgtgggtgctacatctgcagtttactaccccaatcctctggtgctgtgagatgggtcagacttggcagtggccaagattgatgttatgtagactttcgagttcatgaagcaaaatccaagaatcttaccttcactcaacatggctacaactgaatctatcagctgttcttccctgatttacctccctgtactttctcatctggtaaccttctagttattcttcaagattccactgtgatttctactccatgtgcaagattgcttgctggaatggagaaaaggtgagtgtagggaaggtaaagaaaacactccctcatttagctattaattcattaattatcaataaacactttttagggtgtccattgtgcaccaatcacacacttgggtctcatggatgaatatcacattgctcctgccctccaagggcccaccactgagggaaggagagagacaagtaaaccaagcacaatacagtgtacaaattatcacaggatagatgtatgggcttttaaacacagctaagaagaaaaggaatagtaattcatcggaatgaggaagtaacattagatatagctttgggacagtgcacagaatgtatgtaaaaaactttaagtacttttgtaattaatttgaaagaatctgattgtgttattgtaaaaatgtttaacagctttccaagcccattattgtgccaggattatacttcctgccccactgacaccaagctgatcttgcaacccactttggccaatggcatgtgcatggaagagatctgtggcatttctaaacagaagttttaaaaaatcactgtgtgcccctgccatctcccaatttcttctgccttctcaggatgggcagctcatttagggttggttccagaacaaaacgaacatatcaatatcatccagccaagaacaagtaatgagagcaagaaataagactgtggctgtagcaactgaaatatcagggtggtttgtaacctcagcctaattagtcaaaataagctgaaacaaagaagctcatcgtagtcaggggcagattttaagaagacgtgtatttctttattcaaagcaggctgacacacggatgttgagctggtaaaggctaaagtattttgtaaaataaaatggtaccttctctaacctttcataaggtttttgacaataagctttaagattctctggctgccaagtgaggtgggactctccatgccatgccccaatattccctcaaccacactgatgaggagattttgcctatttcccttctccatgttcatttccctggctctggggtctgttctcacacctgtctcttcccattgttactcccttagtaagcagtgcttgagagtgcaggttgagctggcaatgaagtcttttgaattttcaatacatctgggtattacttcaagtatcattataacaataatacactaaagtttgcaacagaaataattgcagccacaattcaaagaacactcttttgcagtggtaagtctcaaatgtgttttgttttgtttctgtatcaatatggagagtaaaaaggaagaatgtagaataatgtagtagaatgttgtagttttggaatatccctttttggcgggggaggtggaaggacatccaggctagagtgcagtggcacaatcgctgcaaccttgacttcaggactcacacgatcctcccatttcagcctcctgagtagctgatactacaggtgtatgccaccatgcccagctaatatttttttaaattttgtagagatggggtcttgctaagttgcctaggctagtcttgaacttctgggctcaagtgatcctcccgccttggcctcccaaagcactgggattacaggagtgagccaccattcccagcagctagggaatatcaacaacaacaaaaaactgctccccaggtgagtctgttataattttctgcctcccatccacatgttgtcttctgaccccaaatccagattgaaaggccctgcttcacatatgtgagagattacaaatcaaagaacaatgcttttgatgcataaaagcataaaaataccattagcagtcctgtgttccactgtgaacagcattaatgcccttcacccagagtgttccagcatcttcctgagttacctgagatcatcctgctttgtacatgttgctgggtttatgcctgtcttcttgtgaagttagtaatagtcccccttttactacttgagacagcaaattatttgatcactccaaatctaggttcattaccaagaaatgttgaggcccaggaaaagtttgtgctggaaattttccacagtgctccctcacattaagcagatatagtttttctcccaaatcgattccttctaacgtcgttataaaactttaaaaatgctctacccagtaaaaccttgaacccattgtgcaaaagtattccttatttaaccttggagcctttatatgaatttttcatattaaactcccttacttaactccctcttcttacctgccacaaatatctttactcatagcattcatggcttccttcataggacagagaaatgtatcaaatgattttagtttaggaaccaaaagaacaacactgttttcagcacgttaaaaatgcctatattctaacattggttaaattatgtaggttttctcagtctgaagtcttatgttggtgggggatatggcagggtgtgtaattagttaagagtggcaggaaaaaaaaaaccacctactttatggtccacccccattcccaatctccactacaaaacagggaggaagctccacagaactatgatttccttgaatcacttcaatttgtacaacactatatgcagaacttttatgaagcaaagatttgaactattaataatagctaacattgcagctacccaagggcacacatatctctaccaaatggaagctgactagcagaattcagtttctatgtgtttgccatttagcagttatttttccaccacttgggttataatgcaccatactgacatccagagcaatgccatttctgccttattttaagataaaatgctaaaccaaaagctctattctgactatgtaaatgatcgccttgtgccaactgattagcatttttaaggcaaaaaatttcaaagagatagcatgttacacacattacacttagcgtgaaagcaaataatatattggctaatgtttttgtagcaccacagtctttctctgacctatgaactataagtaagatggaatgtgttatttaagattttttctctaaaataagtttcaattcataacaataagttcacaactcaatcactctgtcagtattggctggtaacaaaaggaacctggtgggtcagcagtttagcactgagtacactgtgtccatctagtggccaaaaggtgactgagtgctctaaagaggtttcacagcataaagaataaaaggcaaggtggctggttttttaaaaacaactttaacccaaacactgtgcacacatttttaaattctaacaactattaatcaaatcactttcattttctgcaaagactacagcaaacgtccttcttctttcttctcaaatacttgagtccccacttcccacacacagcagatgatattcctactcaaagagaaaatagtaaccatcaaaaaggaacattctccatgtccagccatcaaaatgacaaacacatctactcccacagtcatcatttccattttccctcctgttaccaactcgggcaaatccttccacctgtgctttggttctttgtccttctcacattctctgatacgcagcttcatccatttttcccttactcttttcctcctctttaccaaatcttttccataagcacttatttttcactgtacaaaataagatccctctcaattcctacttccctatccagatacttcttacctcctcctcactctgagcataatttcttgaaataattttgtttatattcactatcttgattctccctttgtacttacacctcaacccacttcaatctggtttatgctcctactatatggaaatttctcccattgggtcaccaactgacttgtgtttcactaaaccaatgaacatttctgaagctattggccactccctcctttctgaaacactcctttcctttggcttccatagcacctaactttcttggttttcttcttaagtctctgttcatgtctttcatttcagctttgtcttcaaatattggcagttcttaggcttgagacaggactctcttgttctcctaatcttgcaccccctttagttgattttattgactcaaataacttctatgaccatctgtagatggatagctccccatcaatttctttggtctgcatctgcctcctgagctccagacacatacagcgcacctgactcctggacagctctccctggggataaccgacatatacctgaagttcaaccatggaactcttccttctccaatattccttctcactgtgattagaacctcagctacccagttgctctgttttgaatcctgaaaataatcctaaccctttcctcaatcttgtttcacagagtctctcaattaccaagacatgcagactccacctcctacctctatctctcagataagctcactttcctccattgcctctgctatcattctgctccataccaacaccgctgtctgtaataatcttctaaatggttccctgcttgcatcccaagtaattctatacaatgcagccactgactttaaaaaacacaaatgcccatgtcattccactgtaatgtcttccaatgagcttgacagccctcaaacattcttgaccttctttctcttgtatgtcacattccagttgtctacatctttagtttctaaaatatgcctcattttccttcccattgcacatgatctagaaaaaccttgtccaatccatgaggcccaggacggccttgaatgtggcccaacacaaactggtaaactttcttaaaacattgagattttttgtttgtgattcttttttttagttcatcagctattgttagtgtattttctgtgtagcccaagacaattcttccattgtggcccagggaagacagaagattggacacttctgatctagaatattcttcccctctccattgatacatttatattcacacttgaggttttagcctaaattttactttctcagtaaaccttcattgactacttctaacataagatccgcctctgccactcctatcaaggctttatcaaacagcttccgactaagctaaaagaaacactctatgcattttaaaagtagtgtatttaatagatctgattcattgcactggtgatggaagagttgaaatgccaaataggggactgtgaggcaacttaggggttagaaacaacaggaagcaactaccgcccctggactagagctaaaaaggagggctgatgtatgcaaggattagggtcacctagctaagggtgaagccatggaggagacacagctactgcctgaggtgctgcctcaggtagagagagtaaaacactctggcttctctctttctgcctctccccaaatgtccaccagtgcctccaatgtgctacatctatctaacaaaggacatggaagtcttgagaccacagccttcagagcgtagcctccaactataaagggcagagaaagggcaatatgtggtctgagaataaataggtaaaaggccaacacaaaaacattcatcacatttaatgtctttactcctaaagattttcttccagtccaaactgtaagaatcatgaggacaaggactatggcttaacagattttctcttttaaatagcaaagtgactgaaacaggcatatctcattttattgtgctttgttttgttgtgctttgcagagatggctttttttttttttttaacaaaatggtttgtggcaaccttgtgtagagcaagtctatgggtaccatttttctaacagcatgtgctcacttcatgtctctgtatcacattttgataattcttgcaatatttcaaacttttaaaattattttaatacctattatggtgatctgtaattgctgattgttgatgttactattgtaattgtttaggagtaccataagccatgcctatataagatggcaaactcaattaatgggtgttctgactgctccaccaactggccattccctatctctctctttctcctcagtcctccccatccctgagacacagcaatattgagattaggtcaattaatacaatgacctctaagtgttcaagtgaggtgaagagcagcacatctcttactttaaataaaaagctagaaaagattaagcttgcttagtaaggcatgtcaaaagtcaagacagacagaaagctaggcctcttgtaccaaacagccaagttgtgaatgcaaaagtaatattcttgaaggaaataaaaagtgctactccagtgaatacaaatgataagaaattgaaacagccttgttgctgaagtggagaaagtttgagtagtctggatagaagatcaaaccagccacaacattcccttaagaaaagcctaattcagaacaaggccttaactctcttcaattctataaagattgatagagatgaggaagctgcagaagaaaaggttgaagccagcagagactgtctcatgaggtttaaggaaaatgccatctccacaacacaaaaatgcaaagtgaagcagcaagtgctgatatcaaagctataggaagttatccagaagatcattgaaactacattaaacaacaaatttcaaatgtagacaaaacaaacttttattggaagaagatgccatttagcactttcacaactagaaagaataagtcaatgtttggcttcaaagattcaaaagacaggctgatcctcttgttaggggctaatgcagctgagggctttaagttgaagccaatgttcatttaccagtctaataatcctggggccattcagaattacaccaaatctattctgcctgtgcttgtgcctgaaacagcaaagcctagatggcagcacatctgttgacagcatgatttactagatattttaagcacactgttgagaactactgctcttatataaagatttttaaaaatatattactgctcattgacagtgcacctggtcatccaagagttctgatggatacatgatatggtttggctgtgtcgccacccaaatctcatcttgattgtaactcccacaattcccacatgtcgtgggagaaacctggtaggaggtgattgaattatgggggacaggtctttcctgcagcattctcatgatagtaaatgagtcttacaaaatctgatggttttaaaaacagaagtttccctgcataagctctctctttgcctgccgccatccatgtaagacgtgacttgctcctcctagccttccgccatgattgtgaggcctccccagccctgtggaattgtaagcctattaaacctctttttctccccagtctcaggtatgtctttatcaggagcatgaaaacagactaatagagtaaactggtaccagtagagtggtgcagtgccgaaaagatacctgaaagtgtggaagtgactttggaactggataacaggcagaggttggaacagttaggagggcttagaagaagacaggaaaatgtgggaaagtttgaaacttcctagagacatgttgagtggctttgacaaaaatgctgacagtgatatgaacaataaggtccaggctgaggtggtctcagatggagatgaggaactttttgggaactggagcaaaagtgactcttgttatgttttagcaaacagactgctggcattttacccctgccctagagatctgtggaactttgaacttgagggaggtgacttagggtatttggtggaagaaatttctaagcagcaaagcattcaagaggtgacttgggtgccgttaaaggcattcagttttataagggaagcagagcacaaaagtttggaaaatttgcagcctgacaatgcgatagaaaagaaaatcccattttctgtggagaaattcaagccagctgcagaaatctgcacaagtaacggggaaccaattgttaaccccaagacaacgaggaaaatgtctccagagcatgtctgaggtcttcatggcagcccctctcatcacaggcctggaggcctaggaggaaaaaaatggtttcatgggtcaggcccagggtcaccatgctgtgtacaggctagggacttggtgccctgtgtcccagccacttcagctgtgactaaaagtggccaaggtacagctcaggccatggattcagagggtgcaaaccccaagcttggcaacttccatgtggtgttgagcctgcaggtgcacagaagtcaagaattgaggtttgggaacctctgcctagatttcataggatgtatggaaatgccaggatgctcaggcaaaagtttgctgcagtggcagggccctcatggagaacctctgctatggcactgtggaagggaaatgtggggttggagcccccacacagagtccctactagggcactgtctagtggagctgttagaagagggctaccatcctccagatgccagaatggtaggtccactgacagtttgcgccatgtgtggaaaagcagcagacactcaacaccagcctgtgaaaacagccaggaaggaggctgcaccctgcagagccacaggggtggagccgcccaagaccatgggaacccaccctttgcgttaacatgacccaaatgtgagacatggagttaaaggagatcattttggagctttaagatttgactgccctgctggattttggacttgcatggggcctatggcccctttgttttggccaatttcttccatttggaatggtatttacccaatgcctgtacccccattgtatctaggaagtaactaacttacttttgattttacaggctcataggtagaagggactccccttgtctcagatgagatgtaggactgtggacttttgagataatgctgaaatgagttaagactttgggagactgttggggaggcatgattggttttgaaatgtgaggatatgagatttgggaggtaccaggggtggaatgatatggtttggctgtgtccccatccaaatctcatcctgaattataactccaacaattcccatgtgtcgtgggggaaacccagtgggaggtgattcaattatgggggcagctctttcctgtgctattctcctgatagtaaatgagtctcataagatctgatggctttaaaaatgggagtttccctgcacaagctctctctttgcttgctgccatccatgtaagatgtgacttgctcctccttgccctccgccatgactgtgagtccttcctagccatgtggagctgagtccattaaacctctttttcttcccagtctcgggtatttctttatcaacagcatgaaaacagactaatacaatacacaagattcatgttgtttttatgcttaacacaacattctttctgcagccatgattcaaagagtatttcaagtcttattatttaagaaatacatttgggaaggctactttctacagtgattcttctgatgtatatggataaagaaaattaaaaatctggataggagtcaccattctagatgccattaagaacattcatgattcatgggaggaggtcaaaatatcaacattaccaggagtttgagaaaagttgattccaaccctcatggataactttgaagggttcaagtgaaggaattaactgcagatatggtagaaatagcaagagaacaagcattggaagtggagcctgaagatgtgactgaattgctgcaatctcagcaacaaagagatgagcagttacttcttatagatgagcaaagaaagtggtttctcaagatgaaatctactaatggtaaagatgctataaaaattgttgaaatgacaataaaagatttaaaatattatataaacttagctgatacagcagcagttgggtttcagaggattgtctccaattttgaaagttctacattcggtaaaatcctatcaaacagtatattacatgttgcagagaagtcttttatgaagagaaaagtcaataaatgtggtaaactttattgttgcctggttttaagaaattgctacagcttctctgaccttcagcaaccgccaccctgatcaatcagtagccatcaacgtcaaggcaagacttcccaccagcaaaaagattactacttgctgaaggctcagatgatcataagcactttttagcaaggcaatattttaaaattaaggtatgcacgttgtcttctagacatgctattgaatacttaatagactatagtgtaaacataacttttgtatgtactggaaaaccaaaatgtgtgtgactcactttattggaatattcactttattttggtcatctgaaacccaacctaccatatctctgaaccctatacttaagagatgttcaggaaaagttggctgaatgggtaaatgaacacaataccattgttcacatttgcagatggtgcaaatgagacctatagaattcacgtctgtaatcccagcactttgggaggccgaggcaggtggatcacctgaggtcagaagctcaagaccagcctggccaacatggtgaaaccccatctcaagtaaaaatacaaaataaaaatggctgggcatggtggtgggcgcttgtaatcccagctactttgggaggctgaggcaggaaaatcgcttgaacccaggaaacggagtttgcagtgagctgagtttgtgccattgcattccagcctgggcaacaagagtgaaactctgtctaaaaaaaaagaaaaagaaaagaaagaaagaaaaacagaaagacaaaataagacaagaaaataacgacctacagtcccacagctaggaaaatgtgaaccgttaatgtgactctaatctgactccttattcttgttactggaccatattgacttctgatctgctttcttattattttgccttctaatacactatgatacatggatttaaaaagaacactcagccattctgtggttttgatacatagtgctgaaatcacatctttgattcttttactatttatgcacttaatgaacatttattaaacatgtaataaatttgataaaccaaaaactgtgtagaaagaaactattaattttgttcatcattgtattaccagaacttgggacatgtcttgcacatcataagccttcaatacatatttggtgaaagaatcattgcataagtaaatttcaatgacactaactgcttaagatacagagagagctcttgacattaaggaattctcagtgaaacctcactggaaatagtctatgaattaattaagagatactgaaggattttgaactgcagaggacataccactgaaacaaagtaggcgctacttgcctgctttctgaatctgctttgtttgttctctcaggctctgtctgtggctggaatccctacaccttctatcgttgttgaactgctttgcatgttaaaaaataacacattttgggaattaactgtacgattggttaagcaaggggataaaaacaaacccagattggtaccttgttaacctacaacgatttctggaccaggtaaatcctcaatctctcctctgccaaaagaaaatgacaacgcataaaaataatgcagaaagcttaactgacatagttctgtcagtgttactactctggatctgcaatgaaatctgattgcttgcacttacatgaaactttctcatggatattgcagcatccttccccaatctcatattttattggcaatgcaagaagacataatttgcatgagatgcagaaagtggtaaattagaaaaattaactacgaagttgtttgccaatagaggtttatatttatcttagtataaataatttaatgtgtattttccttcatgattgaatttataatgaatattcgatgattaatttatttttatagaataaaaactgtttttaatggcccttttaactgtactctctagctttggtttcagtgttatcaaagcagaaacatttactccatttctaagtattttgagaagataattctgttaaagtttaaacaatagtgtttttaaaaaccaggtgaactttttctccttaccctgtcttatgtactgaaaaaaccaggttaatttttaaaagtattcatttgggaagcaactttctgagaggcgaaatattcttacatcagaaaagacagaagcagaggctagtgcctggaatgtgtttgtctctatctcggtagttccaacagtgcttacctgtttcacattctatacattttggcttcaaatccagtggttgtcaactctggatgtaccttgccttgaaccctaactctggcaatttaatagaatcaaaatctctccaggctggggccaggtatcagtattttaatattacccaggtgaagctaatgtccagccaaggtttcactctaacaggaatttgagacagcttgtttggtcagatgatcctatgatactgaaatcatcccaaaggtagctagcagatattagtagtccaaagccctgtattagattttgactctaattctaataaactttgtggagctaatgaggcatccacttaatttactcaatctgttcaattcttttagttacggaaggaagctaattcagtcctgtgtggttgttaactaatcacagatctctaatcatctgacaaagttagagacacacatgccagaatactaaacatttctacaaaattttacatggcatcccctagagcatgtgaagtcagatatcaattcctctaaggttcgaggaggggatgccttgttaagacataaaaccaagaacaataactgactttataatgagtcaaactagccatcagtataaggaggccttctaacaattagaactgccctgtaatgttaagaagacattaaatgtgaaaaatgatgtccatatggaaaaaatacagaaaatagacataagtagaaagaaagtagaaaacagacaaaattatagtatatataccatatatgcttgatatatattgtatatacttttattaaatgtatatgttatatgattataaatgggaaagaaatattacaaaatgaaaaatccataggaaaatggattaaaactttactgtgaaagtattttaataaaagtataacaaatttttaatgtaaaattaaagtagacaaacattatgctaattaaaaagattttatcatcttccctttgtggaagacatagcaggataagacaatactaaattacttgggaaaaggcattgcagaaaccaactgtgttagaaaattaaacagttgtcacccaaccaccagatgatgtcaagatatcacatttgttactattcaaggctactcaggaacaatgatttaagcaagagaacaccatgagtggtactgtctgaacatgacctagatagctcatgctgggtcgtctggacaatatgctaacagttggcagtgtcccccagcccatctggagaggcctccctgaaatacagcttccaagaagacgggtgactgccttttcctggaaaaagggagctgcagctttccatgcttccttaaggtctccaagcctggacagctgactttcctagacaattcctataaagagttgacatctaaaccccaacagtctggtaaccaaaaggtttatctgtaccccaactgggcagattcccctttacattcaccctaaagaggagagcaagaggcatgatgcagggtcggggtggtacaagtctcctctcttctagccaacacttgattagtaaatcactcaaatcctgttcctaccccatactgtgtgctgttgcagcacatgtgctctgccaagatatgtgtcagccatgaaggaacacacttgtcctcaaggcaggatggagaggatgttagtttcctcaagcaaagtcaggaatgaatttactttaccattatgggctactttcaaatatctaagagtcctcttggggagcacgctgctttgttctgtttacaacttcatagagcaacatgtactgacataaatagctaagaaattttaggtaaaaaaaaaagtttgtttaaaagcatgttgtaaattaccattttagtaaaaaagattatatatatttacatgtatcaaaaatctaaatatgtatacaaaaactcttagaaatagttatctaagagagaagcgaagattataaacatctaagttatatttctgtagtgtttggatttttttttacaaaatgattataatatataatcaagcaaaaataaaagaaacatcaaaaaattaaatcaggttctctttagacacagttttaaaacttggtttcctaagggacactataaaacacagtcatttggtaattaagaaattatctctagaccatctggctacctaggtaggccaaaatgttttgacctttttgcctgtaatcagttaagaacaatgcaagttaataaaagcctagacagcttacagcctgaacttcataatttttccccaggagttgactaccagtgtaattattctcagttcagtcaaaatgttgtaattggtttatttgtgtaggcttcaactaatcattgcctcaaagaaaaccagatttttttcctgcttattactctttagacccccaatttatttctcctagtatgccatcctggaagttgaacagatttttctggaatctagttgtcctttccataggctctcagtagaaagggactccttctactcatgatatatctggcccttacttattgtccattttaataggtcttaatgcaataatagatttaatgtttaaaatttaatgaacaaaattactagcattttgttaacagatactggcctatgtgactggtagttgcaaactctcattcttaagaagtattcttagctattctatgatagtcagattaagtaatggaggcaaataacataagacaatattcatcacctgtttagaatgatcaaattaatgcatcaaagcagtgattttataatcaattgttcttcttctaaatgtgaagaaaacacttctaagaatagcaaatagaacaacttagcctaaattatctccatttcccttcttcaaattattttagtcttcattatcttattatatcatccaccaattgtgtcacttgcaaaactatttccttggattctaccaatccaccctggcaaaattagctagggtctctaggtagtaccaagataccccaggtgtgtcttggctcaagttgttggccaagcagatgatagggtggcatacatcattccaaaggacatgcatgctggtcctctaatttcctaagtagcatctccaacacatcagtatagttctgagcaccctggggttttgtgagaatcagatgagtacaaccccatattatcttatgaccatcttagttaagcagatcaatatttcttcctaaacatcaaaaatataccaccagcaacacttttctggccacagatggagggcccttgcaggtgtttgacttgtttagtccagcaaccagcatgaaatctactaaatggagcagagagcaaataggaagttgggctgggctggtaaatcaaagatacgtcttaggatttaaacccttcaatgatgtaatatttaacagtagaatgaactgtgtctttcatatgtactattttctgacattccattactgacagtagtatgtcataacagtgtttcaaaacaaagggagcagaatggaatgagcctaaggggataataacttgtaaaaagttaattgtaaaaaaaaaaactgcagacaaatttttcttttatcattaagtatttatttaaacttcatactgagagacccctctatttattcctgaatcctttacatataatcttgtaagcagttgcaatgactaaaatgtccttggttagtcattaaattcaattattgactgtatattgagaaggtgtaaatcatagttcaaggttaatttaggggtctcttattaggagttggatgaaatgaaatatatgtgttacataaattgctgactgagggaaaaatatacagttaaaataataatttggatggagatgcattcatatcatattgaaacatgacgtttgtttgtgaggacacaccatatggaaattccccaattccttatactttggttataaatctttactgattatagtaaccactgtttcaggtggttaacctagaaagcttcaagaaggaatggaaaatgagattaaactcacatacatagcatctccaaataaggtttcttaccagcgaaagaaaatcaaagattcacattataaaaattcattactgatgcaaacctggttcccatgatgtttctaggattaagagaggtaacagtccccgcactgaatcacatgctcattaagctttcccttaaagccaggtggccaaggtttcatctctgctaacaaaggtattcaaaggaatttatgataatcattctattgtttgaattttccattgctagataatgcaagtgctcagtgcagagagatttccttaaaaaatgtttctgctaggtcaaattagcacctgtacttggatgttcaagtcaacatttctttctaagtgtcactgatttagaacataagagtatgttagaatattaaaagatctcgggtgtggggaaaagcaagagagatcagattgtcactgtgtctgtgtagaaagaagtagacataggagactccattttgttctgcactaagaaaaattcttctgccttgagattctgttaatctgtgaccttacccccaaccccgtgctctctgaaatatgtgctgtgtcaaactcagggttgaatggattaagggttgtgcaagatgtgctttgttaaacagatgcttgaaggcagcatgctccttaagagtcatcaccactccctaatctcaagtacccagggacacaaaaactgcggaaggctgcagggacctctgcctaggaaagccaggtattgttcaaggtttctccccatgtgatagtctgaaatatggcctcgtgggaagggaaagacctgaccgtcccccagcccgacacccgtaaagggtctgtgctgaggaggattagtataagaggaaggcatgcctcttgcagttgagacaagaggaaggcatctgtctcctgcccctccctgggcaatggaatgtctcactataaaacccgattgtacgttccatctactgagatagggaaaaaccgccttaaggctggaggtgggacatgcgggcagcaatactgctttgtaaagcattgagatgtttatgtgtatgcatatctaaaagcacagcacttgattctttaccttgtctatgatgcaaagacctttgttcacgtgtttgtctgctgaccctctccccactattgccttgtgaccctgacacatccccctctcagagaaacacccacgaatgatcaataaatactaagggaactcagaggctggcgggatcctccatacgctgaacgctggttccctgggtccccttatttctttctctatactttgtctctgtgtctttttcttttccaagtctctcgttccacctaatgagaaacacccacaggtgtggaggggcaacccaccccttcactcgggtcatgcaggaatcatatgtgcaaaaataatgtgataaaaacacacctataaggtgaaaaacatctacgtatttgctataaatacacatactttgaatttctatattctggcaaaagcattggaggacaaaaaaaaaatcttttcaaaatacaaatttgaatatgtatgggcctcacttttccacccactaaagccaacctggttagcaggatatttcgaggattaagagcggtagcagtccctgcactgaatcacacacatccattaagctttctcttaaaattaggtggcttcccattgttcttagggtagaagacctaatatgtctataaggttttgctccagttggcctctgctctcctctctagcctcatctcaagttactggcttcctgttagctctcttcatctcagcctcaccagccctcccttggtaaaccgtactgtccattcagtactgtttcctacatcaggactttgcacatgctgttcccagacactcatctttttatttatttcattctcttgcttctcctaccaccatcaccacctacaccaccactaccatcaccaccttaaccactattacttttggaacacatatccatacatgtgcacatacacatatgtgcacacatgcatactctgaaactctcctcattgttacatcctaggagaaatatttcctgacattttacacataccctccctgttataaaatctcctggtactgtgtatatttactacacaacactgattttttaaaattttatacatatttttagacttttaatgtcaatttctccattaaagttggagttgtctgtttcttctcatcattatttacccaacatccagcatgaaaccaggatacagtggataataatacctaaacattgtttaaatggggcaatgaatgtttcaatcaatgaatcagtcacatctgcacacctctgtgatagatggattatctactgtgcaaaattcaacctgaagagagataaagaaaaagaccattcattgggctcaactattttgacatgactgggctaactgctttgcttatttaaatttaatatcagcaactgcccaaagtaggtattctgattccttttttacagatggagaatctcagactcaggtggacttagtaacccacccaaagacacgtttggtacgagagcaacatggttattctgttttgttttgtttttttagaattttctataaaattgtggcaccatgtttatatctgcattcaatgacatttacatataatttgaatttaggatgatcctattttgaagcacagaaattacttttgaatgctggctctagaaattatgaaaaatagaatataacaaaacctgaagaaagtaatacaacaaactgaaccagcattttagtgttgaaattttaatgaagtaaacatcttccatttaaattagcgtgtgtacaattagaattattaagaattaagtatgacttcagaacttaaaatacaatttcttaaaccaaaatttgttttagtttcagctcacccaatctgctaccttgcaaccacaaatgtgtttatgatttccccctccaaaaacctgcctctagttcagaagactcttcactgggtaattattttccacaagcccaaattgttttctgtggtatgaggctgggttcaatgctctttacacttttgcccatttgcagagatcagcatttcctttcgccagaatgctcctgctgacgagaatgctgttgggcctcccagaaagaaagcagagacagttcatttgaccactgcctgactcaaacctctgctactgtttttttctgtccagataagggagctaaagtcagcaataattggaaaaagaggctctcatttggtcctgttatgctactttttccagtaatttcaaacaacaaatatgtagcatttaatattatatgccagccctctaggaactgtgaatgaagtaaacaaaacttgaaatatgatcaatccttatccttgatgaacttgttagggaagatagaaccaatatacatggaagaatcagagaataatgaagtgagaaactaacatgggctgttacggggtgaatcctatacccaaaattcatacattgaagtcctcgtacatatacctccaaaatttgtacgttgaagtcctcgtacctcagaatatgactatatttggagacagggtttaaaggaggtgattaagttgaggtcataagtgtgggccctaatcaaatgtgacgttgttataagaggagctaaggacacagacacatacagaggaaagaccccgtgaaggaatagagagaagtcagccatctacaagctgaggagagaggcctcagaagaaaccaaccctgctctcttgacttcagacttccagcctccagaactatcagtaaatcaattcctactatttacgcttgcagtctgtggcactttgttatggcagcctcagaaaattaacacatggattctattaaaaaatgattttagggcaggaataaaccagtctgtgttcaaagacttgaggaaagctttgtacatgatatagggtctgagttgaatatagacaaaaactaaataaagcagagacagagggatgacattctaggacagcaggaaactcaatgagataagactagtaaatgggagagagaaatgatttagtaacaggtaatggtctctgaaaccttttaacctttgctatttgttcatcttaaatgttaatgtatttttaataatatatttactcacattggatagataatctcaatttatagtaaacaatgtcttgttactaaaagggctatgctgaagttaacagaaacatactatttaccatatatgtttaaatctcgaaatccacggccatataaaaaaggactatgaatttgggcaaaatgccattgaagcatacgtacaattgtattttgtatgttatttcatatgtacacaggaattgtacatggaaaatgagaaagagaagacataaaacatgaaataaattatgtttgagttcactggtatttcatttatccagattatacacatttattgtcaaaagctttatggatttttctgggtgaagtttatacatatattcatgatcatatgttacaaagcatttaagtatatagcttcatagctatacacatgaaattaaatattaaaaatactggtttttttttctaatttaaccctcttctagaaaaagatcaaaaaaaagttccctcagcatgtgcacatctgtttccattgaggattttaagaaaatgtttaaaagctgcatttaagtgaataatttccagcctgggaatggtgagccagctcagaaccaaaggctgttcatctaaccaataagcaggtgtaaatgaatatttcatgaacactgtctgtaattttctttttacttgcacggcaacaatccctccccaccctccccgcatcttcctgtactgttagtcctctctccaaaaagagaggggtgtttgaatgccacttaaaattcttaccagtatctggtatggtgtcattctttactgttcacattattttttatcttttggattttgctttcaaaagccatttgttctacatcaggcagctgcattttctttcagcattaaggaagaagaataccaaaagtacttacctaaaaaacaaaacacaaaaaagggaaagattaaagtatattcatggagatgcttgatgtcttgacaaagcaccaaagtggggatgaaaacacccatagcacctaatggcccatggcaaataaagcatgtaaagccaccaaggaatgactgtagaagttgcacccttgtctgaaacttaagacagcaaaaggggtatgccttggttattttaaaaatgaataggtaaagcaaagttttgattttcttttattttcacttttttaaacaacttacattatctcagactgtaatccatcacgtctctgtccttcaacaggttctaactgcctacaataatggcttttatcattatgagccagaagactttaatcataggcctaacttagagcttcaatgcaaccataggcctaacttagagcttagagcatcatgaagagtgcattgagatatgccagacactggtggctcatgagagaaacaagggctttgctaacagttgtcttcctaactatgaggcctcctgcaatatgagacattgtagtgttggtagaagggtctgctttcttagacatttttgcggtactaacatagatataaaaactaacacacggccaggtgcggtggctcatgcttgtaatcccagcactttgggaggcagaggtgggtggatcacgaggtcaggagatcgagaccgtcctggctaacacagtgaaactctgtctctactaaaaatacaaaaaaattagcagggcgtggtagcgggtgcctgtagtcccagctacttgggaggttgaggcaggagaatggcatgaaccaaggagacggaccttgcagtgagctgagatcacgccaccgcactccagcctggttgacagagtgagactccatctcaaaaaacaaacaaacaaacaaacaaaaaacaaaaactaacacacatagtcagatgtggcatacaaaagagaaaagtaatttttgtaaatatttaggaaaaaagaataaataataagtggcaaacatcagtagttttcatcaatgtgccatctgtgtatagatacgatgtctttgactgtctgctggtcacagaaagccctctacacaaggaaggcaggggatggccttgaacagtgctcctgagtgacagctctggaataggtgggagaaggcacagtgcatacccagcgaagaaatctgttcactctgtcagttaccaaaagccaaagaaaaacttcctccataggaaatgatttccccattccattcttgacaagcaagagctaacaaaagaaagagtcccaaaagaatatgggacttttgggagagtagaggagatctcatttacgaagaggagagaacatccacgtgctgatagcagcagctaatagagctgcctgatctggtgctggctgggcaaaccaacgctaaaggcagaagcacaaaaaggcattgcaccacaatcatctgggtgacttggtcaaaaccaagaagcacaaaaaggcattgtgcttcttgcttttgaccacgccagaaaggcattgggcgacttcgtcaaaaacatgatgttctcagggcccaccaagatagcatctctggaggtaagattttggaatttccatttttaataagcacccctggtaaattttatgtggttagctgggcaccagtctgcacacagagttttaagaatcacatgctagaaggtgtgggtctgtctcctgtaagtgctacctgtcagagactattctctgagaatgctgagtcacataatttggtcagaatttaatgaaactgcagggacagagatagggaatgtgcatttctcttccctatttaattctgcctcaccaacaaactgctggtaaggaaaaaaaaaatcacacaaaatatattatttgaattggtctgtgccactaaccaatgctgttgtccattcctactgtcccctggttcttgttaataagataacattctgtactcctactcatagagggcactattttcttgtcagttcatgctgttgcagacagttggtaattccaactaccaaaataccataatttcatcagtgaattaagccgagaaatagttttgaatattacagagtatatagtaagatcttccataaacctgagttgactaatttctagcatctcttgaccttcaatttcactaatactgtttagctagttcttgagctatttttatctgaataatgtaaattgagaaattgatttactttgtttttcaggaaatattttaattaatttataatatttctctgctttagacatttagaaatatttattttacttacaggatagatgttgtggcatatttaaaaggataaaaatgtacttcagaaaagttcacaaatttaattctatatataaagagatttgttttttcctaaggtgctccactattaaatgaaatataacttaaaaaaaatcagtcctaatatcagcaaactgtgaactgacctcaaagttaatatttacactcatcagaagctaaatggagccgagtgcaatggctcatacctgggatcccaaaatcccagcactctgggaggctgaggtgggaggattgcttaagcccagcagtttgagaccaggttaggccacatattgagaccctgtctctactaaaaattaaaaaatacatagccaggaatggtggcatgcatctgtggtcatagctactagggaggcagaggcaggaggactgcttgagcccaggaagtcaaggctacagtgagccatgatcctgccactgcactccagcctgggcaatagagtgaggccctgtctcaaaaagaaaaagaaaaagacactaaatggaatggaatgactttaattgcaggtgagcctgtattgccattttaaaagatttttccaagtctgtcttgacatagcattcattttgtatttcataaatgagaagactgtgaagattaaatcaaaaaagctaacagtgctggtcaggagctagaaaacttggggtggagcttgaggaaagaagactatgagaatgatttttaaaacatcatctatatcttagagcataaaatggggtaaagataaactattaactgacacagggtgcaaagcaccacaaagcagcacaaatagctttatagcttctgtaaatcctaaggatcttcctaagactcacatccctctacaccccttcaaatcagattattcatttccttttccctctctgctgtacaagtgacaacagctacaaaatgcatcacccaaagggaaggtcgttaaaaaggcctgaagaatataaagtgtcaagcagtttggctttaactgtggcctttgtctagcagcacatagagtgttgtctttttgttttcttcatttttaaggttgtagtataatatattacagcccaagaccaacagttacagcttccagaggtagctactccgtgattaagagaactcatttacagtatattccatattttttatataaaaaaattaaactgtacttgccttattccacattcaaatggttaatatataacaattatggatatgacataaatagccctaccagaggcaggtcagaatatatatgacagtagggagatgtgaaaaacacagagaaagagaagggaagagccaatttatgcaaaaagagaaatcacaccttctgctattactacatacggtcttggaaatataatattttattaaagtcaaatgaagcatactttgttagagtttagccagttcaactacaaagagtaaatacaaatctaaagtaaatatgcttgctgaccaaagcatccaatgacaatcttatttgaaatcataccacatattcgtatgactggaagccaacttgcatagcgctctttatacgcaaagactgattttatgctgggcacaggaaagaagagagagtggaaaggctggaagagaggtatgtcacatcaaccaacctcctaaacccagatggttttcatcatcataaatcatttccccaaaggcagcaacccatttcatttgctaacattgctcttgaacaacttgcctggcaagtagctttctcattaactttcaaagacatcctatccatgtcattcatctcctgcgaatatacgaatataacatttccattaccttgacttttaatttccccttcaaaataggaattttatgaattgatttgacaggtcatataagtctctttatactattcataaaacttgccttccaatatgctttgaaattaagattataagccagttccatattaacatactaatgcctacccaaaattatgctggagacagctggctaggcacaccaagcctaattaaagagctaatatttttacaaagggattaaaagttacttgagattgaataatacatcttaatgacttaaaaaaaagaactttggactagaaatgctctcaacataggaggaaagtaagggctaaaagcagattgtaggaaaaagattactttcttacttacataagatcctctctctttaatcccatcagacactataaacaggaggaagtttaatctagcaataagagcatgacttttattgtcagacaaagctaggttcatggcctttaatatagttatacccagtttgaatcattctgctttctcatgaaaaaaaaaaaaaaaaaaaagagaaaatatggaaagaaagaatgacctagaaaaaagtctagaatacaatacatactgaaaaaagactgtttcaggtcttttgctttctcacataaactagctcagtaaaccaaaatactctcatagtttcaactatactaatgcctctcaaatatatagtttagactctaatttctaatcaaagctttaattcttaatttcgagtggccagaatagagaaatcacataacttatcacattattacaataatgtttacaattcacctgggaattttaaaatgatatatacactaataattatatctaaagcctgtacttaattatgtcatttagaagactgtagacaacaccaagccactccatataatccaccaaaggtacttttccttcctataaaaaatgatcaggaagatttgatcaataattcttttatttttcaaggaggagaatttcttgtttgttgtggctaccatctcaaaatgccttatagtgtctctacttcaacaagaacatccctgtaccaatgattttcaatgtccagattcccagatgttattattcctgacaatgaatctgcatttgtttcagatgcatttaagaaatttgtgaagctagagctcatctaacctgtcatcattactcttcatcaccctcaagcaaatggtcaggctgaaagaatgatgcagaccactaaggaagccataaagtaaactatcagaagaaagtgactgaggagatttgcccagcttttcatcactcaacatatcagtccaagtgggacaacagaagtcagttctcctgaataaaaaaggcagcaacattgcaactgtgcctttgacagttcccatataaagcttagcttagaatttatagacaaaccagaatgtactctgggaatagtactcattcttaattcatttttctagaagaatttgtgttgactagaattttaaatgaaacagaaaggggcatgttcctatttaactaaaatcacggtgtgtgtgttattacaagggctagactgtagatggaactaagtggcataacactaacaagagcaattcagtgttatgttcaggttttttacattcctgctagtattttatttcttttaagttcattatatgccactgtgtacttattttaagttcagatatattatatgacaaagttaaccaagaatattttctttcaccaaaaataagactcaaaccctctttttctgcttaacatcaatcaaatctccaaaaagttaggagaatttggaaaggagtacagaaaagagtgaatgtgtctaccaaatacttctagctttcctttttctggtcacatggtaagattgcccttagcctcccctttggtatcctacatgaacatgggatatactttgaccaattattttaagcaaaagtggtatgtgtcacttctaggtgaaagttcaggcaacctgtgacggattcattacatcatttttccctggtgaagaagcctgagttgagataaagcatcaatcatcttgggtcccaggtttactacaataagtagagcctcttgccaatccctcttgggtatgtatgaagagaacaagaaataaaatttgttatattaagccacttagattttggattactgcagaataacctagactatcttgacttacataaaattaatcaaaataataaaatattaataactgaagtcataaaaagttttatgcaaaaaagttaattttttgcagtattaaattcaaaaatgaaaaccaactaagggtttgacttaattactatctacaactgtaggaacagtgttggttgggttttttttccccctaaaaaggtgtttaccattttgcaaaaggaatatttctgttaaacaaaggaaaccagcatgaaccaatataattttgagttggaagtaagagaaaataaaggaatcttcaagtcatgaaggaagaaggtgaaaccaaggaagggtaaaggatgaagacagtgtggtctccttcctagataactgtaataaggaccatacttctatcactcctggattatttccactggcaaccgttagagaattttagactttagaataaagctgagggatcctcagagggaactgtgcattagcttacggggcctgcaaacggacaaggccagtggctaaattatgtgtacctaggtacacctttcagagaagacatatagctttattcagattctcaaaggggtctctaaccccaaataaggctaagaaccatggttatatattaaccccacttgaaatagggtattataaagcataatctcagttttctacaactgtcttggggataacaaatctgtagtcttactttcactctcaagtcaatgtaggagatggcaagaatttttacttttcccaccttaaactacctattagttttgcagagcaggaaccataacttgaattctaaccaagaaattaatcagagttaactttaagaggtttagagaaaatatcttaaaggggctgggggctctcagttttttaccctatccctaaggtccattcttgtctcccagtaaaaagattaacaacaacaaaaaggttggcttagcctcttacacagtgcttttttaggctttcagaatctaaactttccagactcagtcgttgtagggctcaggcttgttgactgctgtatgcctcaatgtccccaagctcccagagtcttcccactgactactcatggcaaaaaggaaattagagggcaggcttgtctttaaaatttctctttttttcccctccacaattctgtttgtttccattttattattaataccatataaaatagagttatacaatgaatatgtaaagaacacaaactgatgttttcaaaaacttttccaagcatgtcactcaaagacagaaagcaaggttcttaaggcatgattatgttgatcataggctagggaaagaatcagaagcacgagtttcctcccaccaacctattctcccttccctctattttatgaagaaaatagtggccttaaaatttaactgagttctgtttctggatacagtgaaattgcttatggaaaagcagcactctcaccaagaacacaaaatggtaaaaaaacaaaacagacaaaacctaatcttatgtgatgtggtgggaggggactggggtatggtaccagggacttctgggagaattgacaatgttctatttcctgatcaggatggagattacatagatgtgttcactttgcaggaattcatcaaactgtaaacctataatttggtactttatgtaggatatatttcagtaacatatttatctttaaaaaatgctaacttattttagcaggcctagtgaatacctggaaatacatcatttgtaaaatccaagcatatgtacattttctctgagaagcttaacttttagacattctactgcatgtgttcaaatttactcccactgtaattattctctcctggcagttttacataagccttagtgagagatagtctcctttggctggtaagttcatgagcaacacaatcttgcataaagtaatgcccatctgacactgcatttacctttaatatagattatggttatatactttggaaaactgcattgcatgtggtcaaatgtccatctcctcccatccctataactcatttatcagtttcatgatggcagaaaggagattttctatctatccaaaaattacaaaataaatatcctgttctaaattttaagtagacaaaattttgaaacattgcttgcaaactacacttattaatagcattacagcacgtaacaataaatcactttggaaggtaattgaatctcataagtttcaataatttataagaaaatatccagagataatagtaacacatgaaaaagaacaataggaccaacagtctacaaataaaagctagggaacacaaaaatgacacaattatcaaattcaagaatttgaatttctattcacaattgacagaatatataaaggcaactgtaaaaaccacctacaaaaaattaaaatgagaatattagaaaaaatttggtagtgatactgagtaaaggatttctgtaacttgtttaattgtactgagcagcagcagctattacattgattttactcttataaaacaatttataaattttattcttaaaaaacaaaaggacatattagtgctataaaatattaactaacctgcacaatgtgcacatgtaccctaaaacttagagtataataaaaaaaaaaaaaaaaaaaaattaaagaatctctacaaaatatgcttacttatatacctaataaatcaatgagggctaaaataaaagtgtatgtaatttaataagatgaaaaaatacattggctaggttcaggtaagaaactcttagatattttaaaatactacatttaggctattattaaaaagttaaaaaacaacagatactggcaggattgtggaggaaattgactgcttatacgctgttggtggacatgtaaattacttcagccactgtgaaaagtagtttggagatttctcaaagaacttaaaacagaggtaccattcaacctagcaatcccattactgggtatatgcccaaagaatacaaatcattccaccaaaaagacacatgcactcatatgttcatctccacactgttcacaatagcaaagacatgaaacccaccctatcagtggtggtttggataaagaaaatgtggtacaaatacaccatgaaatactatgcagccataaaaaagagcaaaatcatgtcctctgcagcaacatggatgcaactggaggccataatcctaagcaaattaatgctggaacataaaaccaaataccacacgctctcacttgtaagtgggagctaaacaccgagtacacatggacggaaacatgggaacaacagatactgcagactactagaaggggaagggagggaggagagtttgggtgggaaaactacttattggatgctatgctcactatctgggtgacagagtccatactccaaatctcagcatcatacaatatacccatgtaacaaacctgcacatgtgccccctgtatctaaaataaaagttaaaattaaaacaaaacactatacttagttgataacatttaataattaccatcatatgggaatatttacatctattttttcaggcattagtaattcttgccagagtattatctaattggaaatggtaagaatttgtatgagcacggatttgaggtttataacaacattacttttttcagatagattgtaaacatctagacttaattcagaaataagatttcagaggaaatgtagaaattatctaaaaggacaacctgtttttaagaacttctgaagtttctgtttatgtttgaaaaatggatacactaaccacaaatcattgtatcttctttttaaattgggtacagaaagatcctctatttgtcaataatttaaatatcttaattagttttctaaacgttcaaaatccttttagaaaacagttcatcaattacataccacagacactaaatctacagtttttgtgtatgtgtgcatatgttcaccaatttcaattaaaatctatgacaaaattaaagaaattatttttggttttggaagacataaaataactgaggattatggaagtctactatttaaataaatataagtattaaaaactatctatttgacttagttaactagatttctcctgagccacattcaactagaaaagtagcacttaacatataacctgctcctgtcaatgaattcttcataaaattttcaataaatcacagtataacattttagtaataagtatcttaaaatttgaggttcaatgatgtgcataactgtatgctcatagtaacctctgttattcaaaaatatctgttgcttttgggtgatacacaagaaacacgtcataaaatatgacaaaaaagcattgttaacatgacaaaagtattcagtgcacaaggcaaaggcatctactcagagttgctattgatggtttgggtcctagcttcatattacaattacctggggagtttcttaaaaatactgatgctcaggccccatgctcagagattctaaatcacttggcctagagtttccaggacttttgcatactttacaatgctccctggagagttcctaagcaccgtcatggttgggaggctcatgacataacagcttttaagtagctactgtactacatccacagtctacccttactagctatggttaaccctaaacaattccagataaataaataactagatttcagactagttacctttatctggcctcagaagaaagaaaggtgaaatcatacgtattttctattttttaatccttccaacctggataataattccaaatttcccatttacatttttgccttgagtctgcatatttcaaacagagctcatgaccaacaggaaggttgtgaaacaaatttcatgtgttgtgacaaactttaaaacaaacagaatagagatcatcacatgtatcagagatcatcacatgtagtaagagtaagcaggattttgtgaaacttttgtctcagttgaatatacatatatgtgtatgaatacatatgccgagtggtaaaataaaccgtatttttacaatagattgttgggttctcagctgattccagctgcttgtccttttctcactgtctgaaaactgatactcttcgacaatgtcatgaaaagaagtttatttagtcataagcttaatcaagacagtactgaactcataaaaaatcttctgagagaataatcatggcatatatcttgtaaattcagactacagtggggagagtatgcacattaacttataatttctatgccaagcatttttttttggctctttctccaaacattttactaatatcttacggcatacagattggtctcttggtctcccaacttacaggagacattttttggaggttgtatttttaattttttttcaatattgaaaaattttataggcatgagcatttcaataacttcattaaagaagaaattctccaagatttttgttcatgaatattatagtactccaagcttttttttttaattcaaactgttcagtaatagttttcagtttgcaaagttatcaaaaaggatagaatagtttacattagaataaatgtaacattagaataaatgcaacattattgttcatatacatggaaagtatatatttttatttgaataactatcctttcaagaagatcatattacaatgaagataatgttcccacgtactctctgaatagtctgagatttaataaaaatgccatctgccaatgtcacagattacctcccttatctatttcccactaccacccaacacccaggttctggtccaacccagaccactcaagagtgcttctgcttcccttcattcacgatgggcactgtagtcacatcatcatggcatgtggccatgttgggtcactgagattcactgagaggttaatgggtccaatatgccaggatgggaataccccatgaagccaggcattattttccaatatgacatttttcttaaattactttgtatctttccaataagtctctttttacttgatccaattaataggtttctgttcactcattcatttattgagcagttactgtgtgccagacaggtgataataaccaatagggcagtgtagttcctgcctttgtgtcatttactttattacaataaaacttgccctgattaaaacaatttatgttattctcctcccttgaaatggattttaagtcaaggccaatcggctttagtgtttgcagagtaaccaggacagcaatgaccagggcagtgtcatgcacatgaacttggtgaccacttgcacagcagaatgttcctgaaggctctttgtctctatttgcagtagaagtcctaacaaggccaaggacaaaacaatagatggcaaatattcctacactctggagttgctgcaacatctggtaggacttgcaaaggcgcagctattctgaccgttagcttataccccacatacagcctttaaaagaggtcaaagggagacaaaaaatcctagagaggatttctttttagagtcccattggcatgctaagacctaactctttattggattttaatgacagtggagggaaaggcaaatgttttctgactttgctgtatgagtcttgcttgttcaatatggcagttaaactttttaatagactggggagtaatacaatgtagtccaaaaaaaaaaaaaagttcgagtcaagaagcctagtctgcagttggtcaccccttagccatatgtcctgaatatatcattcacttctctgagactcacctgcttcatctctaaaatgggagttgaattagacccatggaacccttcaagtggaaatctccataatttctgacccctattccctgctctatgggtgcatttgggtggtggtaaggaaaggctgctccagcggtagagttttaaaatcccggaacctgcctgagtctccacacttctgtggtctcctccaacatgaagccttcatgatttgacttttcttggaaatcaagacctttggtcatttcgttgttcccatcactgtcattattgaccacagtccctttgttgaagccattcatcatctggctcttctcatttcccctataaaatttttcagtattgaaaaaaaaattaaaaatacaacctccaaaaaatgtctcctgcaagttgggagaccaatctgtatgccgtaagatattagtaaaatatttagagaaagagccaaaaaaaaatctttggcatagaaattataagttaatttgcataccttccccactgcagtctgaatcaaaaagcatggtttttctctacatcctttgtgcttacaaaacccacttcttcaggaaaaaagaaaaataataaaaaaaaatttcttttcaactctcacattttaagtacctgccttagacctaagagtaagtctctaggctagctacaacatccccttaacattcataccctctccagcttgtgaattaacaaaatgacagatattttttcatagttgaacttatttggcttattaggcttctcctattctagagcattacatattttaattccttaatacttttggaaagttgcttcaattaattaagtgatgatgtgtttgttgaaacatgctggtttaaccattgtctactggtctcttctttttaaaagaatgtaagggcaatgagaagagccacttattgtggcattgttcttttaaatactgcctttaaaatgaccttcttttacagttgtaaagtgctaaagaaaatcattttgcaatgctatttcagatattcaggcaaaatcatccctgtagtgataaaagaatatgcccttagaaattcaagatttttcataaaaaatattcaacagaagtcaaagaaataaaaggaaaaaggtgattcgcccttgttgtgtctgaaatggacccatagaagttattgtgatgccttagtaaataaggattatttttagaatggtgtacacatcattatcataacagggcaaaattttttgattcttgcttaatggtcattagcaataatggactctaaatcttcaaatcacaaatttccttcttatgctcctctctaataataaccatcatttttctatttcctacataaatctactattttacatatgaataaatatacatggtgggatgattgattttatgtgtcaatttgactgggtcactgggtgcccagatatttaattaacatcatctggggtatgtgtgtgagggtgtttttggataagagtaacatttgaactggtagactgaggaaagcggttactctcctacatttggatggccctcatccaatcagctgaaggcctgcatagaacataaaggctgaaccttccacaagtaagagaggattcctcctgcctgcctgagctgggaggttggttttttcctgcctttggacatgaactgaaacatttgctccttttgggtatcaagcctgccagctttcagactggaacttataccagcagctctcctgggtctccagcttattggctgcagatcttggaacttctcagtctctgtagctgtgggagtaaattccttaaaataaatctctttctatgtatgcatatatcatataggttctgtcctttgaagaaccctgactaataaacatagaaataaattttcaaatctattaaataagtaaatatgtatctcacatataaacttgagcccatccccctctctggaattccataaaaaataattttcatagcctttaaaatcctctacagttccaaggacctgcccagggcaaggagactgaaactttttatttttaactctttttttcttacaattttattttttaggggtgtatttttaggaggagctaccagcagaactatatcccagcattgctgatactaaggtaatgcccgtttactttcctctgttttgtgtggctcattgcaaccagggactggaggtggtggtggaggagcaggagagtaagtgggggttctggatggtaccaaaatgaccacatacaaagacagcacaacctgctaaggctgcaacctgctaaggctggatgtctggcaacagtggcctctatccacacagtgctcaggatgcaagttgctttttagggacacctttgctgctccctttacctttaaggctgagtgttacatttccagaaagaggtataccctcttcttccatattaaagctaattttaactaagtgacaaacatcactagcataaacataaaactgaataaatgcagcaaagattattatggtctctgtttgaagagacagtgtaactacaacttagcagaacacaatttattgtgacttggggaaaggcagagtatggtttttgcttgggccccacctgggcagggctgactcccagctcctctggttatgttctgcttcccaatatcatcaactactgagaatcccaactatgtaaaacatccctggggaattccactagggtctaggcttttccatgacaggcaggttcttagaaacaagtcaaaactatggtttttgaggggcttcccctccaagccaaatgttttcatctaaataccagcactaactggtgattcagtatctgatgaataatgcttatgtttttatgctcaacttgtaatggactataattgtctacagacaaccacttagcatatctttatctttgcagactggctctgtaaatgtcatatctttgtgaatacttgactcccctatcatttgagtgtctgtgcctattaagttctgtatattgaaaaattctagataatctagaccagttaaagcccccactgaaacactgtgtggagccagacctcatttccttattttccttctagaacaaacaaatgaagcaggtgcaatgatgtccgttccccttctttcatcccaccctgagtcaatggcagcagcaaacccaaagttactgcaccttcattcctgtgataccgattttaatctcactacatttaatttcactacatttctgagacaaagtaacatacatactagcaaaagctgcagactacaagttagcagcctgtagtttaagcttcaattctgacagtaactgtctggctctagtgaaaccatttagtcatttgtttcacattttctcatctgtaaaatgtaatgtgggtcaactctgaatttctctgagagttctaaaagtctacgattcaccaaccacaacttgacaaccagtaatatccaccatgatgcatgagactcaagctaataaaccaattagttaagcaatccccatggcaaaatcagatccagttttggatcacttttttaaaataattccaagaaaccccagtctcctagggaagactaggatgtaatagattctgaaggtcatagagattaaagcaaattatattgtggtactatctgcaatatctggtgggtttttataacctacctagccactagcacagtggcttttagaagacacagtaagtagttacttgttatttgactgaggaacagataaaaagatgatgactctatcatctattagtattcaggaaactatgaaatgaatatacagtgcatccagtgatttgtgcaatgtgtcagccatctgggctttattttcactgtacgccaccgttatttattaaagagtagaaatgattaacacagagacatctggccctgcttatatacccacactgcaagtttttaaaaaaagatatacccaggaaattaacattcatatttggatacaaaagtctggattgaattttgttttttagatttatgtctctaccagtaaggttttacaaaataaactctcttctcaagaatgatgctttgaagaaaggctactaccaaacttagcagttacatatttttaggtttattatataaatataaatatatataaacatatacaaatgtaaaataagttatacacaatcttactgcagaatagtttttctagaagaaatgccctgattggaaccaagaaggtaaaatctctaaatgctttcattttgcataagattagagcctacactgtcagaaaatgattaacactcagacattctcactactgtcaaaatactgcacaaagagagagaatgcaggattgccaggggcattcccagctccctgacgtcaattcagatcaaattcagataacttactatgccagctgcttgatttttccgttttgtgaaaatcctattctctttaaaatgagtttgctatctaaataccatcaaagctactttgaaatattgggaaaagggtttaagcttttttttaatgcttttcacctccctcctcatgacaacaagcttgtagagaatgatcaactccttctgattccttcaattattatcactatcatgatataaaatattttttctggactctatagtttgatgtagagtgaaagacaatctgcactctgttaaaatttatcttgtataggttcatggatatggtttggttagagactttgtaatagatgtggcacctctgggcttctgaaaagaatgtcatctaggaaaccacattatttgattccttggctccaccctcccaactcctgtcctcaccatcctgttgtcttttctctgtggcactatctaatgccacaatagacttcccatggttgctctccagaaatagaagaagcttttggatatttgaaatacataccatcttaactactcctgctctaacagcaacaaacttttcatcttagttgcaattgatgtttttctgtgccttcttgtatgaattctttacaggttaataataacatacaacacttataaaatacttcccatgtgccctattgcatgctttatacatgttttatttcagttaactatcacaatacatttattaaatagacattattattatccccattttacaggtgaagaaatgtagacccatagctgttaaatgactcgccaatgtcatacaacatgcaaggagtggagctgaggtttaaagatgtactcaggttaatatgttcttaaccaccagtgtacattacttccctttctgagcatacaaagtacataggagacatggcctatggagcgttaatgcattaaatatacaatgccctgttaaagtgactgaaaaatactaggtttttattaagcatttattgtaggtcaatacttgacatgcttgtattattgtgggaagtaaaatgaaaatcataaaatgttttctccctgcatcaagaacttaactttaagaatacaattttattttgcaaaaatagttaataggccttcttgttttagtttccagcctaagagttgtctatcaggaatgcatagaagtagaagataataggaatcatatgtccatcatttaaatatgtaagatcatctttttaacacctgtgatctaaactgaaacaagcaaacaaaatcctagtcagtatggagatgggggagaaacaaatttctagattgaaaacagaaggcaaaggagcgtctaagaagagatgtaacaatgatgctttttcaggataagaaatgcttcatgagaaggtatttcaagcatcctgggaaaggtgagcgaaacttctactgggagtgaaaggcaggggaggaatttcaagttgataggacattaactgcagagaaatagaaatagctaaagaaataagcatttgaggtttttttcgtgttcagttaagaggaaataagtaggtaaaacttgaaaatactgactgaaagccaagaaccagactcacagcacaagggacttgctgagtgaccttggacaagctacttaaattcagcttcctcatgggtcagacgatgctatcagccctatcattttcctagttagttattagtctatttgattaaatgcacagtggttccagaaagcatttaaggcagtttataaaaatacataaactaagatagcactaataaaaagtaatcaggaaggagagcaacacaaaaaacatgccggaaaggaggctaaaacaaaaaggcacatcatgaagacttagtccctggctatgaatttgactctgagtttcaaagcaacctctgaattagtgaaatctggtgagttacagacgttaggaggagaaatagctcccttctagcactgaaagcatccagtgagatcccgcatgtaacaaatgcttatttccttctcattcctcttttccatgaaatggcaggaagtgccagatccctttagagagctaccacaagtgactgtctgccatagtatttcttccctgccttcccctctgcacatcagacacacagtgtgtacacagagacacagagacaccacactcacaccccacactgcagggagcattccagagctgactactaaggcttggggtctaggtgctccctagttccctcagttttcaccccggtcactatttacccgtggagacagacatcccagataaatcttctgacatcatcaagagccaaaaaaaaaaaaaaaaaaaaaatgtgtaactgttgaagcaatgtaaaatataatgaattttaaagtgttgccatttctaaggcctgtaggccactcaggctgtagcttcgtttccttttttatctcacattttcatgctttaccagtgccaaacaatttgagctattcagctgaagcaagccgagaaagaaatagaggagagatgtgcatcttgtaagatttggaatacagctatttaatctatcagaaattagtttggagtagataagctgtttaaatacgcatttgaaataccattaatagggacacttctctttttctctttgctctgtattgtggttcttttaataaaattggcaatggtgatatcagtgtgtgcatagctgtgcacactgtgcttagcaaacagttacttaaagccaggatattcatttttatgaaaaagaactagatatatattcaatagaacaataaacctttcaaaaaatataaccactagagataatcttctttttttttttttgagggggggatcttcagagagctttccaagtacagttggaatatttcacaatttcaggagacttgtatgcatctaaatacaaaaattgaatgtattttcatggtaaaatattgttggatgtattaggattggcggtttagctggtaagtaaaattttagggagagtgggagcaaggcagacgcataaaacatctgtgctttccaactgagatgagtcaaataaggagaaaaatgacaaagttctgtggtaaatgagctttgaagtgttctccagttcaagccaatttttaaattttaatattaataaggattgttggccaggcgtgacggctcatgcctgtaatcccagcactttgggaggctgaggagggcggatcacgcggtcaagagatagagaccatcctggacaatatggtgaaaccccatctctactaaaaatacaaaaattagctgagtgtggtagtactcaggaggctgaggcaggagaatcgcttgaaccctggaggcagaggttgcagtgagccaagatcacaccactgcactctagcctggcgacagagtgagactccatctcaaaaaaaaaaaacaaaaaaaacaaaaaaaaacattgttgctgtggtccctctgtaatactgctctcttcctgaggcttctacttgcttgagctcttttgtttcttacaaaagcacaagcatctagaagacagtaattagtttctttcttgatatatcagaattattccctaattaaatgagatttaaggtgataaatggaattactttgtcttttagacctccatatttctctggagaattaccttacaaggtttaaaatatgtatattaaggaagcccacttggaaaatacagaattgtttggctatttaaatgaaagcagatacatggtgtttcagtattcttattgtctttatggcttcaatgctctcaacatttgaattaataagatttggggtgccttagctgcatggaagaatccttatttgtttccttgtgcccacattaaaaagaactcaaaatgactcattaaggaaaaaagaaacttgcaatgaaagaactgttgtgtgggtgagtcccaagggagacttgacaatatcatgcaattttcagttttctccctatttctttatattttaataacctaccagttttctatagagcacatctttctccatgccgttgttttcttacacatatagtaatgataatagttatctaagatttcaactttaaaaaagcatgtgtttaataagatctctggtattcctctagagatagtaaaattataatatcagcactgccttaataacaacattttaattgtttattacttccagtatagtaaaaatatcatttcgcaaatatttgcttagctctttggactctctcatatggctacaaagatgagatacccttacaattatctcattttacaaactgattttctttttctttcttctaaagcaactgtggagtaagtatcctcttaaaataaatttcatatgctaagtgattttctaaaaagtaggtggttgaacttaaacaaaaatattttaaaatatttaatatattggctgtttctcaaccctaccactgcatgcaaaatagcttttcttttcaggtgaccatagcaaataagtactaagtagcttctttatactaattgctcagtcaaatgctttcatatgctttcatcaaatgcttttatctcattttttaagagtcttatgagataaatattatgatctccactttgaagatgaagctggagacataaataacagctatagaaaagaaagaaaaccaactaaaaacagtttctgaacttaaaaataatccatgcaggtaattcatgttcatacacataatgtaaaccacttagaaatgtagtatttctttatatgttacatgcctcatttgtcatctttgtgcatcccttcagacatctgcatttgtgtactgcaatgactaataatagtaaattaaagtaaaataaactattataaccaaatttatcttgttcctttgatgtggtacagaaaataattaaacaggtaaagatataatacatttttatgtgccagaatcaattggcaactgacgtggtaccacgaaagtaaaaggctcatttctcccactatagagaaactctaggcaatgtatctctatccagattaagtcttcagggagtacagaggaagtatacatagtggagggaaagaacatgagttccacgatccacgtatagacgatcaaatcttagccctacttactagcagagtgagattggccaagattatttctctctgaacctacctttcctcagcttgaacacatatggcctaacatatatttcaagcatatctgcaatatttatatttaaaatgatatgaagcaaactttacctataatgacattagttactcttgggagatgattatgtatgtgattttatattgccctgtgcacttttctctatgtttaaaacatctcattattctttttaaaaagaataaaatgagtaagtaaataacataaagttgataatagctacttccaggggagggttcagataaactgaaatcagataccatatataaagcagatactgcaaagtaggtaactctcaatttttagctcccttctttcttgttttcttggcaatgcaccattaccttctacctcatcaatttcattcatgagattgagcagtgactttccagtaaagcaagttatcatatttgatgtcagtggtgattgatacaatgctaattaagtagctacatcacaggaaaaccacataacattgaaagcatatttcatttaaacattttggaaagctttctctgtagtctcattgtgaatagtaactgatgccttggttatgcaaaattcaagtattttcctcagtatttctccagaaagatgatataaaaattcaccatactttcaatgtcactatttaactatatgtatattcacacagattcaaaagaatcatgaataccttatttcttacttaatctaactatctaataacaataaatgttatagttaaatataatgtataagatatagaaattgctctttatcgctatactcttcctggtgagatagcagggataatggataaattttaggttgcccaggcaagaagcagataggagaaataagaaaaagctgtagctttatttactaaagttaggatgttttgctcaaatatgcaacccagatacccattcaggattgaggcattcattcccccagcagctgggagtcttctcagctaagtctctctcctggaattgcctttatccaaagagagagaaatctactgcacacaggtgttgatcttaagagaaccccacccccaaacaaatttcttgggcctaaatctctgcctccaagtctgttttctagagaatctggcttacggcatgttgcatcacctctttcttccttgaatgcccatgaaaaccttgaatacaagtatccatgatcctgaacatggtttggttttctaaaaaaatttactgggactatcccatctgtacattcactgacaataaatgatgtagaacattcactagagaatttattcaagattacctacttatattaatccagaaataatataagaaatgctgtctgattagggagagtgaggttgctcacacttggcacctgacccaatttctacaacattttacttgtgccagtacagacctatgttgttctttttgaagagttaagtgtatatacataggaacattgctcatttctatttactcagaaaatctaattttcctccaatgcactaaaaacaaacaggaggcccagtgagattaaaccctcaaattagtgtgagaatacctggtttcttttttactgccctcaactgaatttctcatcacctggagctaattttccagggtacatgtgctgtggaaataataccagggaagtttattagtgtagggaactgataggtctattatatgtttaggctgtgtccccacccaaatctcatcttggattgtagctcccacaattcccatgtgtcctgggaggcaatcgaattatggggtgggtctttctcgtgctgttctcatgatagtgaataagtctcacaagatctgatggttttataaagaggagttcccctgcacaagctctctctttttgcctgccaccatccatataagacgcgacttgctcctccttgccttttgccatgattgtgaggtctccccagccatgtggaactgagtcccttaaacctctttttcttcctagtgtcaagggtgtctttatcagcagtgtgaaaatggactaatatgatctatatggtcaattcagtgagaggtgtccattggctaaaattgtttatatacttttaaaggcttaaaaaaattaattgtcagattggtaccaaactctgagtttttttattgcaatattttaggcattttggcaaaatatacactggggacccagaaaaaagactattctaaaaagaatgaaaacctcttattttgcaggtggccaaaatcctttgttaagattcaaaaatccgtgtactaaagcagttcataacacatctctgcagaaacatgatcagatacagcttctcaatgtatatacgtaaatgccttgcaataaggcaaaatggttaagaatgtcattttaaaaaagcatgttctaaacactggaatcgagtttactatttggtaaacagttcaatatactgtaataaactagctcacaatgaaccaacaaattaatgtaaagttgttaaagcacagtaagttctcatttttcccatctactctgtttctcaagttaaactgcctattaaataaccagaatctcatccagttatattcataaatacaagttaaatacatttttctctaacaaccagcaactcagttttagagaccaaatgataggtgtcctggtgatttaaatacataattacaatgttttaatgtataggtaaattactaagatcagaaactgaatgaataacgagagagatgtggcaggatattttaagatccatcataataggtaggaagagtgattctatttatttgtgaaaatgcattactgtttaagttcgattcatgaagctatacaaaccccaaatgtcacagcattatgggaaaaggtggaacatacgtctgagcataaaacagtgatctaatcacatctgaccacattacgaaatagtttttttccaagttataataaggattgcttcaaaaaataaatggcttactataaatgcatgataataagataaaaacaaaatgagctttggaaacttggctttgaccctagtaaccccaattaaaattagagaaatacttcctttgacagtttatgctgtgatatcaaaaatacaatgcaactcagggagacagaatgtaatgctttgggtgttgctacctggtgagttcagaccactggcaggaaggaaaatgtcatctaagctgctgaaattgtttgtactccacttgtgaatttgcaatgtgtcagatatgtaataaaggcactttctagaagtcgtatagccattaaacttcctaggcattgccatgttagtataatgatggattgcaggtctcaaaaataaatactagcaagactagaattaggatacaaattcagctcctgaacatctgttagggaaagtcagtgtcctaatttgacatgaaaattagatctgtcaacctaagcaaacaaaacaaaacaaaacaaacaaacaaacaaaaaacacctagaaatttattttctggtctacatcagttctcacaaaagtgagacatcaggagaaagttgaactgttagtcataactttcatttattttatatgcccaaacttttgcaaaaattttccttgtgattttaattaattattgcaaagaaatgttactaaggttgcacagtcttttaaactactattaactatccctaatctttctctttcaaaaaaccaagaaaattctaaatgtctagcaatagacctgaggcacttgcattaagactttgaaacaatcccaccagcaacgtaccttccccgtaaacatgcccctcaaaataatactcagtgattggtgcggactacaagctgagcccaaaccttattcctcacttggagtgttggaataaatggatgtgttctatacatttctaagaaaaaaagcaagaaaagaaaaagctagtttttaacacaggctcctgtattcaaatccccttcaagttaccccctacaattcccacctaaggctgttattttcatcaatatgctctttctaccttatccagcccagtttggccttgacttccccaccagtttcctccctaggaatcttccttgagtcttgtcctgcctttatgatattgtaagcaaactcacaaatatccttgatcacttctggatataacttgctcagctccttgaccacactgaagtcgggctttctcctgatggcacactcttccaaaatgtttactatcagaagtagtctccccacttgcatgcttctcttagtccattagctcacgtctgctcttcaacaaggttttttctttgcaagtccatcatatctacttactccattctctttgtgtctctcatttattaccccctggccctgtttctaagtttcttagtgaaattatcatcaaatttcaacaagcctcatcatcaatcctcaatctccatgtctccattccattttcatccttcataaatagagacatgaaagggatcaagatggctgagcagaagcaggtagtgtgtggctccccaacagagaaacgccagaatagtaagtggacaccttctgagcagatagtctaggagagaatgcttggatgcgatagagaagagacataaagcattagaagactgcaggggcaggagagttcccgaagccaggtttcttctgggtggcaagacatgcagctaggggcagctttgagacctggaaccagtctgcgtgtgttgctacgaaatgagaaaggttcccttgtcccccttgcaaggtgtgcaactggagaagtggctcgcttcttcagtgccctgctgctcgtacctctaggggagcatgcaggttgtgggggtcgatcccacggcagcatctaggggtggatgtttacagctcccaaagccccagtgggcatgtgctaccatgggctctttcagttttgccgtctataggcagcttgtgttaaccagctcaattagaccctccaccttatcacaaggacgagggctttctgtatcccgggttcttgccttggcgtgagggaagaattgaatcacacctgggcttggagaatgagtacaaggttttactgagtggaagtagctatcagcagatgggggagccagaagggagatggtttccccctggagtccagccgctcagcagcccgggctctcctatgactgccacgaccaaactccgcgtcattcctctgctggacggcctgccaggtggcagcatctgttggtgtgctcttccaccagcgtgctcccctcgatgtcctctccactttcagctgcttgtgtctctacccgctagggtcttggggtttttataggcacaggatggtagggggcatggtaggctaggttggtcttgggaaatgcaacatttgggcccaaaggctggagtgcctgtcctcacctaggtccgtgggcacaggcctgggggtggagccctcgccagggactcacccttctttacccagcacttcccagcatcccttacatatcaactactgggttccccagtcggcttccttgttcagttgggggacagtaacccaccagctctgaaaagtggtaagggaagggacccactcccctagaaatctagccctcggttcagtcggcccctaagggagggggatgtagccggctaaagcccctcttgggtcaaaggttgggtcaaaggaaacaggagcactgcgctagccactgaagggggcgccaccaaagccagggaatggttgtcgagaaggggtcatcgctcacctctctcatccctcttcagtgtactgttgcggactcgaaggtggctctccccagcggaaccgagagagtgtgggctgaaagagaccacttttggggcttctccagcaattccactcccactgaaggcaaacgcgctgaaggagggcactttgcagacttttccattgcttctgcccttgcccctaccttctggcgctcactcttaagtgccacctactgggctgcagcctgaattacactacaaaacaaaattacatcactacaagaagcaacgtctcagccaccgcacaaacttatctgcaaccaaggaacccatacagagccttggcgccctgaaagcactcagaaatgaagctgatccacccatacacattttacaccacagtcatacccacaagggaaaaaagaatttaaaatcaacaagctccatccaaacaatagcaaattcaaaaaagaaaagaaaaaagcatcagctctctcagatgagaaggaaccagcacaagaactctggcaatacaaaatgtcagagtgttttaccacctccagagaatctcactagctcccaagcaatgaaccctaaccagaatgaaatgtctgaaatgacagatatagaattcagaatctagatggcaaagaaactcaatgagatccaagagaaagttgaaatccaacacaaagaagccagaaaaatgatccaagatttgaaagacaacatagctatattaagaaagaaccaaacacaacttctggaattgaaaaattaactatgggaatttcaaaatacagttggaagccttaacaacagactataccaagcagaagaatgaatttcagggctcgaagactagctttctgaatcaacccaggcaggcaaaaataaagaaaaaaataattttaaacaattaataaaaccttcaataaatatggggttatgtaaagtgacattggcatttctgagataagagaaactaagcaacttggaacacatatttgaggatataattcagggaaatttcctcaatcttgccagagaagtcaacatgcacatacaagaaatccagagaattcctggaagaatactatataatatgaccatcttcaaggcacacaatcatcagactatccaaggtcaacgtgaaagaaaaaaacttaacggcagctagagaaaacagtcatatcatctataaagggaaacccatcagactaacagcaggcttctcagcagaaaccatacaagccagaagagattgggggactatttttagcatttttaaagaaaaaaaatgccaaccaataatttcatatcccaccaactatacttcataaatgaaagagaaataaattctttctcagataagcaattgctaaaagaatccatcaccaccacactagacctacaagagatacttaagagagttctaaacatgaaaacaaaaggaaaggatgatccttgttaccatgaaagcacatgcaagcagatagcccacaggccctaagcagtgactgaatcaatactacaaagcaaccagataataacactatggcaagaataaaacctcacatatcaatattaacttttgcatagtcaaaattaatattgatatgtgaggttttattcttgccatagtgttttaacataaaatattaactttggccatgcaaagttaatattgatatgtaaggttttattcctgtcatagtgttttaacactccatttaaaaggcaaaaagtggcaaattagactaaaaacaagtctaacttcaagatacccatttcacttgtaatggcacccataggctaggctgcaagtaaatggatagagaaagatctatcatgcaaataggaaacaaaaaaagaacaaggatcactattctaatatcagaaaaaatagacattaaacaacaacagtaaaaaaggaccaagaaaggcattacataatgataaagtgttcaattcaataagaagacttaactatcctaaatatatatatgttcaacattggaggatacatatttataaaataattgcttatagacctatgaaaagactttcatggccacccaataatagtggggaacttcagcacacgagtgaaagcaatagacaggcaaaaaactaacaaaaaattttgtatttaataaatttgatagttggccaattggacctaatagacatctatagaatactccacccaacaactacagaatatgcattcttctcatctgcacatgatatatattccaagattgaacacatagtcataaagcaagtcttaatacatttcaaaaaatcagaatcataccaagcatcttctcagaccacagtggaaaaaaaacagaaatcaacagcaagaggaattcttaaaaccacacaaatacaggaaactaatcaacttgtttctgaatgactctaaaataaacaaaaaattaaggcagaagtcaaactgttatttgaaacaaacaaaaatagagatacaacataccaaaacctctagagtacagcaatggcagcgttaagaggaaagtttctagcactgaatgtctacatcaagaagatacatctgaaattaacaacctaaaatcgcacctaaaaaaaaaaaaaaaacagaaaaacaagaacaaaactaaacctagagctagcagaaaaaaaagaaataactaaaatcagaacagaattaaatgaaattgagacccataacaactatacaaaggatatacaaaatgagaagtttgttcttggaaaggataaaaaaagattgatatactgctagctagattaacaagaaaagagagaagatctgaatatgcacaatcagaaatgacaaaagtgacatcacaaccaatcccatagaaacataaaagatcctcagagactactatgtacatctctatgcacaaaaactagaaaacctagaggagatgcataaatttctggacacacacaacctcccaagattaaaccaggaagaaactgaaatcctgaacagaccaataacaagtaatgaaattgaatcagtaataaaaaacctaatgtccaaaaatagccctgaaccaaatggattcacagctgaattctaccagacatacaaataagagctgatacagatactactgaaagtattcaaaaaaaaaaaaaaatcaaggaggaggaactcctaattcaaaaccagtatctttctgataccaaaatctggcaaagacacaacaacaaaaaccctacatgccaatatctctctgatgaacagatgcaaaagtcctccacaaaatattagcaaaccacactcaaccaatgagatactatctcacaccactcagaatggctagtatattaaaaaaatcaaaaagtaacagatgttggtgagactgtggagaaaagggaacgcttgcacactgttggcaggaatgcaaattagttcagccactgtggaaaacagtttggagatttctcaagaactaataatagaaccaccatttgaccctgcaatctcactgctgagtgtatacccaaaggaaaataaaccattctaccaaaaagacacctgcacttatatgtgaatcacagcactattcacaagagcaatgacatggaatcaacccatatgcccaccaatggtgggctggataaagaaaatgtgctacatatataccaggaaatactatacagccataaaaagatgaaatcatgttccttgcagcaacatggatggaactggaggccattattctcagtgaattgaaacagaaacagaaaaccaaataccacatgttcttacttataagtgggagctaaacactggaggcaacacggacacaaatatggaaacactgaacaactgaggattccaaaagggtgggaggagggaggtgagcaagtgttgaaaaactccctatggtcctatgtcactacgtgggcagtgggatcattacaagcccaaacctcagcttcacgcaatttacccatgtaacaagcctgcacgtgtactccctgaatctaaaataaaaataaaataagaaaatacaataaagagatccctctactaccctcacaggactggccattgtatcatttcttttggtacagttcataaactctaaccctttatttcttctttttttctccccttctgatcttctctctttccacattttcactttcagtgctgtatccctttctcatttttccatattatagcctcacctgctagaccaactaatttttttcttatttaaattccaaaattgaattttctaatcagattcacattatcacttttgaatctcttatacttggtcttcagaagtcctgaatgtgaaatccaaaccctctctccattcattgtattctttttaacaataacaaaattatatctttgaatacttgttagagatatattcctcagtcagtctgccttccgattttcattacaatttatcatgtagtcatttcttagtttttagttgttgtgtagcctaatctgtcagctgttttctcccaataaaacaattcaagagcatatcctttatctgtgctgggatatggagattacataatacatttggggttcagatttgtttacttcaacaaatattaagcatgactacactaggtagagtagatatattaaagaacagctcctgaccttaaggagcttgcaacttttggagaaaaacaaagacatgcacaaataatttggatattacacagcaaatacagcgacagacatgtatcagcatatgagagcacagaggaatgtattaaatacatcttggaaggcaggaaaatgaggaaatgcatccagaggcagaagaaagaggcagctggggaggaaagaggaaaatagactttccagacagaaaaaacccagcagttgtgtacaataatatgatgaagatctaaactagtgtagtcaattgataaaaaggaaaaagcttaaaaaatattcagaatataaaatcagcacagtatggtgatggtgactgattggagacactacctaactacactggggaaagactggcacagcaagagaacagggaagcgatgtgcattcatattgataggctgaggctgagctgctaattggaatgtcaagtggaatagatagtagaatgtctaaatttaatgggtaaatttatggatgaagataaaacctgaagatgcatgagaatgtttatgatagctaacattttgctcttgcttgcagtttccccaggaatttttacagtgcctttggagactcagagaaactgtcttgttctattaattcctttgcctcctttcactagtgttctccactaaattataatctccctaaagattcatgccatggtttctttacctttatatccctcctgtctcctagcatagtgcattactcttagaagagagtaagcactcagtaaagtttattattgaaaggtcctcaatagcatgaacatataactaataggtagattaaacttatgtggaacacctgtggtcaacaaaatacctatatgcagatgttccattaacagataagtctttctgagatgattaaagcaaagagaaagaggtctgacatttatgacatgactttcagatttaaagcactcaaatagttgtttaaaagaacagatctctgtttaattacctccaaccaatggaggtattagatcacattcagaaagctttaaacatggtgtctgagcaataggaatttcttccatattcttctacccaattaaaacttggggtgaatactgaaaagatggagatatatctaatgaaacataaatttaaaaaaagacattttattcactttgggacaagatcaaaaagacttagataattattttaattcaattaggaaaattgaaagcaccattattttccactcagataatttctttattccttaaggtagtgtgtgtgtgtgtgtgtgtgtgtgtgtgtgtgtgtgtgtgtgtgtgtagtttgttttatctctttttttgtaaaactctccttagggaatattgcaagaattgtttttcttgatataaaaattaaagcatggagaaattccagtgaaaaggaaaggacaaactaacatctgattccacactatttctaattctcaatcacaatatcttgataggatagaggtgttttgtaggagattagaaggctttttttttttttttgctgaaattgcttttacttgatttcttttgaagagttgatctcaatttttaaaattgtcatttaaatgctaagttctgtattaggagaaaataatctagaagaatctaaagacaagtgtatagccttaggtaaagcatcagaaagcataatttaaagagggcttgctgtggaagacccttcaattcagtattattcagagtagcaaaaaaggttaggctacaatattcctgagtgttaatttcatgctctggagctcttaggtaattttacagagtatggcaaagtgataaaagttcaggaggtccatcatctataactacttctgtagaaatataggggaaactgtaattacatcctcagaaacttatgctttcaagtaaaaggcaaataaaattagtaaaataacttcatgcaactcatggctatccagaggcagctttattcaatggaagtgctctcactgctggttcacagcaaaggttcccatgacaaccaagaatacacagtacagtggtgatgctgtttgcccagggatatcctgtcattaatataaataagtagataacgatatctagtctataggtattatgatccacagctgtctataaatgacaactgcagagtagaatggaatgctcagaactgagtttattccaagttcaattaaagttttatttccttactttctaaaaacatcaaagtatatgcttctaaattattctactgtgtttcactataattttcaagtttggtttcatcctggattatgacctttcagtgagctgggacagtaatgtggccccaggtatggtgagtaagcccacctgaaatagaaggtggtttactttcttgatatgaacaaaggctattttggagttggaactctccagaacagttaaaatgcatttatatctaaaggttcttaggtgtaaaggaacatacatatgattttaagcatatttctctactagaagtcttataatatttcttatctgttattctgtattcccatgtttcctgaaatactgtgaacttattaagacaagaacaaaatgtcatttacttttatatattgggtctaggatgagttggtttcttttatatattggggtctaggattacttgatttcttttgaagaatccttgtagaatgaaccaaaagataacagataaaaatatgcaatcaataaatgtaatagcatgtgctaaatgtcatgtgtaccagaattaacacttggcctatgagagatacagagtaatatagggcccatttgaatcctaacactgatttgtcatcctgtttatttaagaaagttacatactatagtatttcataatatagttgaacaaagtatctgttatatacatatgcacattaagccacaattcattttgcatttgtaagaaattcaatattattttgagtaatttgaaggaaacacaattcttacaatttgcataactgaggttcaaaaggaaagtccaccatctcaacccagttaaatttggctaactagtatgtaccaatcaatataaacacgtgctttaaaaaagttaccctagttctcattcctaggaaacatcagctgtgtagcaccgggattcatttctgttctcatacaatttaatttctgtaataaaaaatctatgtccattttttgatgtgtcattgctgatagctttaaagtgttatacctctctcttcccctctgtcctacatttgggaaaactgttaagaaagcccatgtgttctctcctttggtgatggtgggaaattcaaaccacaccagagtccacccacacaaaactctcagcatggcctcacccactaaaagtcataaaatctcaaaccagtcattttccccctgctctctcaagctacttcagaccttcttgggaggcctgctctgctctccccagaaaaacctcataattttataagtaatacatactttcatactttcttggtaggggtatatgtgtgtgtgtgtgtgtgtgtgtgtgtgtgtgtgtgtgcgtgcgcgtgtgtttgtgtatgtgtgtgtgtgaaagtgagagagagagaagtgtagggctgctcattagtcttaacatttgaaccatattttgggtggaggcttatctgaatccacacaatggatacaacagtttcatcttctagatcttggctatttggttctcctcttctgctcctttctttgggagggaagtaaaaagctaaaatatgcattcccaggttatgcatagaagctaacctaagggaactgcagctttaatacagcaaaaagaacccagaggagagtacagaactgatgttattattagcagaagttgaaaacattcacctgcctaattctgagttggctctggcatcaacagtctttctagaatttgttcaaacagcattattagcagagggtgctgagaagagcagattaccagattactctttttatgcctacattagattggcctcttgcagtgcatcaatataagggtatgtggtatcatttccaagatgaatgttaaggaaattcacacggacaggggaaagcaggttttctacacttaaatagcacattctcaagagggaaaatgtcaacgtatggcttattcatagcacaatagctgtttaaactacagcttagaatctactatgtgccaagcactgtgctaagcattttacattttgcatatatcattattagtgccattttactattggaaaccaaaaacagatccagcagttgtcagagatagaatttcaactcagacttacctcatattcaatgtctatattctaatgaactcattctaagacttcagatttacgttgttaagactatgaagctttttgcttcctgataatctctgaatgtctaataggcctttatagctggcaagcttaggaaagaagcacatttttttttctgctggaatgtagggagatatctgtcatagctcatagatgaaatatataaaaacactacatggtatccattattcatttcagctccattgccctaaagaaacataacaccatgaatttagatgtagcaagacaatggaataaatgcttttaattttttttcaataattatgtcaaaatagatattctgggaaccgtgagaaagtagaaagtgtagaagtcatgttgttgacttcaacatgcttacaatatacctaacatatggctcagtagtttgtctagttgttaataatttgaaacattgatttgctaaattaatataaatggtttcacattacaagtaaggtaagtattttaaaatactaacttttcaagacttcattttttagaggagtgagattcacagtgaaattatgaaggtatacagatttcccatatgtaacatactagttttcaagcattaattttaataattcttatatcctgagttagcatttaaatttattttatacccttagtctttggcaaaaaaaatgcttctgcttaaaatagcttattggctaagaatccatcattttaaagaaaattatgcataatcaacaggtatatagtttaaatagaaaacagcagggggagctcaaagacaggttggacaaattaaaagttgacttcaagagtactgaaaaattattttaataaaaatttgaagagaagaaggaatatactgttaaattatgagatgatattttatacaataatttccagcaaaatagctagctaaatggaggaatagtttcccatacagaacacttcaaaagtccagaaaaaaaaattaatgcacagaatcactagacatcagtgaagtgaaaattaaaattacaatgaaataacactacatattactcaactagaatggttaaaatgaaaaagataatacgaagtgttgacaagaatgtggagctcttagaaaatagagaatattggttggaatctaaattgaagaagctacttgagaaaactgtctgtcagtcttcaaaaaatgcatgcctcataatcaagcaattccacttctggctatatacccatcagaaatatatatgcattatacaaaaagatgtatacagtaatgttcatagcagcatgatttgtaatagtttcaaataaaaataaaacaaatatttaccaataataaaatgggccaggcacagtggctcacacctgtaatcccagcactttggcagactgaggcaggtggatcatttgagatgaggagttcgtgaccagcccggccaaaatggcaaaaccccatctctactaaaaatacaaaaattagccgtgtgtagtggcaggtgcctgtagacccaactacttaggaggctgaggcaggagaattgcttgaaccctggaggcagaggctgcagtgagacgagttcgtgccactgcactccagcctgggcaaagcagtggaactctttctcaaacaaaacaaaacaaaacaaaacaaaacaataaaatgaataaataatttataacatatttgtatgaagatgaaaatgaactacaactacatatataaagacaaatgttcctttaggcccaggagtttgagtctagcctgggcaacaaagcgagacccagtctatacaaaaaaataaaataaaattagccaggtgtggtgtcatatgtctgtagtcctagctacttgggaggctgaggcaggaggactgcttgagcccaggagtttgaggctgcaatgagttatgactatggtactgtactacagcctgggtgacagagcaataccctgtctcaaaaaaaaaaaaaaaaaaagaaaagaaaagaaaaaagaaagataacttttccaaatacagtgttgaggaaaagaagctagagaacaaagaacacactctctttggtaaataatatgaatattatcttagaaatcacaatagtagttactctggggtgggggcagaatctgaaaggtacacaaatgggggcttctacagcttagcaatatactgcctattaatctaattgctgcttacatgggtatgttatcttcatggaaatttaccacattttacatttaggtttgtgtgctttttcctcttatggtataattcaacaaaatttgctctaaaattatactggatgattgctttaaatcattaaattaaaagtttttgaggcttgaaattaagaaagcttggtcccacagggataactaagtactagaattgttttttgctttgtttgtttttttgtttttttcctgaaggcatttaccaattctttgggttccagggcaagaatctaaacaaggggcctaaacagagaaagaactcacattcagacttcacagaaagtcttatacccaaaagtcaatacctataactaggcatgctacaatctttcatgcagaacaagacttgtcttggtttcaggcagcatatttaaaacaaatatttctttcaaaaatttctaatcacaagtgtatacttgcgatatgtaatatggcattggatatttgcgtggcccaaaagttgaacatttcatttaaagtaaatctatagttagcagacatgcagttacttaaattataagcaaatcctctttcgaaaaatacactttcaacacagataatttccagagataaaatactaaagagtatgagctcacatatgtaaaaaaatatagaaaatgcataaaaaaaataaacttgcctgagagacaatcagtggaataaactgcacaggtagaccaacaagattacagatattggaactatcaaggaactaaaataaaaaaaaatatttaagctgtttaaagaaatgataaaaaatttagtaaatgagcaaaagacaataaaaatcaacacacatatttagaataaagaccaatagaacttctaaaattgaatgtctaataactgaaattagaaactcaacaaacaggtgaaacaacaaattagactctactgaaggttgaattagtgagccagaaaacatatatgaatgaaacattcagaatgcagtagaaaaagaagtggaaaatatgaaagcaaggttaagataggtgaatgacagagtggggccaacataagtcttactagggttgggatagattaaaaggaatggcaacgaggcaatatttgaaacaataatagctaagaattttccaaaataaataaaagacaccaacactcatatttaggaataccaatacattttaagtaaacttttgaaaaactcaacttctggattcattagagtgaaattgcacaacaacaaagataaaaataagaatttcaaagcacccaaaaagaaaaaagtaacactggtcagactgaaaagtgatttctcaaaagacaaggtagtatcgtatttaaagaggtgaagagaagtagttgtcaacccagtaatgcatacacaacaaaactaccttccaagtctaagcacaaaataagatagtaagaaaaccacacatgaagagaattccctactattggagagtcactagagaaacttctaaaagacatttttaaataaaaaggatggtctcagatgcaaaaaaaaaaaaaatgctgagcaaagaaaatggaaaatgtgttagaaaatgttcaccaaagatgacttactacaactataataataatgataatgtctacaatgtaatacaaatatgaagagaacaaaaatctattcttttgtattttctcaggaggacagtaaaagggtaaagatattatttaacttcagccttaagttacatatttggaaaattttttagggttattattaaaataatagaattagagtttaaaacttacaaactagaaggaaaaatacaatgagaaaagggaggaaatcactttgatctaaaataatgccagaaaagacgtgaaaagaaaacaaacattagaaagcaggataaataggaagcctaaattaatatttttgaatattataattatattataaactttataattttatattaagttataaatatataaaatataggtttatattataaactttataaattatataaacttatatataattatacttttgaatataattatattttttgaatattataattataattaatccagtgttcatgaattaactaatattttcagtttagtttcaacaatgtcaaagaataggtactatacaaatatctcttctgttaaagatgaacaaaattagaaattaataacaatgtatttatttaaaaactcattcctttggaaaacatttaaaaagtacttctaaataacacttgagtgagagaagaaatcaaagggatttataaaatacttaaaacttaataataaatatattatgcatcaaatatatgggattgtcactaaagcaatagaattaaatcactgtattagaaataaaggctaaaactcaatgcacaaagcaacttacttagaaaaaataggaaaataaacacaaaaaagtaaaggaaaataataattataaaaacaaatactaataagagaaaatacagtaatagaaattcaaaaacaaacatgaatatactaattaagtagtctggcaatttgacacaaacgagatacagaaatagaggaaaagagaaaacagcaacaaaaaaattttaaagagaaaagagaagaatgggcatagtataagagacagaggtagagttccagataggtaggtaggtagctagctagttaggtagacagaaacaaaggtagagaacatcttagtagagatagacagacatagataaaaaatagtaaaaatttaaaggaggcatgacttacctggaaaaatatagagacagaagatgtaaatgaaagaactatttcccaggtatatggaaacagcaggaaaatgtaatgcatcttggagaaatcataagggtctgagtgaaaactctttagttaagtgaagcaaaaggagcaccagtgaaaagtggtggcactagtgattccagcagataggcaaggagatctgaaaatataatttctcctacttaaaccgttttttaaaattctttctgtttcactgtaaaacttaaatccaagtaccggtgatcgtaagatttaattagagaaaaatagaatttgactcatttgtgatgcaagacaaaataaaataagattaataagtaagttatcaagcaggtcttactcaaatagcatctttttggttacaaaatgacaggggacacaaatatgattgtagaatttgacctagtaatcccagttcttaaagattattttagtaaaataaaagcagtttaatttaaaagataaggaaaacttctaaggatgtttctagagccatcatttctaatagtaacaaatgagaaaagaagcttgaacatcaaaaaatacaaaaagtttcgattaagtcagaatattatgtagtaatcaaaatgatacatgagaagactgtgtcagaagaaagagcaatatttaaggaataataatgtggtttagaaagtaagataaaaagtatacaattattattatagctccattaatatgcatataaccagtcaacattgggaaggaaaaaagaaaataaaagtggttacatcttggtagaatcatggcttaagtaattttcaaagtctttttctatatataattaggaactaataaatcttttaaatattctacttgtacttgttgactaatatgcacaatggtagcagggacagaccattagcttttacattatttttgtgaattcataagaaattcacaaaactagaaaacaagtataaaattccttaaaatgagctatataagtagagtagctatgttgcttttttcactttgataaatatgaaaatgaataataattttcaaaatatatagaagagcacaggttacaaggaagtacctgctgtatctttataatgaacagtgtccagtcaattcaatttccttaggagatagaagaataggccaagttacagcccgttggacaatatgatttcagaaactttcatacatgattagcaatctgaaaacactgaatttctgttctatggattcagcactatatgataccattctaatgaggcttttaaaaaatgtggtaatttgaggtctgaagtgggttcaaagatgtaacaaagtttggcgctccagaacataaacaaaacataacacaggtgtggatgtctaaacttttgactgtacccaatcttaacatctggtttttgtgctcaactgctcacagtcatgtaaaatgtctcaactgttaatgactcagtgttaagtgagaaaaaagaaaaattaaactctgctgttgaataccatgttgtaaaatcctcatctttagagattctaaaaatattcatagactacacccttttgaatgctgtggcaacttatcccctgaaaggagcaggctaagccaagtgacatgaagatattttctctgtttccattaaggttatattcctctctgggtcagtcaaatcaaacttgtagcacgcatgtctaatgcagaatcactgatcaatcaacgtgctcttttctgaggagtcatggagctccatatgccttatgatatttaggacatattccaggaagctaacaatcaatgaaagcttttttcaaacagacttaattaaagagaagatgaatagatgaatgaacttggggtaaaggtgttcaaatgtctctccaattttacttcaagaatgtttaaccccattgaacttatcagttttggttttatcaaaccaaaattctggatatacagatgtagggttcatctttattgaagggtttaatattggatttcctatttcaaaggaatggaaactgaaaagataatattaactcagaaatcagttgacagatgtcaaatcaaggaacatttgtaaaaaaaattagactaatgttcaagtacagatagagacattttctgtaataaaatcttatcacagaatagcaatgccactgaacagacaagtataaagtaataccaaggacaaagataaaaagttatttctatttttgaaaagaaattagatgatgtctagtttaaaaaaatatgtcaaggtataagattccaatattttatttgactatacagtttaggttgtttttcccattaatgtagaagcacattacatatcgttttcaaagtctaaatgtgttcttttttaaaaaatgataaatatgaagggcaaaatattcatcttaaaccatgagataaaaatatagaggtttttcatgccgctatctttttggtaatcaatgattgaatagtgaatattggtttacagtgcagctatttaattattaatacatttgttttttcttagaaggatttaatattatttttacattttctccactaaatatatcatttcaaaattatctacaggaatatgcccaaaagaatgatcaaagcttagaaatattttgcaactctgtatcatattgagatataaaaacagaatcaagaatgatattgacaaaaatcaggttagcacatcatctagatgataggttttcaatctcctaaaaaataatgcattacattaattatgcatatttgagctttaatgagaaaacattgtaaggatgaacaaaatcctttaacatcagagctgacagagaggtgagagactgcctagttcaacctcctttcacaaatgaggcaattaaacctgtaaaagactacatgatttgtgcagttcataaccttcatgagcaggctaatgtctcctgtattttcttctgtaccctaatatctacgtagcatagaaaaaaaaatctctttgaattgttaaagtaaaatgtcttacattgaaaggcagtacttccacatgctaaagagtaagtaagaatttaagaaaaaccatgaaacaatgtgaaagaaatcaaactgagtggtaacaaaataaacacgcttcattgtggaccacaggatttcatgaaggataatgacagtctttcccatgtttctgaagttcgctgtaaagatacaggtttaaatctcagtaagagagattgagattcaggtataaaggaaaacttagagcgaaagtcagtatactagggccaaatgatttcctgaaaggttatgaaaatgataggcatatacctattagtgaattatgctaaatcactgcagaattcagtgaaaggtatacactttaaatgaaatcatgaagcaaattaagcttttgacataggccattaagtgacaaagccaaggtaagtgtttacatttttctttttttttttttttgagacagagtcttgctctgtcgctcaggctggagtgcagtggtgcgatctcggctcactgcatgctccgcctcccgggttcacaccattctcctgcctcagcctcccgagtagctgggactacaggcgcccgccaccacgcccagctaatttttcgtatttttagtagagacagggtttcaccgtgttagccaggatggtctcgatctcctgattttgtgatccacccgcctcggcctcccaaagcactgggattacaggcgtgagccaccgcacccggccttcatttttcaatttagaatctcggtctaccacctcctcttgatagggagtgggaggctgttacaaattactaggggccccacttttctcagtggcctcaaaatcattttatttatttatttatttttacctcactaggatctaaatctgtttttagtggctttgaaaactgtttctaggactgaactactgaattacatttaagattgaactagtgaatcagtgactaaacaaaacaaattttaggaaaccattctcttcattgttcaacagacaaaaaccaacgaattttatcacttactagctatgtgactttgggctagttatttaacctccatgtacctctgtttcttcatcagtaagatgctgattataacagagtgtgtctcaaaaactagtataaaagtgagttccatgtaaagagcttagaataagagggtatacacctaattcattctataatgaaacttaaaaacattaagaatcctcaaggattacatgaagccaatctgaatcataaagacaggttaaaaagtctaaaccaaatgttagcaaataaagcagcaataaatacatatttttctatgtacctatatgtgtatgtatatttgtgtgcatatggcatgaaaggctttaaacatgagatgttctaataattcacaatgttaagagattaaaggggaaaaaccacagaaaattattcaactaaacaaccattcacgataaaaatgtatggcaaatttggaataggaggaagttaccaaaactaatcaaagatatctaatcttgatggtgaaatgtggaagcatgctctttaattgtagacacaagtaaagaatgcttgttctctccatttctatttaacagtcttttgaaagcattgctttttttggacaagtgtcctcactgtcacctgggagcttgttagaaatgcaggttctcagtgcctgacctaccactgaaccaagatcttccttttaaaaggatccctcagggattcatattttaaagtcagagaagcatccgtgcagccagtcaataaatcattttaaaaagtggtataaaatatagagtataaaaattggaatggaagaaacaaatttttgttattcacagatgatacgattgtctacaaagaatacctaaaagaatcagaagaaacatcattaaaagtacatcaaagtttgaaaagtttctaaatatttgttcgatataaaaattattagatttggatatagctgcagcaagcatttggaaaatataactgaaaattgttgccattttgtaatagcaacagaagtctacagtggatgtgaataaaaaatgtataagatcttcgtaacaaaatgtataaaatgcactgaataacactaaaggaggcaattaatagagggatacgccacaattatagctagaaaggtaaagcagaccaactgtactgatgcgtgtcaaaggtaacactaccagtcagtggaaaaatgatggatcagtcaatcgatggtgtggaaataactagttagccatatgggaaacatacaaaagtggatttcttctcacactgcacacagaattcaattccatatgtaaaagaactttacggtgaaataaaaaacttgaaaaatttttagaagggaaacattattttaactgtgattcatgaactatatgatagaatgaaaacaatgacattttatatcatctgggacattactagatgtaaaataattaagtttattgacctctaaaccagcccaatagggaaaaagggagtaaaggggagcatcttctaggcaaatgatgttcccatacatagacttgccagagcatttgcaagattccctttagaatcgatgtttggtctcttgcctatccctcctccccaggcagtcactttctctggattttttttccctctttctttagcttttccttctcagtcctggcaataggccttcaacaccacaccatcaccactccaccaattctggagggatatgattttcaaaggaacaaagtttttggagttgagttccagcactaacatatgtatggacgaagataacagtctacagctttctgttttcctccctattgctctagaagaaaacgctgccaagaaaaagctacttctaattttttcatagaaaaaaactgctactaaagtatttttttaagaatcattcttttcttcgggagaagatatttccaacacttgttgtgatcaagagaaattgcagaatatttttaaaattcttaaaaatcaatcagaaaaaagagtctggaagaaatttgaggaaggcttagaaataatttttatagaaaaagaaacatgaatcactaacaatatttttaaggcttaaatgtattatcagggaaattaaaattaattaaaaaattagtatcatgttaccactagattgacaaaaaatttgtctttcaaaaaacacgagagcttttataaactacatgtgatcacatattctttctccaatactccttgagaactactagattataaacatacatacacatacataggcacacacataggcacacacacacacatacacagtcatttaaggttaaaatacggtaaatattttctaagtcacttaaaattattgcctgtggatttttcatgtaaaatattaaactcttccaatgtttgaacttaatggttattgagaaatacgaaaaactattagctttcttgatttaatatagttaatattgcttataaaggaaagaaaaaatgcttggctacaaggtcatctcattttaagattacattgattaaacatgtagtatagacagggcatctaacccccatttcactagccagcactgaaaacttctttaaccttgcataaaatgcatgcatattctttgaaagtctttttttgtaaacgaagtattagatttttaatgtaaattataagaaatgtaatgtttactaatgccgtcaagaatggcaggtcaaattcacctggtttttaaagatcaaatgcctacttttacagtcacctttcaacctttgttttagactctaggattcgtttgtcacaggtttgcctatttgggccacagcttccttatatagggtacagagcagcattcaaaggtagtgtttaagtatatggacttgggtgctagatcactgtgcactaacacccagctcagacacttactagctgtgtgacctggggtaacttaacagagcctcattgagctttggtttcctcactagtaaaatgaagctgaaaggaggatatatttcatagggttgtagcagttacatgagttaaaatacctgagctatttagagcagtgcctggttcatagcaggtgatctaggagtgttattgttcttcacgttattcacatttaatagcaaatcatactgcaaaaaatggtgtcaatgtaatggtcattacaggcaatctaagttgcttttgctcttgacagtattttacacctttaaagtttccagtaaaaaagataatgctaataccatttataaaacagaagaacaaagaattccttgacaatttaaatatctaaatttattagttaaatcaattaattatttgttgttgctgacttccactaaaatgtgcctaatcgttttatgaatgtcttcctattccagtcagtatttttagcaggtttaattctcaagcattccaattggatgtgctggaatttggctcctattaactcatggttttgtcctagtgattaatttatcctaccagattgaataagtatatatgtatgtacttgtgtgtttgtgtgtgtgtgtgtgtgtgtgtgtgtgtataaaatttacaccagtggcaaaaatagtgatttcattttgccagtttgcaaggcaaaatgatgtttgctattgtatttcttttgctaaaaaaaaaaataaagcacgctcgagtatttttactgtctgcacactatttaacctcatgtcttattgtgtagctgagtcatgatgaatacaacaagcaaacatccttaatgttctgttttgtcagtgctgggctgtgcactatggtggctgcccaggaggaggggggcaggacatgagcactcacatcaaggatcttatatcaatttaggaagatagaactaaaacacccaaaacaacagtgagcaataccaaatggtttcagttcaacccatgatagtgtacaggagtcgaataaacaacaggaatgaaagaggggaagatggcaatagtcagggaatgtttcatggctgaaggggtcacttatccccaattcaggcattcgactaccagcttcatgattctgccatatccacatttctacatcatgatttttgttgtttctgcatcccctatatactattattaattttaaaaattctgtaatagactagttttttaaaaactgaaataaaatgtcttcatttaaagaagaaactttatatcacaactataaatggaaagtcagtaactcttgccataaatgcagcataaacagaacaaccttattagtttctatccagataatgttgccttcgaaaggcactaggctacaggccggtgttatctctgtttataagacaaagcaggtgttaataagtgttagagacttagtaaagccaacatgagactttctgctgtccttccttcttccctaccatctttcttcccttcctttcttctttcaactttcctctttctctctctccctccttcctcctcttcccttcttccttccatcctttagcaaatattcattgagcacctattatgtgacaggtaccattctaggcacagaggatacaacagtgaaaaaacagaaaaaagcccttgcccttatagagcttacattcttgttggatgaaagcagtcaataaacagataacaaaggatacagtaggtcataggtgctatgaataaaaatacagcagggaacgtcaaggtggaagaaaaagcatgaataggaaaggattactgctaaagtaacatatgagcgatgatctgaagggcaggatggaaccagccatccagatacttagaggaagagaattcccagcactgggaacaggtagtgcaaaggctgtgatgcagaacatgcttggcacattcagggaacaccagtgaagtcagagtggagaagtgagtgggtgaggcggacagtggtttgagaagatgtcagatccaggtcacttgaaaggggcggtagacatagatcatgtagaagtttaacagacatagcaagaatttgactttgactctagatggcatgccattggatggctttgagcagagagcaacacgatgtgaactaattactgtttttgtagaataactctgctatgagattagactggatgggcaaaagcaccagtcggaaaactggttaggagggtatttccattaatttaagagaaagatgagagaacagtcatgtgggaagcacaggaagtagtaaacaatattggatttgttgggcaaagtgtatccaccaccccccaaatacacacacacacacacaaatctctatctcagcacttatgtatttatggtttataaatgaggctgtttatgggcaggacacggtacctcacacctgtaatcccagcttttttggaggctgaggtggggggatcacttgaggtcaggagtttgagaccagcctggccaacatggtaaacctcatctctactcataatacaaaaaaattagctgggtgtggtggccagcacctgtagtcccagctacttcgaaggctaaggcaggagaattgcttgaacctgggaggcagaggttatggtgagccaagatcacaccactgcactccagcctgggcaacagagtgagattctatcaaaacaaacaaacaaacaaaagaaacatgagaccatttatggggatggggctgttctccctgccccaaatttgttgtcagtgactggcaatcatgccttattcatctgtaaaccttactgaccacagtgcctgataaaggtgcttaaaaagttggtgcgactgaatttcagatgagtggaataatgaaaggcacagaggaaagaaggctcacagtaggtatttggggcaagaagatctacgtgggaagtgcagaaaggcatgggcattgtggtgaggcacctctcagagaaaccgaggttcacattagaatggatttcacgtgaaagaagtagaactaagagaagtataagaggagaacgatttaagatgataggaaagaggccaagtttcatggaacctttattaaaaaaaaaagaaattccatataggttagatttaggaaatcaggattcggaaagggctaggatttactacataactttcattctgaaatccttacatttcaactatcaattcactgaataatgtcaatattttattttgctgcttttaagagataaaaaagagctgttcataactaatggaatatgtatatgcacacatacacacacacatatacatatatacacatatatacacatatatacacgttgtgtgtgtgtgtctgtatgtgtgtatatatatataatgtatatgaaattcctcaatttcaaagactggaatagaaacgttcctatagatatacaaggatcatttatactcctaggatgaagagacatgcatcatgaaggtttacttgggttaattaggtatatttcaagggtgattaaggaacaataggagatcactaaaaaaaaaaaaaatctctgctgcaaaataaaactaatggaaaactgaggcaggactaggacagcagtagagaatgatgcaccactgagaatgggggaagaggaattaaggcagatagacctggaagaaaggtggctggaggagcagatatcttgtctttacatcagtgcattcctgatgtataagggagacttggcccatcttgcataaagcagtcaggtcagagtaaaaataaaaacagatgtataactgcccagtctcttgctggaaacgtggagaccccaagtcttgtatggaagggagacaaagtcaacagctatttttgcaggtaaaagagaggatttttttgtttcctaatccaggtcatcctcatctcttgcctttacttatagacacagctttctaattggccttgcaggtcaacacttgcccatctgtgcaccattcttctcccagccaattactggcctctaaactatttttgaataaatagcaaatcttatattatctgtttcaacctcatttcctgacactctttccccactttaccccaaattgcataacttcctggttaattctttaaaagttgcctgttctaacactaacttcttcctccctccccaacccatctctacagttaagtttatgtcctcttcttatttgatcctgtagcaccttccacctgtctgttataatatttgatacacttgtaattctagatctgtcaccccagaatgtagaaaagtgtctggtacatggtaaacacttaatatttgttaaccgttgaaggttgaatgtttactattgatgaacatgaagataaaaagatagtagccgacaattattgagaatgaaagggtttttacactaatttacatttcagataaggtacagctttcattgagatttaaaaaaaactcaggtttgaaattattatagaacattgtataatttcccatgttcacaaatttaaaaaatacagtacactttaaacaaaacagagttcacataaagcatatttgataatcagctcagctccttggtgaaaaaaactaaaatttggaatagttaattgaatggctatcatttaaatattttaaatacttgttcttgaactataaataaccacatagaaatatgaggaaaattaaatttaagagggtgtttatttggagaggaattttaaaacaagtcttatgaatcatggtaaatacccttacaggtatactcagggcactggagtgcactttatgctccaacaaacccaagacttagagacagttgctagctgcacacaaacagtgtcactgtccactattttacacaaacggcaattgagtagcaagggaaggtgaattcctcagtcctgagttacttctgggtgtgcctcagatgtttaagctgcacattaactaactcatttaggcccccagagtaactattaatgtaccaaagctacaatttgagaagaccctttatttccaagagagctggaagaatcttcaacaattcataatacttgttcttattaaattgcgaattctgggcaaagaatcttgaggagtaaaattgcctatgccatttcacatgaatgatatacagaatgtgactctgaaatgtctgccattttcagagcattacacatggagagcttcctcaattttcagaggacctctactgctacagggaaaatttcggttcacttgagttagaattatccttaaaagggatagaaaaattcaggaatgcaacaacattgacttaccaagactcacaagttgtatacaccatttagaaaaagtttttagccttgaaaaggaacatcttgtattattgttaatatgaatatttatgaagcactatcagtaggcttaactcagtccctgctcaattagcttataatttaattagtcctaaatgcaaatcctctaaattggggtggttggcttttgaaatgaatgccaactaatatcattattgatggctcactatcttctgcttctctctctcatttctcttttcttcttaccttatacatacattttgctctcaaacacccacccttcctcaactgaaaggatgtaaatgaaggtacacctgcaaaagcagaagccctgtggtccacattgaactttaaaatccttattagcattttgtatctgaaaattatagggatgttttgtgaatttttatagatctaacacaattgtcaaatatcagctttgaaccatgaaaacatttctaagatattacgcaaactaaactctaaattgagttttctatttctatttgaatttcacatatctaaatttcctatgttgtttctgagagagctccatatctgtgctggagttggttcactgcacaacatttcttacaggtttagatagcacaccttgttttgtgctacattctctcttgggagacctcagttgtattacaatcatagatggttgcttactaatacagaaagtagaaaaaaaagctgcccctttgaaaactatttaataactttaataagctgctttgtaaataagtaaataaaaagatacacttccttttgtcaaagcaaactctttgatatggtctggttctgtgtcctcaaccaaatctcaacttgaattgtaatgcaaattgtaatccccacgttttgggggaaagtcctcatgggaggtgattagatcatggaacagattcccccatgctgttctaataatagtgagtgacttctctggagctctaatggttttataaggggctttttcccctccactctgcacttctctctcctgctgccatgtgaagaagaacatgtttgcttccccttccaccatgtttgtaagtttcctgaagcctccccagtcatgtggaactgtaagtcaattaaacccgtttcctttacaaattacccagtctcaggcagttctttatagcagtgtgagaacagattagtacagtcagttggtactgagagtagtgtggcactactgcagatacctgaaaatgtggaagcgactttggaactgggtaacaggcagaggttggaacagtttggaggcctcagaagaagacaggaaaatgtgggaaaatgtgcaacttcctagagacttggagggctcagaagacagaaagatgtgggaaagtttgggacgtctgagaaacttgttgaatggctttgaccaaaatgcttatagtgatacgaacaatgacgtccaggctgagttggtctgagatggagatgaggaacttgttagaaactggagtaaaggtcactcttgctatgctttagcaaagaggctggtggcattttgtccctgccgtagagatctgtggaactgtgaattagagagatgatttagagtatctggtggaagaaaattcaaaaggaagcacaccataaaagtttgagaaatttgcagcctgatgatgtaatagcaaagaaaaacccattttctgggggaaaattccagccagctgcagaaatttgcataagtaatgagatgccaaatgttaatcaccaagacaatgaggaaaatgtctctagagcctgttagacgacttcacagcagcccctcctattacaggcctggaggcctaggaggaaagactttattttgtggggtgggcctagggtccccctgctctgtgcaaccctgcatcccagctgcttcagtcccaaccatggctaaaaggggccaacatacagctcaggccattgcttcagaaggtccaagcctcaaggcttagcagcttacacgtggtgttgggcctgcaggtgcacagaagtcaagaactgaggtttgggaacctccacctagatttcagaggatgtatggaaatgcctggatgtccaggcaagagcctgctgcagggacggggccctcgtggagaacctctgctggggcagtgcagtaggaaaatgtggggtgcaagctcccacacagaattcccactggggcactgcatagtggagctgtgagaagagggcaaccatcctccagaccccagaatggtagctccaccaacagcttgcactgcgcacctggaaaagctgcagacactcaatgccagcccatgaaagcagccaggaggggactgtaccctgaaaaaccacaggggtggagctgccaaagtggtggggacccaactcttgcaacagcatgaactggatgtaagacatggagtcaaaggagatcattttggaactttaatgtttaatgactgccctattggattttggacttgcatggggcctgttgcccctttgttctggacaatttctcccatttggaatgagtgtatttacccaatacctgtgcctccactgtatctaggaagtaattaacttgcttttgcttttacaggctcatagacagaagggacttgccttgtctcagtcgagactttggacttggactattgagttaacgctgaaatgagtcaagactttgggagactcttgggaaggcataattgtgttttgaaatgtgagaaagatgagattttggagggcaaaaggtggaatgatatggtctggctctgtgtcctcacccaaatctcgaattgtaatccaaattgtaatccccatgttttgggggagggaacctcatgggaggtgattagatcatgggagcagatccccctgctgttctcatgatagtgagtgacttctcaggagatctgatagttctataaggggctttttccccctttcctctgcacttccctcccctgccgccatgtgaataagaacgtgtttgtttcccattccaccatgattttaagtttcctgaagcctttccagtcatgcagaactgtgagtcaatgaaacctgtttcctttataaattaccatatctcaagtagttctttatagcagcatgaaaatggactaatacacccctgcagtgataaacattttcatcttttgagaataatcaaaaatagatgtgcagcaaaaatgtcataccattgcttcctgtgccctgtgatgcacaatggagcaatgcagcactcctcactagataaacattctgaaataacagtacagggcaagcagtcctaggaaggcagaccacagagcttagaaaaagtacacgctgcagtttgaagtgcaaaccacaatgaggcaatgaggagcttatgtccactctcaatataaaacatatctctgttaagtcctcaaatgcctatggttctctgcagtcacccattaatgacaactaagggaccatgaagggggagacatggactggcattgtctgctgcaccattcctggtggtttgattaaaaaacactgaaactggagaggatatgtttagaaaataattgtatgcttgcttcaattcagcttttctctccacttttaaaatcaggtaaagccaaactcatatatattcttattatctacaacaattactgtttcaggaggttgacatgtcttgttacctaaaaccactgaaaatttgaatgttgatcaacatttaaaatagcaagaggaatcttttcccattgcttaattttatttttttgagacagggtcttgttctatctccctggctagaatgcagtggcgtgatctcggctcacagcaacctctgcctctcaggctcaagcaatcctcccacctcagccaccctagtagctaggactacatgtgcatgccaccatgcttggctattttttttgtattttttgtacatatggtgttttgccatattgcccaggctggtctcaaactcctgggctcaagcaatccaccagccttggcctcccaaagtgctgggattacaggcatgagccaccaggcctggccaattttatttcttacttgactttttttgttggtgtagccattctcctattgatagacactgttcattttaatttttgactattacaaagaatgtttttgggaaattttaaaatttttttcttctcatgccaaaataaaagcttataacagaaaatataggcaaaacgtgaatatgtaaaagtttctgcaatcctacttaccctgaaataaccactgaatggcatggtggttgttatggtgtgtgtgtgcatgcaagtgtgtttacaacatttatctttttctgagtataagcttatatgtaaattttaaatttacatatatgaataagcaaatgcataaatttgtaaaaattgaatggtactaaacatactttttataagatccttttttaaccctgtaaggctattaaaatattcaaaacactatcctttttctagtactatgttcacaaagtattcattttaaaatatcactatagaacagtatattacagcaggcaaagaagttcagttgaaagttatactcctaatatttgagagagataagaatggatgaagtttgatgtacttaatcctattgcaataaagtgaactttcaaatatttcaagccttcactgcaaagtaaaataagacctattcttatttcttcaaaaattttatatattataagtaggtaaggtatctccagctgaaagaaataattttatggccagctttccaaaccttccaaattgtatatcactttcttctcttttaattctgctgtctcagatatttaattaataagagctgctgtagcaaggggcttgtccataattttattgtcaacatttctgagtcatctacttctgatttgttttaaaatcaaatgcaagatatttggctaacatacaatcaccatgagctaggaatataacaaataaaccaatgacagccttctctgatgcacccttactttcatctgaaccattgtgctaagaaaaattagttttttattccttaaaagtcttaagtatccttctgttatatctgaaacctcaactcctcaactccttttttgttagttgaccatcagccatcaaccaccatccagttaaagtcaatgatgtgaactgcacgcttaaaggtaagcaaaattcttttaagttctgctttgaaaagagggaacaaaacccttggtgacaggagtttgtaatctaataggggcactgtgattaagtgacatagtgcatacatgtgtgccaggaaacaaatctatactgagtacaatcagaaacagagatcctatcagacatatgataaagcttgcttaaggaagcttgagggaggagtgacaatctttattatggaaaagggtgtagtttgggaaaatactattacatcaagctgggaaggacagctaagagaatggatgacagaatcaggatataaaaagagcataaggtcaaaatataaccagatggagttaaatagggtcacatttgaagtcctgccctttggttaaaacaaaaacatctaactgagcagctgccaagagagaaggagatggtgcctaagtcaagcccttttagttaagtgcaggatgtcacaacgatacgatgtggcagccagtgtctatctaatctaaagtcactttcattgataaataaccccaggatgaggcaaagaaaaaaaaaagtctctatgatgttctgagctaattggattactttaggaatttctggaatttgctaatctttgggccattaaattacaaaaggaggttatgagataggagctagtctaatggggagtcactagaaaaggaaagagatgtgatggtataatggtagccaagttaaggaatagaaaacatagggaacagacctgatggttacagatacaaaagtgtcacatgaaaatggaatttcaggcagttgtgtgctgggtcaccaaaatgtcattcccaaagtttactccatcgcacctggccactctgcccttgaccctcgactcagccaaatatgacatatctctggaaggctggcagatgcaagctgaacggttggccataagagcccagctgaaacaagagtacctgcttcagtacaacaaccaactctaaccaccaagggctcatcgaagatcttgccttaattcgttggacctatgcaagatcagcaaatgtctattctaatttcagactcactcctaaaactcactcttgggagctctgtgtggaattgggcccctcttcttctggtattatgttttcaaaactgacagggataggaaagaaaaacttatccaggaaggaaaattggatggaacatttaacatctcatattaagtctggcaatgatgactataaggatcttgcttaaataaattgtctattaatcattaaaaaaagaaagaaaggaagaaaatggaatttcacttgccctgtgtgtttccaagattcacaggtaggagcaatgctacttagaagtttcacggaggccaaagttcagtgaaagcaagaccaagccaatgacacagagccagccaatgacacatcaacactgacaaggagaaggatgtgcagcaataggggcacaagcattgacctttgaagagtcacatcatagctgtgttagcactgaaccacagggcactggtgtcttttttcatcctgaaaattctgattcaacaaaaaagtttgtttccttcccaatttaccttcctttgaactaattaaacttctatcctcttcatccctcaactattaaatatttaaaaatatgttgaccaatttaaggttttgaaataaaaacattatatgaccaaaaggtttgataaattctcaaaagcataacactgtctacttctctgtaggtatctcgtgagcaccagatactaagctcccttgatgaaaatagcttttcaaaatatgatagatatgctagtgcactgtattcggaaaaatgtgagttcatatggacctgtcaggatgtaaaaaacatgcaatacttggtgtgtttcctaaggagggccccgggtaaggccccagtgctgtgcttctcacattgaaaacacatatgaatcacctgggatcttactgcaatgcagatggttacccactaggtcagggtggggtccaagaatttctaccaagtccaggtgatattcatactgctggttcatggatcacattttgagtagcaaggtaaggcgtatttcccatgaagcaccattgcagaatgtttattactaggccaatattcacctaggcatttctttgctttatatattaacacttctattgacacagatcataaaatttctgttttcctttctttgaaaattaaaatatatggtatactaaaacttaaaaaaaaatcagacagttttttcccccaggtacttaagaggatacaaacccatgaaacttggcctcaattagattacagtggtccctcaggatctttggggattggttccaggtcttcaggcagataccaaaatccatggatgctcaagttccttatataaaatgacatagtatttgtatataacctacacacatcaatatactttaaagcatctccagattacttatacctaatacaatgtaaatgttatgtcaatagttattatgctgtactgtttagggaatgacaagaaaagtctgtacatgttcagtatatacacaaccatattattaaaaaaaaaaattggattgaatacacagatgtggaacccatggatacgaaaggcctactgtacttggaagtatcaataggaaatttcatcaaaattgatggtgaatttcacatagaattaactctcattttgtttttatttatttagcatatgtaagccggtctctaataacaaaataattacaatgactatttttctccagctctaaatttattatagcaacaactcaggatcaaatataatttgagatccctttgaaggggtataagctgttggttgataatgatgttgagtagatggtccaaaaagactcagtctgaacatcctcaattgtttgccttagaccaaattctaagtgattgtaagaattcatcttctttgaatacggtgtattgaatttcttaatgaactctccagcaaacatgaaaaagtaaatgatgttatttgggcaagactgtttgcttatagaaaaataagaatgtcatctgtggagttttgaaacttcatcctaaatcatcacacatggttcccaggtgaagcttgtacatatattctgaagtagaaactgctcttttaatggtgatattcagaatctagtcaggctgatcattgtcctagtctcagcttttagcctcctgtttccttcatctgaaatgttcttgcccttcatctcctttgagtctatgcaaatgttaacctggagggctaccctattcaaaattgcatccctactgataacttcctatgtcattccctgacttttttccttagcacttatcactatccaacatatattttttacttatttttcttgaatattgtctatcttttctgtagttttctgctgctggtgtaacaaattatcagaaacttagtgatttaacaattaaaatgtatcattttatagttctgtaggtcagaagtccaacacaggcctcaatgggctaaaatcaaggtgtcttcagggttgcattcctttctgagtgggctaagggagaatctgcttccttgccctttctagctgtccacattccttggctccaggcccccttctttcatttccaaagccaacaaagttgcatctgtctgaccctttttctgttatcacatctctctctaacctaaccagggaaaagtctttgcttagaaggacttgtgtgattagattgggcccactgggctaatacggacactacatctcaaggtctgtgcccctaatcaaatctgcaaaatctttttttgcatgtgaggtaatgttcatttagtccagggattaggcagtggagctctttgcaggggctattattttgcctatattcattggaatgtaagctccaaaaggtcacagatttttatttgtttgattcactgttatattcctagcacttacagcagcacctggtatatagtataaactcaaaaaatatttatttcagaaaattaatgaaagaaaattggattgggctaatgatgtcatgacaaacacatatttgaagtgcaggcgctagacatagacccttactagatttttttgttttgatttttgagatggaatatcactctcacccaggctagagtgccgtggcgttatctcagcacactgtaacctctgcctcctgggttcaagccattctcctgcctcagcctcctgagtagctgggattacaggcacctgccaccaccatgcccagctaatttctgtatttttagtagagatgggttttcaccatgttggccaggctggtcttgaactcctgacctcaggggatctgcctgcctcagcctcccaaagtgttgagattacagatgtgagccaatgcatctggctagcctctactagatgtttgaagagttaatcacttgaattaaataaaccttagtcctcatttgaaaaatgagaccatcactttgcccacttcatagagtggtttagagaatcagtcaatgtgatctgcactgaagtggtctgaaaattcttagctaaagaaatgtaaattattgatactatactttttaagtcggtcttagtatccttacctaaaaatttaagtttctttgagctcaaaatatcagccattttggtcacagttcactcctcagactttcagaaaccccattcaagatgctgaaaaagatatatgggaaaatcttaaagcatggcagtagccttctttggtttcttttttgccaaacataccattcctcagggtcattgccctagactgagtgtagcatgattggaccatctgagaagatggtgggataacagaaagttatttggagtcttcagacctcagtctagtccaggctctttttgactgggcatttccattagtatctccaagccaccctgctgcctagagtttatcattctcagctacatgttattaaaacatgttagcaagtactgcagtggtgcagaagaaaggccctaagagccttattgtttttatttccttaaggtaggactagaacataatttaactaacacactgtcttcatataacttaagtttataaccagtatcatagaaaagataacatgcccacaaatacttgtagaattattttgctgatctttcaaaaaatggcacttagaacttttatcatctatttttagaatatttgtacaaggaaatgggcctctccaattttattgaaaacatttgtcaattttattaaattttttaaaactcagaatttgcttggaactcatatgcttatatttactagaagactaaaaatctaaaggtttaagatagaattttctattgccttagcaaatctgtaatgcccaaattagaaaacagttatttttctccaggattgatgtaattaaaacactaaagggtgggggggtcaaacaacaacaaaacagtcttaatatagatgtggtttgtttctctgggcctgtgactacatatggatatttggaaacattacagtgtttggcgacaacaaagctattcattgttagtcaacagatatgcacactgtggtgaaaactcaaccaataaaattgttaatttaatgcagtgattctcaaagtgtggtctccagactagcagcattagtgtcacttggggtcttattagaagcaaaaaattggaggctgtaccacagatctacagaattagaaattttggggaaggggcctggtaatgtgtggcttattggcccttccaggtgattctgatgatcattagtggatgcccttttactttcttaccttaaaatatcttataatcttgtttgatagtgtatatgaaaaagcacaattgctttttaaaaggtgaaaatctgagtcagcaattaaggctaagtcatatctaaaaatcatgtgggcagagtattttgaaaactagatatttgaatcagctgaaaaagcctctgctgcaacccaaacctaaaacctcccctaaaacccaaacctaaaagtattatttattcaataacttacataaattatccatgtaaaataaacattgtatatattaagaaatgcttttcacatgttaattgaaatctagcttattttcttggaattttctcttgcattttagacatattttccagagattgattttcttgctctaaaattttattggcaacccaaaaaaagcaaaatcaaacagacaagccaacaatattctcatataatcaaccagattttttaaatccagagtcttaaaaatatgggtattttcccctgcgagttaaataagcacaaaacaaacatattgtatggtctatagttttattttagtaactggaaacactattttgcctgcattccaattgttataataaaggtgaagcaaaagtcctgagacagcctcaaggatctggtggctaattctttcaacagaaccaagggcagggtccgagatgacaaggtctgtttcagctgggtctcaggtgagtgtccagggtatacagaatggggttgaagactctttccacaagagcagcagaatagtatgcacatgaaagtaccccattaccaagaggccttgtgggatgaacctgtgtgcaatggagttacaccatccaggacttcctgagtagaggattttgggttattggtaggcaatggagagccaatgagatttcaggttgtggatttacatatcacagtctctttttaggaagatgaactccagccaaagtgtaagctctaaactgaatcttacagagcctgttgtcaggaaattctggcaatttctagcttgacaaaaggccaggccaaagcagtagtggtggtgatggaggccagaatgtgagaaacctttgggccaggtttgaatgtgatggctgaaggaaaaaataggaaacaaggtaaaatcttgggcttcttgttaagtatttattaatattgggtatgatgcttattctgcattacttatccatgcaaactattgaggacaacaagataattttgtgcttagattggtgtgtgtgtgtgtgtggggggggggtcctctatcatgtatctagctgattcaaatcatttttttctaaatgataggaacaggtgaaaagtgatatccctgggagtccgagcaagtagggatgcatttcttaaccagcagttctttaagtggaagtctgtgaacctctaaagcagcggagtcatgaaagacatttagaaaaatacagtcacctgggtcctgtccccagaaagtctgatgtcatttttctgggtgtctggcccaggcatcagattttttaaagttccccaggtgattgaaagtggataagaactaatgcttgaaaatataagtgaaggcttttttcaattagataatataactttaatttcattctgttgatttgcctaataatctgttgtgatgctaatgaaaccaaagtgttacatatttacctcctagggatgatgcaaaaacaaaaagataatatgtgataaagtacatcaagctgatacctatttgggccctgttgtcaacaatagtgtttcaactttttcctacagggaataaatacttacataaatcactgggaaaatacagcaaagtagcataatttctttgcttttacctttaacacgtgggctataaaattgtctataaaacactatctgccacaacttataataaatacatcctttttattgacataagatgggtaaatatagtttttaaaaggcatcagaggagctataaaggcaaactggatgtcaacacccattttgagggggttaatttttcttccaggaagtttataaatggcaggtcctggaaatcctaaaatcgctagatggactttgccttgcacatacttgacattcaataaaaattctggaaatgcctgaaaaagatcagcacatgtgttgtcttaatatagcacagtaacattacattgtttgggatgggttgtgctgaaaaagttgatctcttccaagacttaaagaatagtgtctgaaatttagcaacaggaaatctgggcagatgtgtaatgaaagtgctgtgaaatgattagaatatctaaaacaaagaataaaaataccatggatttggtaatattggatacacgaaaatggaatatatcaaatacacatgaagttctatctggaaaatttaaaaaattagcttttgggccaggcatggtggctcacgcctgtaatcccagcactttgggaggccgagatgggtgaatcacaaggtcaggagattgagaccatcctggctaacacgatgaaaccctgtctctactaaaaatacaaaaaattagccaggcgtggtggcaggcacctgtagtcccagctactcgggaggctgaggcaagagaatggcgtgaacccgggaggcggagcttgcagtgagccgagatcatgccactgcactccagcctgggcaacagagcaagactcagcctcaaaaaaaaaaaaaaaaaaaaaaaaaaaaaaaattaccttttggctacttttaaagattttccacatgaatgttggaactacccaactttcaatgaagaagtcttagctctatgcatttgcaatatttaacttctcccactttttccaaatctcttagatttcagctgttatgacacatttctaagacctttattcagacccttacaggcttttgaaaagactcttttttctttaatatgagatgtattgtgtacctattacactgaatggcactatagaaaaatatggctaatctgtatttctgtactctttgtgaatgacctaaatacaatgtttaccaccacaaatttggtacaacctacatgaaataagacttcagttttaaatataatactgttccacatagtatgacaaatatatacttggtatatgaaccatttggtatgctacaatacgacccacccccaatttaaacaggcttatctgaagtttacagaagatttaatatagtttactagatgattaaatataggtatggttgtgcgtgtatgtgcatgcacacatattttgctgagtggttaatataaaagctatgatagaatgtgaggataaacactgtattagctaagtactgtagagtaaaagaattcagaggacctggactaggataaagagcacaggaaaagaagatgagatttccataaaacaagctttgacagctttgaccaactcttaactgtctgcctgtagtctacattatgtatgagcagaaagtttgtatttcacatagaagctttccagttattaattaggaaaatgtttacatatggtatgtcacatgagtaggtttatctccttagccgaccaaagtaatgcagatattaaaaagaatatgttgtcagaaataaattattcatgcttcctaacttttctaatttggtaatttgaaaacattaataggatttggtcattcttaattgtgttgatgactatccttgctctctttattctcaaggctagttgaaatttatctcatttatattaatttttctgtctgtggcttctcaaaagtaaaataacttcagaagcttcataagtatggagaaaatgttaggtgaaactttgcagaatcatttataatttatatgagatttttctttagtttttgagaactatcacttgaatatgtaatcatcaaacaggtggccttccacttatttgatatgatagaagaaaacttctaacattccaatttaaatattttatttgaaaattcactgctataataacactataacattaaggagagctgtgttgtaaacatagtccttctttttaaaaatgggaactcttattttatcctgtagctgttatattcatctactcatttttagtgttgctttcaccaaacaacatgtctacagtaaatatatttccattttatgattacagggaagtgattcctaatgaaaatgagaacagagtgctcaaattggggttagaccatccctgttgtgtcatagtttccactgttgaagtaaaatcccaactgaaaaataataggtcttgttagttggcaggcaggtttcactgagtaaactaagttgctttctaggattttgtgcagaaaaattctgcaatgctaaaattctgcaacgctaaaattcacataacacttaaaactgacatcgagagtagtggcccaatcactatgggagtaatcaacaactgtaaaagttttttggctttagcctctgctgtgaaaaagcatgagaagtatttatgagaataaagaggcctaagggattgcattttccacagtttattggacatctctacttggacaaccacagacttctcagaccctactagcccaaatggaacacataatttcaccctcaaactcactcctcttgctggaccccaaactcagtgaatggcctactgttcttctagttgtcccaagtgtcttcctgttcctcgctgtcacacatattgaatgccagttcccgttcaatctatttcctaagtagctatttcctaaatctctttacttttcattctccccttgctgctggtccaagccatgagtaccggtctgaattattgcagcaatgtcccagctggtctcctttccttcagcactgtccttccccaatacactctctacagcacagccaaatactacaacctcaaagactttcccttttgttggaatgaagtccggaattcttaacatggatagcaaggcctgttattttctcttccttgtattattctcagcttcatctcccatcattctccagagcatgtgcaactgtcctctctgcaccctaaactccaccatatgcacattcagtaatgtggtaatgtcaagaactctccactttccaactttgcatatgctcttgtctctgcctgccctgtccatcatcttgctaatttctattcacactgtaggctttagtgcctcttccatgaaccattcatgaactccacatcacccagtcctaaaatcaaggatgactgcttgcataacatcctatattctgcctcatcctggaagtgattatacttcattgtaattgatgtttactcatctagctttaccactggacctctggcttcacaagaatcacatatgtgagtatcttgctcactgtacaaccttagcccattatagtgataagcccatggtaggtgctccacaaatatttgttaagtgaattaatctgaatgcagatatgtacaaagaccacagagttcagatttttgtctatgcccttagctatcatgtcaaagaactggagggtagtgcataataactagctgtcttattacaacgtacctccctgcaatacagtttcacccaccctaccccccaaaaaattctaatcactagccagatttaaatctatttgactctacttctttcagtgttggtaagagctatagcagccattacttaagaagagagttaaattactaatatctgtctacccatttctctgagaaaatgaaattacttctctacataattaaaacaccatttctttgaacttgatgaagaagccaattttcttttgtgttcctgcctcaaaaaagaatatatgtctagagagaatattagagaagttattccataagatataactttctgctagaataaacttcattattcctacaaaattatggaagtagctggctatacttctctgcttacctcttaatttttcaaaaataacaaaaataacaaaactaaataaaagtctaccccatattttctaaaatagaattctgctaaaacacacacacacagacacatacatacacaaacacacacacacgaactatgaatttctataccattcttcaaaattctaaatattgtcaaagtcattttaagagaaacagaactagtttagttagtgtacatctgtcctatggtattctttgcaccagtggatctcagactctagcatacatcagagtgtcctggaggtctttgtaaaatgcaggttgctggactgctcccttccacctagagtttctgattcattaggcctgagatggaaccagataatttgcatctccagcaagttcctaggtgatattgatgctaacctggggaacacgctttgagatgtgacttatacgtgtaactaacagtagggaagcacatttagttctgtccatgcagttctatcaggcattttgacatgtgctgtcctcttgctctctttctttcattttttttggtaccaatatctaactcagcattactgcctaaatacataaagcctgtattccatgctgaaacttaacagcacaagtgtacatcatttaaaaaaacgaaaacaaaaaaaaccaaaaaacagaaaaaaagagggctatttctgcaagttaaaaaattaaatggaaaaacaaccccaaaattgctctaaggaggttttgccttcaatagcaaaacatgttttgcctcaattgtgatttctttgttcgggagccaaggtggcaattaagctggcacaaggagcaggagccatttatttaatatgatgacagcgtagccctttgtaaatcctggaacaatgagggcccacacacaggctcattccaagttctagttccttctcttccctgttgctcagtgtgaattctcatagccacaaaggaaggggaagattttcaatcctgtcacatcctcccccatttaaaccatttatagtcttaacttataagatatgagtaagaaatcttctttaaacattttgcagagctgatcatcaaatctaacaaactggtggttttgaaatctcctttgctccaaagacattccattaacctctgtgtcctctgttgtgtcattgtgctgagaagagcaagttaaaaatccagtcttaattggggcttggtggtaggattatttttatcttatagatttatttcaatattcattttaggaagaaagaagaccttaggaaggtctaattctcatcagttctggcataagctgagttagggatctcagaatttaaagaaacgacgcccttaataatggcatctgaagaagcaagtgtaccatgctgtgacaattacaagatactacatcagttcccatcctctactaggctcttttaggatggagactctgtctggttcactgctttatctctataatttacaatagtactcagaaaatagaaggcgctcagtatgtagcaattattgcctgactggctgtctctgtaagcattacagggaatgtacaaccaaaatgtataaagtgtaacatgacaccaaagttcataaattaaatgttatcaaaatagattgtttttataaatgaagaaaattaatcagaagatatctttttagaatataacaacctctaacacccagtctacaaatatacccatcatcaaacttctggcaaatgttcaaagtaaataaacacctatcatgacttaaatacctggctttatacttcaacagtgttcatatgagtaaaaacatttttgcttaagttgtctaccagtttataatatgggaaggaattccccatgggatactatctcctccccctttatatagggaatacaagtttggctaaatactttatcataattgtgcagaaagcacatggccttataaaagggcaatcacatatattatcaatgggattgatactattatcaatggtttcctaaaagcagcctctccattttgcaagtctatcaacttatagttctttaccttcccttcagctgaatctactcacttcaggctcagcctgagttcctgaaagaatcctgccagggtgggacccattataaggattttaattgcatctaggtcatgacactcagatctggatctaggggtgactgctggcttctgcatgatctactcttcttctcaggctgcccattccctgagatctacttcatggacactagatcctgtgcctgatgttcaaattaggatggcctcataccacaatgttttgttgccccttctagctttggatctcctgtaaccccaaatagcctaatctatgccgggccctcttatgcccttttgatactatttctcaaatgactcacaagaccagcctctaaggtcaagctagttctcccaggtctcttctagtatcctagtgctatttttttctctgccaagttctgatttcttttccagtccctgttgctaaaatcctactgaatccctcacagccacccaaatcctggcaaggtatgattttaccatcttaagttcattttcagggctgagcgtataataatgactggtcatgcagcacccagtgatcacactgtacagagagtacagacattgggatggaggaagggcaaaaagaggcccttgatactgaaacatattttcagagagtaatataattggtgaattctcatatgctgtgaggatcaaattgatgaaccattttagcactcccacaagaattctgctccctcatttctgcacagaatttcatcttatgaaaaagttccacaattgttaacatactatagcatctcttcatgccaagtagttttgtattttaagaattacaaaatgcactcatcaaataattttggcacataatatatatttctaaattccagaacaaatctctctcttgaaattctatttaaaatacaacctgggcttgtacaccatccagtatgatagaaaaacatataatcaattcatagaagaccaacacctgccctacaggtgctagaatttgacatcttgttgaaattagattgaaatttagtatacagtatgtaagaaaaaaggcagactacaatatttcctgctagtggacatcattcaggcctcagagatgaaatgtgcaaaactcttctagaaatactaatcaactgaaacaagccgcctccaaaacagtaatgtggtcagtctgcatgctgccaggtaatttacaatccatgacaagcagagccaagtgaaagttatttacatttattctactggtagaatagaagagatgagagtgaaaaggatctgctgaatcagatcatgtttgactgaggagtgacagggaagttttcttcaattaatagccagctgcataatttgagctaatgccagctggactttcatcatgaaacgacacagaaataaattattctgtactcaggtgctggcatagtgaagtgaattaatccacttaaatctggaggagggagagagaaagtagattacactatctgaattttttgagcctgttttagccacactttaaggatactgaggttcatgataattattaaaatgtccaagtggatccatttagactcaaatacttgcttgaatgaacaaattcttagaagggaggaaccagagtagaaatggctttatcaaggtcatggtggtttctttcaccaattagtgaaattcatattcaactcagaaggtcagggggaagtgggcaaaaagagtcttattaagaacaactttataggggaattcttgagggggtaaaaaggtgactacaaagatataaaggaatccaggacaggtttagagaggtcaactgcctgctggttcattcagaaaagattaacagacccagctgctgggacttttctggctaggcatccttcccagtggtcacaagtcaatgtgtctcctggctgcttggctatgttcccatccgtctggatggaagagcgcccacccctacacgccagaacttttccttaggggaaagttactgaggttccacgtcaggcaaactttgctcacccatcacttcaagtaaacaactcttctatggagatttcttagagaaaaaatgcacttgaaagcatctaaccaaagcaatgaaggtggaaaaaacaagttatgtgggaatctgagtatagaatatacagacataaaataagctctccaaatgaggaagcagtcacagcttgacctctgaattgtttgctgtttgttccttcaatattcaaactgtagccctggaaatacaaacacaaacttctaaacactcacaggcctgtggcaacaaaatgctacatgccagcttcacaactggggcatgcagaccataaatcctgtagtggcaggaggggaggtgtggaaatagactgtcatcattctgcagcaaggaaaactaggtacaaggaaaaggcaactggcaacacattcctggattctctcattcattgaagaaggaactcagggattgaattacccaattgacgctagttctacccatgccagagggcaaaagttccaagactgccacaggccatggttgcttggaatttaggcagaggtgcttggtccttagagtgtagcagagagaagttctggaaaaggagctcctcatcgagtctggtaatgagcacttctattctgacatggatttcagaggactcaggggacaacgtgcccagaatttaacccttttaatcagtcagcatgagagataaatctaatttagctatatgagactgatgagaaacagtctttgccgtctataacacaaaaggaaaaggacaaaataagaagcccattacttttagttaacattcagagcaacaaataaattcctacaatcacatagcacctggttccatcaatggttggttagtctgggagattctaagctattagctggaagctctctccacagtgagtagtggggagaaggggagaagcgagctgttagctgaattagcaagtgtttttacaaatgtcatatgtagtgtcaatgtgtgtcctaaatgtaacaccctgccaattcatcaatttatagacagaacataggcacaatttctagatatgagattgcatgacagtgtttctcaaggattagtttatttctttcaacacaccctttttgatacgaactgctttattttctagcactcactacatctcactcaaatgtgtggatggcaacagaaaattttgatcattactcagagtactgattttatacattatcatctttaaccttacagtcttctgaggttaaaatccaattacataaaaagcaaaagaacctcagaggtaaagagaccagccaaaatataactatgccctagttttacccctgtatttttattattttgtggggtaacttttatttgccagtcttccttaaaattgtaacttctttgaagatgggaactccatattattcatcttttcatcttcagtgcctagaacagtgcctggaacctggtaggcagtcagaaatgtgagaagtagatgcaggccatgcagccagtcagcaacagtgctgggttttcaatgcagaaatgtctgattccaagaccactcacgtaaaaaaaaaaatgttgcagtttatcagtgatgtttggcaaaagaatggatgttgatattagtttacccagtttcattctaggtagttcacaaccaggagcttctcaagaaatacttgtttacagaattcatgaatccaaattagctctgtttcccaaaaccatagataactggaaactaaaaattggataaaagtcagcttcaacagaagaaaaaagagtttgtattaaatatgaatgagcatttactttgttaaatgatatgtgggcttttcacctagattacaggaaaattactctagcatcaatttttactttgaactttgaagaactttgaagagctatattgagtaaaacccaaagtgctctccgcatgaaaaattctagtttgcccctactgtaaaaattcacaatataaatataatcatgagggtattttctttcatagcatcagtcatttaaaaatacaaatctttgaagaaaaaaaaattgttgacgaagtaaaatagcattaaatcctgtaaaaagattacaggcacaaaacctgaggattttacttgtaaagttttgttgatggagtcaaatactcacttgcattaactctctttccaaaccctgagtccaccccttcgtattccacttgtaataactaatgttaatagcaaaaatatatttatactggaatgaacaataagcatacaacagttgtttggtttaccaaattccctttcattcacagcttaaaatgtaaccaatttagctatgacaatgccagcttagtttatccaatagcacagtaagcactattcctagagctcataattttaggagctcatagaaatgttaaatctcttttaaaatctgaaaaaatgagtacaaaacagtttagattatatttatctttacataaatgcagctacaaaatataattttgtattttttatgaggaggggacccacaaagccaaaagtgcgttgcgctcatcaaaatcatagtgagctagggtatttttaatctttataaaattgctatggcattattcgttgctggaatgccaggagcatgttaatattatgtgccttttatttcttctcacccactaaaaaaatctaatctcacgaaaaatatggaaaagtcttatgaattggattggatatgaacaggatggatatatgacagatgtatacagatatatgatgggtatgaataggatgaatggatataaatcacaaatccaatttaactgggcaatgaaagaaaaaaaattcctaagaaagccttcctttcccctatctcacatcttttacctagaaagcaacaatttagaaatgattacaacttcagagaactgaaggaaaagacgaactaccagaatattgtggcttcataaaaacaccaatttagaaatgcttacccacaaagcttctttttccccttaacactggatttgctaattgaattgagcaaatcctgaatccagctggatatctcagtatgtagtaacaccaaattactgagttagtactgaattaataatctgaactgggtgagtatactcactaactttactcagttactaaaaggctagtatcaaagctaacgtcagaaatgcccttctcatacagtacagcataaccaacaacagtagttcttgtgggcattatgctttcatgccaaccaagccacaccttgattttctgactgtgttgcctatgagttggttctatgttcatccattaataggatgttgacttattaataaatatattatctaattcttcctctacctctaactattctgtggaatagataaaataaggagtaaaaatactttcaattttgaagtatttgttaagtatcttggcatagaaaaaggcaagaagtaacatttgaaataaatttgtaacattatctgtgaattttatttatctatgaacttctatcagttttttataggaaaaaaaggggcagtatatacataattcaaataccaatagttggaacagaaatttttaggatttctagcacattctaagtctcttttgaaaaattataaaatcaaattagaatttaacaccttgcctatatgaatgtcataataatatagaattatatgaattatataagaaggaaataagtaatgacaacctcaagtaaacgttcacttttttcacagccaaattttgacttttttgacagttttatctcagataagaattcctttttcctttcaaaatatcattttcacaattatgctgtgaaatatgtggtcatctgatattataggaaagcagaactttaaaagacttagaactacattcctccctgttgtaatgagatactcttcacatatgaccattttttctggttacagtgtatctctgaatacttgtcatgcatcttctcctcttattctgataaagaattctgattttcctttgattaatccccctcctactgatggaactgacctccacaaccgggacacacagaggcctggtcagtcagtcacaattgactcaaggttgacctgtaatccaagtgcacacgtttcaagtcagccctgggttttccttggaactactgggagatgtatgctctcatgtcacaagaattactacaggcagccttgtgctgtctgagctttctttgctaccacatagagaaagtcttagaaacacagtgagacagaaggagagaaagagaaagacagagacaaacgctcaatcaaatcatgagagggcctgcagcaatcctcacaaccattaaaactagctgtatcctttgaatttttgagtttcaagatcctgcaaactgctattttgtttaagtcggcttaaattcagtttctattatttgcaactaaaggagaaaactctaatactgtatttcaccacatgaatattttcaatgttaaggaatataaaagaaatcttgatatgatgcaagttcactcttgcttacttactctttgctatctttatatttgattgacaacaagggactccaactgttgcttgttgctccactggggaaaatttatttattcattcattccttcgctcattcattcaacaaatgcttatttcacacccattaggtaccaggcacccacctaggttctaaagattcataactcaacagaatagacaaatgttctaccttcataaagcttacgatctggtgggatggagtcaacccttaattaataaataaataaaaatctaagtgtgctgaatagctacatgtgctacagagaaaaataatgcaggaatgaggatacagaaagtctgcacttgaggataggttttgattagttgtttttaaaaacagatggtcatgaaaggtcttattaagaaagtgatatttgagcaaaggcctgaaaaaaaatggagttccttactggggaaagtatgggtcctacaacagagaatagtaagtctcagctctgcagggtgcatggcaaattttccttacaggagttcacctagttacacaagagagaaactcccatgacaccccactagaacttttttctgctagctctctgagggaactgggcatatttgttctgtttcactgggcaaacagaaataggagttaggggtggctgtaggttccacgaatcattattattttcaatgttcactctctggcgtaaaggctgtgaggtgaattgctgactaattttataaagcacctggagctcctcagggcaaaggcactatgtcaacaccaacattaaataaatagcaataattggccaagtcctctggtggtataaggcaaataaaatatgttccctcttggaagttcatgacgtctgccaggttaagcaagaatgaggcaaagcacttttagaaagctactttttctaccattgtatatggcctccaaacagccagccactgtgaaatgttaagtgttcaacagcaaattaaaactgagtgtgtttttcattcactatcacaacaaggtactaaataaccacttgagatatttgttgtacgttatcattttccaggcagttttactgttagctagaaataagagtagagtgacattcgtttgattagagcagaaccattttccaccaatttttagagcacatgcaaatctctttagcaaaaggactttttcaagggttgaatctcttatagtttctcaatgtgaatgttaattaaagaaacctaccaaaaccaagaatgatttcaaatggttatagggtttcaaatggtagatgaaacatgaaaatatatataacctattaacaagatatatttgtgtctctaagaattctataggggaatatacatttcagtgaaactctgtacccacccaacccactccacagcaaaacaggcatttgtgagaaagcgctatatatatacacacaaacacacacatgtacacatgcacaatttataaataaacatcaggatgttaaatttaactaattttaactaaaacaagggatagctcaggataaacttggttttactctactaactccaaagttcaataaataataacaattttctcaaggttattaaccatcaatactcatagaattatgaaatatttttgctaaaagcatttagaactaatctagtatgattcctttatttcacagatgaagaaacgaagtgtcacagaggtctctttgctaggggtaatctatgtgctgaaaaccacctataacactttgaaccatacctgttgttggtattttgtgatgtccgtctacatgttttccttgaatgactatatattttttattataaaaatgggctctcattttatgtattttttattttttcatttaacataatgaaaatctaccatgttaaaaattatccttatgcatcagtatcctatcatacacatttaccttgataacatatcaaggtatattgtgctaattcccgctgctgaatatttggctcattttttttcttggcacattttcagttttccactataataaacattgatgtaactaaatcttttcacatattcttaatttttttcttaggataaattcttcaaagtaaaattgttggttcatagtgtgacttgaattctcttctagaaagctactcaaactttcactttcattgctaatgaataagaatgtcctgactttagtcaatacgctgaatttgttatcatctagttttgactttgttttttaatcttgaatactctttagagaaaatgttagttcactattgtttaatttgtatttctttaaagttggggttttattcatgtaactcaccaattgtgtttcttatggattgtgttcattttcctggaagaaaggtcatttttttccttattaatttctaagaatttttttttttttgagacagagtctcactctgtcgcccaggctgaagtgcagtggcatgactcagcttactgcaacctccgcctaccaggttcaagagattctcctatctcagcctcctaagtagctgggattacaggcacgtgccaccacacctggctaatttttgtattttttagtagagacggggtttcaccatgttggtcaggctggtctcaaactcctgacctcgtgatccacctgccccagcctcccaaagtgctgggattataggcgtgagccaccccacctggacgatttctaaggatttttaagacattaaagtcaatgtctctttagtaacactggaaatagaatcccacccttttcatttgcctttacgttttctttatggtgtttttgatgtgtagaaaaatttgattccttaatgtatacacatctatcagacattttcttcatgctttctcgctctagtgatatgcttagaaatatcctccctatgttgaaatttaaatactcatttttattttattttagtaattttaactaaactactttttagttgttacattaataaaattatatattatatattaatgaaatctttatttaaataaatatttaataaaatatatatccaatgtatatttttatataaggtttaaagaaagaatctaactttatattattttcccaaacgatagctgttgctttcaacaccatttattgaataatcatcccttttctcattgaataaaatgctacttcagtcacacacacacacacacacacacaaatacataaatgagtcttatttgaaatctatagtctatccaaatcaactttatctaattcttcatttgagccaccgtcctaattcttacaatattatatattacatgatatatgttactgtaatttttatgatataatctctggaatggtgtgttctacatccttccaacctttacccactgtgctttatttcaactttttcttgattttcccatgttagcttgatttttgaaatactttattaaaatcaaaaataaaatgtgattggaattgcctatagtggaatgaatattgtggattgtttagcattagttaagacatttttgttttcttcacaacaataccaaaaaaacccttctaatttcttattattttcactcataaatataggtgtagtatgtttttgtgactagaatcttgtgctatttaaaaagaattggccgggcacagtggttcacacctataatcccagcaccttgagaggtcaacacaggcggattgcttgagcccaggagtttgagaccagcctagggaacacagcaagaccccatctctacaaaaaatttttgaaaaactgtccaggggtggtggtggatgtctgtagacctagctactcaagaggctgaagcagaagaattgcttgagcctaggaggtgaaggttgcagtgagctgagattgtgccattgtactccagcctggacaacagtaagaaagtaagtaaataaagaggtattttatttttttcattataatatctaactgattattactttctataaaaaagctaatagctttcttatatgtaattttgtatttggctacctatctgaattactgaatcatttctaataacatttcaactaattcctttggctcttccaggtaaatacccacatagctataaagtcagttttcattttatattttatgtttcaagttgttgtactagaacaataacttgacaataactatacaacttcccaaacaaatattacatacaaatattatgttacgtcttattgcttataactaagctgactttaatagaaacgactcacacttaaaaattggtttcaccattgaaataaacactatattcttctgttgctatttcactgcatccttttaaaaaaaactaacaacaaatggatattaagttttagtcaaatgccactgtggcacctgtcaatacaagtctattgctttttctttcaccatattaatatgatggattctgtgaccagatttgatcaaaattaactatatgtacatttacagactcggccttatttgacatgagcatgaatcttttaacaaaatgcaagattcaatttaccaagttgtatttaagattttatctaccgaaaagtaagattggttgagggacttccttcttattgcaaataggtctacttgatagaatgaattgaaaagttgattttcttttcacaaactctagaaaatttatataacatactatttgttccttaaaagtttggaaacattttctcagaaagtctctgtgcctgacatcttttgaaggactgtttatttaaagcaatttttctaattttttttctgacagatatcgctttgtcaaggttatatacttcactttgtatcaaatgtggaaatatatatatttttgcaagaaggcacaatttaatcaggattgtctctctccctttccgtatgtacatgtttctgactcatcctaggcccctcactttccctcactcccatagaactgtttcaccaactgttaggtatgactgctgtctcattctctctcaccacagaaagctgggaaaggcattttaggaggtgagaaataaagcatcctctctcaagtttttgccatcccccaagagttatatgtggggtctccatgccaacagtccactcctctgagatggttttccctaatcacccgcaagtaacttttcacttttaactttaaaagagtgagcagggctccccttcctcataacctagctgcgaagcaatttaataggtgttccatgaaatttaaaagcagtagtaagattcctaacagagacactcctcaactttctccattctcacagcctgtctctagatatagggagttctttggaactaatttctgaaagaacacgtactttttcatattatataacattctaagccacattaaaatgaatgcttggtgagatttttcaagcagatatttaaattattgtatgccactgagaaagattaacagggcataataagctatacttaatattttaggaacgagtatagtaaactattgtttaataaatacaaggcaaggcaaacattacaaagtgaaatgtggaagaactaaagcttctaaaataattgaaccttccctctagcagcccctcacagagctctccgtcattaaccaggagtataaaaaatagagcaaagtatataatacaataatagctatagttttttgagctctggccacatacctggcataatgctagatgttatacacattagctttcttcctcagggcagccctaaggaaaaagagcaaaggagggctgatgtggtttatagctcccatatgccaggccccaggatggatgagtttgtaggaactagagtctcagatcctaagtccatagagttaggaagacacaattaataaggcaaagttcctgctcttgacattgtaccactgtttcaggtttgactcaactttttttctgaaaataatgattaactttttatagttgtttacagcctgccaggcactgttctaagaactttatatgtatcaacttctccttgaatcttcacaaccactttataaagtaagtatcatgatggcccccatccccctccattttttaggggagaaaattgaggcttaaagaagtggcctgcccacagatggcaagtgaccaggccagagtccacacccagactatttaactctagactccatttaactctagactctaagcttttaatcactaaactttcagaaatgtctaccaagaaagatggctaaatttggcgagcaatatctaaaatcaagtccaaaggaatatgaataaaagcatttgaaagagaaggctatgatttctcacactatgactagcatttttccttaggtgtcatctatgctgaatctccactgggcaggaaacacaatgaaatacaactgaaactgaatggaaagttaaccatgaaacgactggaggaatctcagtcagaactaggtctcgctttaccaagagaggtcagtcatacttgacaatagaggctttagggcccttttcgatgttccacaccataatttaaatgatgcagtaaaaacagaaaaagcaaagagttaataatcatctgaagaaatgtgcttccattctaaacttccaagggggttgggggtgtaagaagactaaatattgtggaaagcagcttggtgacatctgaaaaggctaaaaacagaactaccattcaactcagcagtcccattcctgggtatatacccaaaggaatataaataattctaccataaaggcacatgcacacatatgttcgttgtagcactattcaccatagcaaagacatggaatcaacctaaatgcccatcaatggcagattggataaagaaaatgtggtacaggtacataatggaatgctatacagtcatacaaaaatgcaatcatgtcctctgcaaaacgtggatggagctagaggcattatccttagcaaactaacgcaggaacacaaaaccaaatactgtatgctctcacttgtaagtgggagctaaataatgaaaatacatggacacaaagaggatcagcatactggggcctaccagagggtggagggtggtatgagggagacaaccagagaaaataactattgggtagtaggcttagttcctgggtgatgaaataatctgtacaacaaacccccatgacaggagcttacctatattaaaaaaaatctccatatgtacccctgaacctaaaataaaagttttgttttttaaaataagatgaaatgcatagggcaaaggtaaatctgtttgtggaaaaacagcaaaaggaagcactgtttcctggcaataagtataactcttttcttaaggtctgcccttctccttaccccgatctccaacttgttggaaagctaagattattgaccttctgtgaactctgtatctagttaacttctttcattcaaccctttagggactcaagcaaacagcatcactgacaccattgacagtttgggattccaaggtggctatgcaaattaatccctgtctcttgctccactcctaccctcatcactaatcctcacttctcctacaaaaggacattgttatgaagcatcctcgccttgttttcagcttgtgtgtttttgagccagagcttcattagaatatgaccatctgtgctccctgggaccttggtcacctcaatttatttgctggaagatgtggaatgatcctatttcacgtgaatatctagctcagtttcctctatttctctaaatgtatctcaatgtcttttgtgctttctggaaggtattagagtttatggaccttgctcttggttaacattaaaaaataagctttctacataatatagtgtaaaaaagctatgtcatttcttcacttttctgactactaagttctcttgagaggcagtgagtgtcacactgcactactagtggcctgcacatctgagacagagtatctcttacacacttgtgaattaattcctaacttctgtataatattctatttacattttttattcaaattctctctcattctctgtacatttctttagcacacactagatgtctgctgtgccaggtgactctcacttattcagcacagcaaccctaagagacacacacatttagtactgaaatattagagtggagagaacaatggtgaggcaatgaggttacatggtcacattcttaccttgggaattctgctttgctgtgaagcagtgggtaaagacattgactattacagcactcactgtttatccaaacagtatcccaggggagaatacatttcagggttctgtacgaggaaaacttagtctttcctgagaaatggatgttgtgttcttctcgtctagcatttcttttgttttcctgctaagtttggccaccacgtaactatgagatgggtttctgggctccttcagaggaagcactatgactcttattattgaaatattcactttctcttcacccaattttctctttttaacattctgaattaaaaaaaaattattgactttgtactttttgtaacttactgcaaatccttttctaaataggcagggcatgaataaagaaaggatggaaggatggaagggaggaagggaaggacaaaggaagaaagggagggtggcagggagaaaacaaaaacaagtaggcaaatacataaaatgacttaccttttgtaattttaaattattcaagtttgttttctaataaatataaccttaatgaaatgccatctctaaaaatcctttatacaaagcttttcaaataataaaaggaatacgagtaaaatgatgaaataaataaactttttgcagccaagaagtctatgatctaacgtttcttgttcactatctctcaaggttccccaagagtaaacatatgccataaggatttttgctaaatctagtcttaaaataggaactattctaaaattaaacttctacttttatccataaggccatttatatcattttaagcaatgttgtaacaactattggaaataccacatggtctggttttacataaatttgcaatgtatattatcctccatcaccccctacattggtatagaagcttgttccaatggtatcacatagtgagttttattttctggccaggttggcattttgagatctagaatctttatatgccacccctgccgccattgccgactggctgtgtgcctaaaagccagagacactgggcagggttaaagattgtggccaggtttttttttttccactttgtcaaatgtaaaaatacaatgatggtttgtagagtatacttcagaaataatttagtcagtaggtttatgtctaccaatatatatcctatgagttaatataagcagttcacactaacaactgtaggtgatgtatccttcttttagttgctgatactgtgagagaataaggcattttatttaattaaagaatgagctaaaatagcaatgtggaaatacagaaaataaatactgaaaccacacaatgctaaacatgaatcagcattcctatatttgtaagtgaagtcacctaaagggaagaaagtataaacagaaaaggcaataactgcatcagggaaaatgagaacctatggaaggaaaaagaccagcagtacctggattcagcttttctggttggaaaggtctagagacattaaaatcacacctgtttataaaattatgtatatttaatattggaatattattggtggctctagagggcatacacctggttgtacaggaaccgtaaggtttaacaatactactaaaaaaggaatgtttatagatttagatttattgcaaaccatgctttcattttttcttcctataaatctttcctgagcatctactatatattaagtgctactgtagctatggagatacaacaagacaataaatatgaacttttgttggagttcacattccagtcgaagggatatgaatattaaacaaaataaataggtaaattagaaggtatatcagaaaatgacaaggacaatagagaaaactttagcaggggagtctgggagtggggttagggattaaaactgcagttctcaatctaatggatagaaaatgttacattgaagtagctttggggtgaagccttgaaggaagtgagccacgcagataactgggtaaaagcatatcattctcttgtttagatataaatgtgctgagaaaaaaaaagtattttctatatataagactattcctctgaagcagtagcatgcagatgactgggaattgtagaagaggtgtcaatgccaacaatttgaagaaaaataacatattttaatgttgaaacaaatagagaaaagtaagggattgaagagatattttaaagagaaaactgaaggtgttaaaaatgtgcatctgataccataaatccaggctactcttccagacaccaggctcacatgttcaatttcttctggcatgaaaaattccagtggaaaaagtcaaagaagctcttatctcttcgctgaagcagtcatgctagggtaacagctgaattcaggaaaacttaaggaaactaactttcactgcactcatactatatgtaaaacatcatacacataatatgaatgtccaattttagaagtatttaaaaaacatggattttatatagctctaagccacatgaggtgtgtatgaggttgggggtagtgaagctcaaaattgtaagctagacacttcttgaaaaaaaaactaaatgcagccttcactaatggcaataggtagaaagagaaagagcatgagccagaaatactcatatttaaatcaaattatggctctgtgctctgtggtcatgaggaaactgcttaatatcatttacttcatttattaaatgagtctattagcaacaacacatgtcaaattcctaacatggtacctgtccatccttcaccttatgagattattaaattattaaattttgccttttgagcaaaaatattgatttattgaaaatacggcctaaaatatatgccaattatgctacttactataatagtttaacatacaacagcttgaaaatagtataattctttcttcacatgagccatgttatgatttccagtaatttgggacccactggtatgtgggattcattacaatgttcttcaaaattatttcatttattacatggactttgtttaaggaaacgaacagaaaaaaattaaatgtttgttttggagaagtttcatgctgttaacttcaaagcccctaagcctccagtggccctcttggatataagccacagatatgagcgtgaatgacgctggttgttctacatgaaacttcctgatgtgaaaacttttcacctataacctcaaaagtcagctatagctaatagctcatgagtatgtttccacaatactgaacattttgataaaatacactttaaagacttcctgattagaaaagattaaaaaaaaatgttttcctaggattatactggaaattttgagaagcttcttacagcactcaaaaagagttcttgtgtatttgttgttgtctggaacgacatcatcaaggatcaatcacattctttaagggctaagtacgttcacaaaatttccatttttctctccaaagcacatggaaataatttacatataaatgaagaaacatgccaccctttaaaaataccagtttcttgacatatagtccaatggattgctacaatttcaagtctttaatagattcaagttgaaaggaatggcatgtcatttgaaagcgtttccaaagcacaagggcagccttgttttgcaatgtttctgaaatatttggtttaggacatggcaccagagggcttggcagtgaatactccgaagaaatgtaaagtttaatcaatccatgaaaatcagtcccagatgtggcttacgagtgacaccatgtttttaaacataatctggcataaaaagttcaaaggtaatagatatcagaaatatattcctagtgataaaactgtaggtaaagtttatttaaacctttattatgaacccactacacgcattatctgttttatgtcttatagcatgtaaaaaggtgagaaaaacatactgtcctgaatatgctaccaatcaggtagatgaaagcacaaaaaaaacccattcattcattcactcactcattcattcaacaagtatgtattgaactccaattcagggttagatactcttttggcaccatgactgtgagatctggttcttgttctccgctatctctgcgacttttcatctttagtggggagaaaagacaggtaaacagttgattaaaacctagtaagaattaggttcaagttttcacaggatgtggtgaagctcagaggagagagcagagcactggtccagttctcaggtctggggcctggaggagaattgccaagggagatagagattgagcatagtcagggaagggtaatcccagcagataaagcaaactgtgtaaatacggggaaaagctagcaggaaacaggcaacaataaattcattgtttctggagacagtcttaatgggacatggcaaacagagagaggatactagtgagagagccaggtgctgcgttcctgatggccaaaaggtcttgttggagagtttgtattttatcttcagggatctggaaagccttgaaagatttcaatcaaaaagatatttaaaaacatgacagagtaagagaacactaagttcctcacttaaaagttatggcagacatttcaaaactgttcaccaatttccagttttcttcttccaaccccacaggaaaattgtacttccctgcctctttgaggttaacaaagttgcattgctttggaaaatgaaatatgatccacttttcggggtggaagcatttaattgtgacttctggaatctctaaccctttcttctgtcatggtgaaggtagacacctgtggtttatatggcggcattgcttttggcaatcacatggagactgctggcctgcggggttctcagatccacagtggggtcgtccgttattggagtattattttgcctaccatgactagtacacgtattcaagtaatggagatattcttataattaacaagctactagctctgatttgtaatttgctcaattagacaaagttaagtgtgttccttgttaaaagtattcacctgtctaaagtttcttgtcttagtaaagcaagtcaccgcttccagattttggaagtggtaattaacagcgttttgcttatggatttacttataattagtttttgtttttggaaatttgaaaaatgcaaagtttaaagaagagggtgtacatttattctaattacttttagaaagaagtagtacatcagtaatatggtctcagtgttaaaatattttaaaagggaccaggcatggtggctcacgcctgtaattccagcactttgggcagccgaggcaggcagatcacctgtggtcaggagtttgagaccagcctgaccaacatggcaaaaacccgtctctactaaaaattcaaaaaaattagccaggcatggtggcatatgcctgtaatcccagctatttgggaggctgaggccggagaattgcttgaacccgggaggcagatgttgcagtgagctgagatcgcaccactgcactccagcctgggcaacaagagtgaaacgctgtcaaaaaaaaaaaaaaaaattaaataaaatgtagattaactcctgaaagtgaatactgtacatgtttgcatgcattttattctttgtaccttgtgactgctggctacttactgccttcctcctgataccagtttttctctactgcatatgtcaataaatgtttagaaatgcttgaagaatacagagaaagcccaaagtgttttttgttttgttttgttttgttttgtttttttcagaaatgcatctaagtgtctccttacaaaatgagagaattcattgattagccattctttggacatgctcttaaacgtcctctaccagaaggaatttcatattcctatcacaaaagggaaattgcttattcttatgtttataacaccagatcttttatttgatatatactatgtgtatatattatacaaataagctctttataaaagataaccatgaaggaattatttcctgaaacggcaaaatataaatttgcctgtaaaatcagaatgccctagccaatcttttgagatttgaccaggatgatcctgtgggtaaggaaactaaccctttcaaattgcatgaaaattagaagacaaatgaagatgttgtgaatggaaattcatttccaaataaaccactgggataaaaatcattagaataatgctagtttcaaaatctatgtttttccgtctctttgtcactcacaattatttcaaatatgttcactttaaagtacagtatatatacctagttaggttgagtcatgttttagaaaaattccttagagtttgtttttaagcaaaacaggactgttttaaacaaagcagaaccttaacaggaaactgataacagtggccaagaaaagcatcttattttctattttctgtgtattagaaagaaaccctatttctcacttcctcatatggtaattatatctcggtggaattgaatcctcaggacaacagggcatgttattgtgagatattttacacctggcttaaccattctgtaaaatcagagatagtgactagcccagaggctctgtctcacttccttccggtgttgcttagctattgataaatattaaggtgcatgtgatttggctgctaaaatgaagaaaggatgtcagaaggctatcagtttgctgaatcaaacagcattgccacagggctccaagctggcagggcccctctgggcattgccaggtcaccaaggaagtggctgggtgaggtggcaacaggtgtcagacatgctgctgagcagatgatctcagcaggcctgaggacagaagagaaggttaccacacaaagtgcttagctgtgaccgcagaggaatttcagcatcaaaggaatttgagtagaaaaaggtttcaaatttcagttaacccagggttgaagcagcaggactcattgatagaaagagagaagcaaataaaagcccacactagttaacataactctcaaataagaatgcaattatctgcagccacagtagcccatggaaagatatccctaaccagtcattcagttgagacatagggacatcacctgggtggaaaggacccttacaggttgtgaaggaattataagtgaccattagtgagtggtcactatgtaccagacacagctgtaagtgctttatggccattaattcattccatcttcacaacaacactctgaggtaagtattcatatttgccttattgtacagaggtagaaatggaatcataaaaaagtgaagacatcagccctagctgatacagcaagtacagaggagagccagaatataaacctaagaagtctgtctgtataaaccatgctcttagccaccaagtttcaccatccctcacagggagaaaactgcagagcagaaaagttctggtcttactcctaagaagagatgcacattacatacatgaaaagataccaaacatgacaacatagaaaatgatggatgccaagtgagtgccaggaactatagagctgttgaaagagattcattgcaaaacaggttggaataagcaagacaaacttgagaagtggattctcacattgagtgtgaacaagcaggggcagtgtgatgtggaggaagggagcatgtactctacaggctttagcttcagaggggcttgggttcaaatcccagctctgccacttacaagtcatgtgagcttggggaagttacttattctttgttttctagttttcctatctgcagggatagaaaaatgctatttcaaaacactattcatgaagatcaagcaaaattagttataagcaggtctcagcatacttggtacaaggtacacatttaatatgtgtactattatccaactagggagagatagaaagggagcttcaggtgagaggaacagcataaaaaatgatccgcaaaagccagaaataaaacttctatgagctcagttcaagctgactgggtaggtaaatgtctgccatgaacttggaagtgagagagaatctcccttggacactcattaaggggcctcaaagccatgaagagttgccatgtggtccttccagtcaataaataattttgtccaaacacgagtggaagaaaaaattaagagacacccggatggggaaaacccattctctttttggtgagacaatctagccagaaggacactctcgccagctagagctctgcatatccaaacaagcacaggtaaagtggaagaactgaccagaagaggagaaaacatgaattaattaattaatcaaagaaacacctgtaaggttccaagtaggtggcaggtaggctgagtgttagtgtatccagtcaggcaggtggtgatgacaaagggcccccaggaaactcccatttgtgtgagtgagaaaggcaagaaaacagcatgcacaatgctacttgaggagcgatgtttgaaaaagtgatgcacaggttgcaggggatgcacagaaactagggatgcagcactggagtggggtgagaagcttccaagaagagacaagccttctgatgggtctcaaaggaagaggagggtctcaccaggcaaaggggttgggggacacattctagtcagaaggaacaccatggacaaaggttgatgaatgaagcagaatgatatctttaagaagctgcaaaacactttccaccaggagggtgcagctggggtgtggcacatgaggttgtgaaatcaggtcctaaagaggctggaagaatgtgtaggaaggagatgggctccgcttggctcttaggtctctgcagaaggaaagagaaggagaatgggacaggtggtgagactggaggcctgtacactatttagaaagttactgggccaggcacagtggataatgcctataatcccaacattttgggaggctgaaccaggaggatcgcttgagcccgggagatcaaaaccaacttgggcaacatggaaaaaccctatatttacaaaaaaataaaaaatgagccaggcatgttggtttgcacctgtagtcccacctacttgagaggctgaagtgggaggatgccttgagctcaggaggttaaggctacagtgagccataactgcaccactgtactccagtctggatgactgagtaaaaccctgtctacaaaaatgctctaaaacaacaaccaaaaaaacccagaaagttactgcatggagcccagaggagaaatagttgcagcatcactgggaggtgtgggtagtggggtgaaaaggctatggcgtaagcctggtgaggaaaggcaaagcacctgatgctccttggcttcaagtacagatggcaaagcaactgggcaaggaagtccctggacagatgctcaggatgattacagcttcagaatgctgaagtgcagctgtgcctatgttttcttcctcctgtcctctgccacactgtccttcgtcaccctctggggcacctcccctcatatgagaattgagaaatggagggagagtacatgagtagtggggagacaccaagacagcagagcatagtgaagagaggaggagaggggaagcaaaacttaaaagagactcaatgaaactgggagtgcttttgctaatgccactaggaaaaagaaatgtgaaaataaaattttatatataaatacaaacacatgcatatgagtgggtgggttaaactactataccacctcttagccagaatgatcttttctaattagattaggaaatgaaagtgttagaagactgaatgggtaacatttgaattttccttttgaaagatgggccatattttgactttagaggaaacacagatgggaagtgcattcttgatcttggaaatgttgtgatgatccatcactgtcagggtgaagtaaggatctttagcatggccaccagagccttatctcccacctctgtgcctgcctccaccctggctcttctgctgcctttatattaaacatttgttcattcaccacataaggttctctctcttgccttcttttcctggttaattcttactgatcctgcaaatcacagcctgaactactcatcctcagagaagacattcctgattttccctgaacagataaaaaaacccttcacagatttttgaaccctgtgtgtctttctcccgtagcatctgatccagtcacagtttcatgtgtgtgtgtgtgtgtgtgtgtgtgtgtgtgtgtgtgtgtgtgtgtgtgagagaatgagagagagagagaaagagaatttgattaatgcatgtcttccccagttaatcataaactccataggggcaagaaccatgtctgatttggcatctacgaatgagtgatgaatgcaaataatgtttggctatggggggatgaggtgtggccatgtaggaagatgatgtcagggtgtggtacaaggttaaggaagctgcagctaaaaaggatgccaacttaatctattttggccattttgtctaccctaagtattatgttcacactgtatttcttctttctggactaagaaaaaaaaaacatgtttgcttgtggggtctttttttccttctaaaatattagactgcaaacaaaggcactgttgggtagtatatttttgttagcacccaaggggaaatgactgtgttcttgggctctccaatttttacattacatgttttctacatgagctttcaacctaatgtaagaattaaatgcaaatttgaggcatatgaactattttatgcaagatcttaaaattgttttccttgggacgttcattgaaagtatggctcattactgaaaatctattcttcagtgtgttcctaaccatctagccacgtcaaaaaaagttgctttaatatctgaagccaaatcgctgctttcctttgtgattacaaggactctcttggtaaatcagagtatggccaatgtccagttgctaaaggtggaaactacaagttactattctccttaagttaccagcaagatacagtcaacatgtagttctttggtgtctgtcaagaaagtacagagatttataggtaaagaagtcaattttcttatcatagatatagttgtcatatggagagtatgctgattagaaataatgaaagcaagagataaacttaaattgtggaattatctgagaatttccattatccatgtcccaagttaactgcaaacaatataaagttgactatatcaatttttatgtacagaaaaacatttgggacacaaatacattttaaaatcttaagagtttgcagggtaaaaaacattttgggggaaaaataatttttctaagggtttgagaaaaattcagcttatatttatgtatttcaacttcagtaaggataaatggaacagcaccactggaattgaacaattaagtaagcaaatgatggatggtagtttttcactgttggagtggaagattatagataagcaagaggaagaagctagaatgacccatgtggtaatgagttagatttgaaaatatcagtatgaactaatgcttatctatctatcatctatctatttatgcttcctgattgttagatatgtgtacatacacaggttggtatacacaaatatatgtccttgctctgtcagccaagaaggccaaaaggaaatgacaacccaaaaacaatgaacacacctattgctcaaatcttggtttttaataccattttccaatgaaaggaacgtgtgctccttggagaaatggctgaatctatgatgaggaaggagttatattgttgataagcctcaagtattgtgtaatgctagaaaggatgaaagtgcatcaaaacaaaacaaacaaaaaacagaaaacaaaaccaccacaattgtggggatgtatcaaagggacacaagaaatagtacccaatggccaaagctggaacaatttcacagcacgattagtatgacagtagtggattataacctaagcataaaataaatatccatgagtccatactgatatacataaatgctgaataattaaatgagggagaataagcaaatcttctgtggagaagaattgcaaatattttatgtagattctctgccttcaaggagatggagtataacaccctcttaagtgtgggttgtttatcatgacttccttccaaagggtaggtatgaaaataataaaaataaggaaaaataatacatttatagtggaaaaacctgaccaaatccacctcgatcaggtgatcaaggttaacatctttagtcatgttgacagtgtgatggaaaaatggcacattaccctctgtggtctctctccccaaaacactaactacagtctaatcatgaaaaatcaatcagaaaattccaactgagagacattctacaaaatacctaatcagtactcctcaaaactgccaaggtaatgaaaaacaaggaaaatctgagaaaattctatagcaaagataaatgaaacacgagaactaaatgcaatgtggtatcctgagtggggccctggaatagaaaaaaagaaccttaggtaaaactaaggatatatgaatgaatagggactttaaataataataatgtaccaatactggttcattcattgtaacaaaagtatcatactcatataagactttaataaaaggcagtgggtgaggggtatatggaaactccctgcactatctttgccatttttctgcaaatctaaagctgttttaaaataaaatttatctttacaaagccctgaaagcctagaaatttaaagtaaactcgtacaatcaaatagtaaggcctaatcttactgacataagccaatatttaattttctaacccaaaatacaaactcttcttcacatgttaacctctatctccattttctatgtctacatttctttagaagaccataaatcacgctatattatcattaattagagccaagttaaaatgttaaaattgctaaacatatgactcatttaaacaaaggtttactaaaagacaggaaacaatttacaggaggtatgcattttctgcatggttgcatctttcaagaagacaaagaaagggattaagaatacctttgtcctaagatacaaaaaaaccacaaggcaaaaagtacgacatataaagttttacaccaaacaaaaaagagaaaaatttcagcaaatcaatgttatcatctacttatgattttttatcattgcaaacaacgcatgtttgtccatccttacttcgccacctggaccaatgcaggccatgtcatatgaaatgcctgttctgaccattagaacatccagactcattctggggcttaatctcttttactgcaggtgcatccacttgttatatttcagattagcagcctcaaagaactagcctcttcccagtacccatccttcaattactgcatcattttctctaacaattgcagtctttcaaccactttatatgtgacaaggcatgagcttgcttcctctcttgtcactctcctgagtcctcttctgtttgtctgcagcccaaaaggaagcacaatattccagctgaggtctgaatgatgcagggtcaagtgcattcattacctctttattttgggttattctggttctattaatacagcttaagatgttatgtgaaatttccaaaataggttccatattttaccttcaaaactgtatggcagacacaaatactacattatctgtgattaccgtgaatgaggttagcacattattatgtggttgtgaatatcatacttggcttcctggagaccgaatattcatgtatcagggccctcctgtgatgacacagtcagtggcgccctcacaagggcataccttctagccttgtcttattctttaaaaaaaacccacattctttctttgttctagctacacagctggaaaatcagaactgaacataatagtgggaagagagtactctttaatctcagtatttaatctcctgatactttctggacctctgaaagtattaatacatgcattcccatgagaaatattattgcttctctaataaataaggatgtcatacaaaattaacaaattaataattcaaggacacattcgggtgccaaagaatacagttttctaatttttacaggaaaatatgtaaagtaatataaaattttcacttgtaaatagtgcaaactgtgttagaaaaaaagacaatgcagatgagagatttccttgaaatgctcttaaaatcatgttattgatccgtgtaagtcagctatatcaattctactgatcaagaaataggtattttaaacacaatgctttcaggagtatacaatgttgacaaatatgcaaaaaaaaaaaaattgcaaaactccaagaaaatcaaataatgaatgctagccaaatttctatccgaactaagctaactcaatgatattatcgttgtctttaatggagaaacatgaataaggataatctttagtggacttagattaagtaatacaatgaatagctataaaatttgtggatcagaattagaagaggggaaaaacacattaatcaagtagacatgttaacaaaataatggattagtcaggattacatttgaataaattagcaaagcaaaagaaatacattaaatatctaatatttagtaacttagaagagaaaaaaatgctgtgtattttacatactaattcatacacatgcccaacaaataactaccgtttccagtcttcatgtgcaccataacatgtgtaacatatgaaacaaaaatttgctcctccctgatgtatattggtatgaaaatcttttaaggtaacatgagaatgaaagagattcttcttcatgctagacatagaggtttttaaacacatcatttggctgacgtaaagcacatttgcaataggcattagtaacctcaagttaagaacaatatatgccaggctgatgtactggacacttcctaaatactgtactcagcagttttggagcacttagcaatgatgaattggtgtgaagactcaggtactgaaaggtcatttccctttttttcttgaatcttttgcttgtcttgattgacgctctgaagaagccaaggatacagaaggggtggagaaagcacgcaacccaaattacccaaaggagctgcttataatgaacttgaatgaagatagattttggggagaggtgggggaaagtggccacaatcttcaatattcttttgaagtgttactgctttcaaagttgtgatttttctcaaggtaaagctgtttgacacagatagactcatctgtcaatcaaacatcttttactcatggccaggtcaaatacttgactattctagtagtggtatcaaactcttagtgccaatataaaacagccaactcacctagccagggaaaagaaataataagaaaatgaaaaagtgcactgagcctttatatcctgtattcaagaactgcatttcttttttatttagttgttttgtcattgctgtttatcagtttttgtttttgttgttttgttttatgatcaaatagttttagggggataatatataatagccatgtcacacatttctgaaagaacaacttatttcacctggccccataaatggaaatatttcataaattccagaagctttggcattcgtctacatcctctttccagactgcttgctatttcataatcattttcatgattctcattttccttatgaattgaatttgtgcttgaaacatttcaagcctagggaagcaatcttgtgagctgacagatcttattgggagcaaccttgttcagaattttgacttccacttccactcttacacaacaaatgtccacgtatagactcaacatttgcctcaaaaattcaagtctccttaagaattacaaaaggttgtatcaccctgtaagactgttgccattacagatggcataggactcaggattctaaaatctagtgctataatgggctataagttgggttaaagaagtgagaatgctgtgcttttaacttcaaaatttggcaagacataccattttttaataagaaacatattttttatttggattatccttttcttatactatctattttattatactttctttaatagtatttaatcagattttaatgaaatctggtacacaggttttttgttttgttttgttttgtttttgtttttgtttttgtttttgagacggagtcttgctctttcgcccaggccggactgcagtggcgctatctgggctcactgcaagctccgcctcccgggttcacgccattctcctgcctcagcatcccgagtagctgggactacaggcgcccgccaccacgcccagctaattttttgtatttttagtagagacggggcttcaccatattagccaagatggtctcgatctcctgacctcgtgatccacccgcctcggcctcccaaagtgctgggattacaggcgtgagccaccacgcccggccgctttcttttaattataaactaacaatagtatttacaattttcaaagaactttcaaatatactacaatcttccacagaaatccataggggaaaaaagggacaggagaggaactaaaatatatcaaacacactaagttgagcagataccatgatttatatatgtatatcattaatctttatgcacaacttaggacaaatttctttctgatcttagtatcataagtggtgtgcttccctgatccatcaaattgtttatccaatggacacggggatttgtgtttaagcttcctgatttaccctggatcctaggaagcttagtgagaactttacattccatcttgcatacccttggacttcatggtctgcttaactcttgaaagatggaaggccctctgcctcccttgagatctaaacaaaattgatttgaacttcctaatttcatgaccagtaagaatcccaaaactcacctctaaatttctgataatttcctaaaggctgggctcattgacctgctttgccaacacaacacagctcattttgattcacatgccaccaacaccatcaaaatcacttacttcaggtactcctgaggcttcaagtaagacatacatatattagtggtcttcccacccctagcaactccctgtaccctccccaatacccctcacccaccgaaccactgtcagtactggggagggatctgtttatggagtatacccgcagttctcagccttcccagggcgaattttcctcatcctgtcctctctcctaatttctctgcctcatctccatcattctcattggctctttagcactaaattcttcttctgttatgcagagaagttttcacccttagagcacttgagcacctacctatagtcagatcctcagggactttcttcctatcccaagggcacgttcaaaatagctcttctaggccagctgcagtgactcactcctgtaatcctagcactttgggaggctgagatgggtggatcacctggggtcaggagttcgagaccagccaggccaacatggtgaaaccccatctttactaaaaatacaaaaattagctgggtgtggcagcttgcatgcgtagtcccagcaactcgggaggctgagctaggagaaccgcttgaaactgggaggcagaggttgcagtgggatgacatcacaccactgcactccagcctggacaacaaagggagactctgtctcaaaaaaaaatatatatatatatatatatataaaaatatatatttatatatatttatatataaaaatatatatatttatatatatatttatatatataaatatatatttatatatatatataaatatatatttatatatatatatataaatatatatttatatatatatatatataaatatcttctagcaaagacatttttcttccttccccaagaggattctggtgccgtttgtaaaggtaatatatatatatatattttttaactattacatacatatgtgagtaggaacatcataccttatttctctttgcccttcatcaacattctccctataagttatgcacatataactttgttggttgtcttaaatgctgcctgggaaaagctgcggtttaaaaatgacaaattaaataatgtattatctcattgaatccttacagtaaatctgggtgattggaactgttctatttttctcttataaatgagttaagtgatgctcataaaaggtgatttgctcaaagttaaccagtcagcatcagagttgaatttgaacttggttcaatacagctttaaagcatgggatctttcccttgcattgtactactggttaagagagagaggtatgaaaccctcgaatgctttatcaaaatatacctgtcacttcctcttcctacccactcttcaacctccagattttcatactccttattactttccccccaacaaagtcttgcagttatttctgataaatgatacaactgccttccctaatgacattctccaatcctcaccatctccatcacactgagaactatggctttttaaaacattgaagttaatttttcaggatgttctctgacaaaactacatataatgatataaaatagttattgatactctttcataataaagtgagaataaaacctcattctatacatatatagtgtgattataaccactatactaaagaattgatatatttaaaaactcaaatataggatatgtatgctagaataatgagagaaattaattaacactgataatattaataaaaattatcatttctacaatgagactagaaaggaggaggccagatgaggcagagctttatgctgtattacatataatacaaagctagtacattttcttggcaagtgaagagatattagggagatgatttttagagcttagtttgacagtgaaagatgtataaaaagaacgaagagccacacgtagaggctggtctatgtctgaagaccacatcatgtactgtgatgaaaagtaattaaaatgaaacatcaatgttatagatgcagaaaggggcataatcaagcatcagagccagctgtggagataatttacagacttttatctcaccagcaagataaaacatacatatcttcaaggaaagaaagattcctatatgaaagtgaatgagctagttattagttttgaagaaatggtgtcttagataaggtgatttgtagcaatagcatttagattttacagatacacccagttcggcaggatggttgcttctacaaatccagttaaactctcccaagtgacagaaatcaagatatgtgggaattatttatgctcaagatgacaatttttatagaaacagtatctatccccccaaaaacatgggctatatcctaaaaacctgaaattaatattaaaagccgtaaattcccaggacacaattctggaaaagtaatgtttactctaaaatcattttattgagcacctactatgtgtcaggcactgtgctaagaacagagaatctaatgaagcagggcctgagtaagacagtcataaacagaaaatccatcctgtataaggtaggcactgactcaacatgggagggcacatcagtcgattcttgctgaggcttgagagatgaggaggtataaattatccctcataattcaaacttaacccaaggtattgtccctgtatttactgaacaagaatgtgatatagaagaggcagtttagacctccaagcaacctatagttaatgggtaagatctaggttggaagtggcctgccactgattaccctaggcaacctggttaaccattcacagctagttgcctaatctgtactataacaatatttattggatacttactgagtgacaggtgttctaagcactagactggttttctcatttaatcttcacagcaaccctatgcaatgagaactatttactgtccctatgttacagatcatggagaggttagataagtgacccaaggttgcacccttagtaagtagataacaagcccttgccacagacttgggggatgattaagtaaaatgatgtctataaaaaaattagtctatacttggaatggataacctgttaaatgtgatagttattatctgtattattttttatagcatacgaccctaccttatctcaaaacatagcacaataacattatttgaaaaatataaagttatttaattaaaatttcccctgacaatataatttttatttatcattcttttctgtacacataattatttattaagaaaaaatttaaaaagtacctattaagtacaacaccatgctgggtattgtggtataaagtagaaaaaagtagtcgaggtggctactgcaatgaatagaacagattataatgttaatacctggtctcaaaggctagcttggtctcagaaagttctttgaagcaaaaggttgtgtgcagtgaagatctcacagaatgtggtcaccctttcaaatgatgacatcctgaggcaacttagcattcaacctctctcaaaaatcaaatctggcacagattattttctaaaaaataggacttttcccacaaatattttcttcttttaaaattaacacacccaaaggtttaagactcaaatgccttactttaggacttgtaagaggtctctttcactgatctcaataccactacggttttctcaatttgcccactgtcacattgctagctttcctttcttctctagaacatcaagggactctccatcattacgccaattatttgttttaaacatagtgagcaacccaatgacaaggttcttaagattgaggacttcatatcatgttatttccttaaattaaatggaggatatatgaaaaaggaagggcctgagacctttatcaagagaagagttgggaagatatgagaaatgtataggttgcatatggaatatgttttctcaaatactgtggatatcagcattaacgggcataacgctgctgtcttccccatgaaaaaggctgccatttaaagttaggttttgtggagaaggaattaagcaaaatacccaaggtagacaggctaaggatattccataggagaggccaaatacttgagaaaagcatcagagctcagtcctggaggtgtttgttgatttatgtgtggtttctctgcattacctttaatggaagaacaattatgcctgaataagacagaaatgagtaaattaactaggtaagatataagatcatagatttttatagcaccttagtgatcagttaagtcaaccttctcattttcatatttagaaaagaaaaatatggagactcaagggagaggaagaatgaagttccctgacaagtgactaagacttttagaatcttatttagagttttagagccacagcaaaaattctacaaagcaagctctgtataaagtagtggtgagcactgaatgctgacaataatagcggaagctctgctgagatgattagaagagatgaaaggaattcataatattggctaaagtcacagtatcctccagggtttattctcatgacctagaaaattataaggctatttaataatatcccttaacttacatattttatttgtcattttctcctatttatcttggagacataaaagagaatttaaatgtataaatatttaaactgggttacatcagttctggttaaagtcatattatgtttccttatttccagtacatttctcagagactggtgacactttcaagtaagcttcatagcggttttgaagaaatttttgtaaaagcaggttacatatatatggatttgtgacattctaacataaaccacagaaaggttcctattaaaaagggagcaaagctgaatcattttggcttttcttcccactgtgatttttattcatttgaagataaaattcaaagcaaacatcttaaagcttctgtttgtcacccaagagttatttcaaggcagcacaggaaatctcacattttcaaaaaatcaggtcatgaaaatggaactgcaatctaattaatatgttcataaaacagtttccaccactaccaaataaaacaacaacaacaattaagatcaactctgtattctttggaatcccaagaaacacaatccataggagacattctcatcacaaaacagtttcaaatttaataattaagaattgtaacatttctgtcacatctctactcatttccctgacataatactttgtgtaaataatttctcaagtagagtaaaacgtcttttattgactggatatattcattcaacatcactgacctttttccaacttgtttgactgtcttgtactctctcttcaataacctttccaattccccctagtagctgttccatcatcttactaagctcctccacctgctcctccctggtcctctttctgagatgtgatcttgaattccatttaatacttcccagagaaaacacagggcataaaacaaaaactccctcaggctctccttccacctacctaatctccacattatctgcattctccctccttttcctccccctatcccagagggtgtcatgtccacaagtttcccagctctgtatcagaatatttccttagggacatgcttcctactcttaaaagtgcttggtgttcttcactagctactgtgtttttctcctctccttctcctctttcctcctcttcttctcctcctccttcgttcttaagcaaaattttgaaagaagtagtttgcacaacttttctctgcttttattacccctgaaatataacttacccccagacactcccttaaaccactctctgaagtattatcagtaactactaattcccaaatccatcaaatatattttcactttgaaacttaaggtatttggatcaagtcagttaagttgtttctccttctgactcctgtaacaacttgtatatatctatattaatatgctccatactatactgtaattatttgtttctgtggctgttctccagactagtttatgagtatctccaaggcaggactcttattacattcatctgggcatcccctatgaataaataactcagtgtgttccacctgttccaatataattcactaaccatgacatttttcagtaactcagaaattgggctattttatgattaaaatgcttctttggcaattggatctgatttcagataatactaatattctttacttgagcacaaaatgaagtttaaagacatacaattagttgaatattttgaagaaagtaataattatggcagcaaaacctaaaatgtggatgatcttttatttttggcaaagcattctcaaaaccatttcatctgtcacaaagtaaagctggagcccgtatcaaagcagggccagagataggcagtttgaacagggctcaacaatgccccgcagagatggtgaatagagctgaattcatctatgctccacacaccaagtgtgtacccagtgggaagagtgacttttgctttgaacagaggctctgtccattcaccaagtactgtagtttgcatttctacttcatctgttcaaagtgtgacacctttcctaatatatcgtccagagaggcactttttagtgaaaggatcctataggccacagtgaccttggaaacagagttcaccacaaattccttttaaatttctcattctgagaaaatacagaaagagctgctgacacagtctaagtataggtcattgttctaacattaaaaggaagagtttctcaaggaaaggctattcacattcagtaagcatcctacatacttagccaggctgctaaataacagggtaaatctgcttattttctctggtctactgctaatctaattttcaaaaagatccataaacaagagtgctaagtcatctgccacaagaacaatatggtggattaaaaatatattgggctctaaaatcaggccaggcctggttttgagtgggtcagcttccctagcaatagatatatgaactttcagcaagttatctaatctctgtgaacattaccttcctcatctgcaaacagggatttggataagaaattctcagaaagttatattgccattaaaggatgtaacttatgtgaaaacatatggcatgcagaggagtgctcaacagtgttgatctcttccatgaagtatatgatagttatacaagagattttggcatgtcattgtcaacattctaataaattcttcttttatttttttgagacagggtctttctgtcttgcccaggctggagtgcagtggcatgatcatggcttatcgtagcctcaaccttctgaattcaagagacactcccaccttagcctccctgagtaactgggaccacaggcatgaaccaccatgcccagctacctttaaaaaaatagagagagagacagggtctcactatgttgttcaggctggtctctaataaattgttattaccaatgtgctatgagattttctttaatagcctacttcttaacatgaagtgggtaaatatctgctgtaatagttttcaaaagtggtaaaaactcaaagagctttcagaaggtcacacaaaacattaacactccagaagctgaattagaaacctggagtgctttttttaaattatttttttttagtttatttatgtttccagccaatagcctgattatgtagactctagattatctatccttgaaatcatatatggagagatatatatgtataaattttacacaacataatccctagttgtaatatattgtcttgggtatgtttataggctggtacttctcaaacaactggaaacgtcacctaatagtccatcaagttataagcagttgcagcagttatggcttggagacatttttgagctattgcaaaaatgtggataatgctatagctagacagagtattaatgagcattaacgtttgtgggatatgattgaaagaggagagaaaaggatgagggatttttttaaaaaggaacattcgacctatggcaataaaaaactggttgtttagtttttttgggttcttctttgcatctcagaatttgaaactattttcaattttcctttacttgcctatttttctctgaacccaaatacctcaacattagtgtaagtaactcagtaatagtcaactaaaaggaagaagcaaaaaggagtggaaagtgaagaatttaaaagaagctaaaacatcatacattgttagtaaataattttcatatgatgaggaataatttcttatttttttccttttgtaagatttctaagacctccctggcttatgccactcagtcctttgaagatgtaacctcacagcgatttaaagtgcacaaactattttactacagcagaaaggctgctaggactaaagactatttttcatttccataagttgtaagcacattgatattactaataacaactttgctcctctatcatagcatacttaatcgaattatttttaaaaacactaaaacataaacatttgtaatttcatttttaaattccaaggtattactagaaaaaattaaggggcatacagctgatggcaacaaaagacagtaaaatagaaagccaagagaaaagttttatgtttaataggatcgatatctcatataatggaaaatctttgctacactatatctaaacctgaatttctgccttaaacaatggctgactttaacattgagccctagggatttgtgaacgagatgagtttgtataattatgagctccatctaaactttattggtcctaagtgtttacaagtaaattgtatttggccccaacaggaattcagaattaagctggcagtctggtatttatattttagaatttctgggttgttctgtaacccagaggaagagatgttaaagaagcaaggtcagctattacctgcaatttcactggaagacaagcagacactgcaataattttaagttaactaaaaggagcaaagctccattatcttacatgagacttgatacgtcatttccttcaacgtatacatagtcatcaaactcaatattgctcccaccccctaaaattctaataaaatataatgtattggtcagaacacatactctggaaaatgcacttctggattgagtttctgtaatttcaatgtatgaagaggagaaaaccttaaaagatgaaactctatgaggctagataggaaggattatcttttcattagaaggcaggccattctgactttctctgaatacgtattcattatattagtagatttaaacacatatacatgcaaattatgaacacatatatgaatatattatcaatatactgatttatatcttgcttcattccataaaggatttagatcaaaacagaataaaacagtatgagttagtttatgaattgaatgcttggtctatagaggaacaatcaaacaaataactttctagactaaaccttttagaaattgatacctggaaaaggacagtctaatgaaagaatttagggtcctagaagaaggaaaaagatgcctccatgttgagtgaaagtgccacagtcacctcattttgcctcttcactggagttacctctcagcatcacaaagacagtttaaaacatttagatgtcctacctttaaaaattaaaccctaagcaccaaataagcaaatcattaatcaccttccacaatcattaatcccaaatcttcctctggtgtcctcagaggggccctccatggcagcattccacagcctctcctagccagggcctttagcttctatcttccactgtccttttagccatgtgaatccatcattaaaaggatgcaaaggtatttaaataaaatgccctcctaaattgtttagctatgaaattcaattgcattcaacatagccttgatgtttctggcatgaaattatagtatttttacaaataagattataaaaagttgttatatatcttttaagtcaggcaaaaagctgaacatgttagtcacactgtgttaggtcattcatgttagaccctggcatgtgattccaggtcataatgcttctaaaggtcctcttaactgctgctacatgaaatttaaattcctagaaagctgacttgcatttcccttctttcaaccatgccatacttgttcctgaatgccaggctatctctccattctaacaactagccagaaggaaaaataagaagagctatatagtacttatctatccagtgaggcaaacccttatctttgtttggcttggcagtaaaaagactgaaaagtgtaatggaaagaagccttcgcaataaaatcctccagctaatatttctaatgtagcttcaaagaagaaacacacattcttcataccactcttttagcacggaaggggtagtgttctattaaaccaagtaataggaccacttattaactttaactcataactgataaagagtgaatttgtaatactattgctcaataatcaacacaccagccctagggcaggtggatgagagtacaagtaggaactctgtgcacaggcttctatttcaattactacttctggtaaaatttgaagactaccctagacctcctgtgtctcagctttttctcattcttgcttctcaaaaagcaggacagaaagaggaccagcacatgccaagtcccgcctctccaaagggtacagagcctttctagagatgagctagggctcgtgaaaccaaagcacatatgtcttttacaatgtttattattccttagcactggcctgttgccaacttctgatcggtcccttcacgaagaaaaggctctaaatgtgagaatgaggatagggggagtctttggagatgaaaagagcaatttggcgagacctttattctaagcacgataattcacgagcctgaaatctcaccctataggggctcttacagtaggacaaagggaaagagggttttctgtcaacaaacccctacaatctcttactgcagtactggaaggggaggctataaataagaggaaaacaacaaccattgagaaagtcaagaaccaagcacaaaattaattaggtcacctggaaaaaaaccaccaccttcttcctttgagtccaacatcatattaatgaatccctgcaaggggcccaggaagagtaggagttatacagagcattaacattctacattggcttagtttggccacaacaacaacaacagattggtacgacatgcagtgaagcagatgaagggttacctaactccaggcacaaaagaaaaccaacaggactctcaacttctccatacagctttcaaacatatgtattacagatctagaggagcatgaataagcaaatttgcattctttccaaaacttcagagttgaatagcttatttctttccagtcaaaagtataggtgaggctaatgcaataaaaataaaaagtgcttataattgcaggcattcaaagagtacatggatcctatgtattacaacataaacaaatgggcttaaacagcagaacttaggtagaacaaaaactgttgctttgtagcaaggtacacttgatagaaaggagactggtaatttcccctcccaagcaaatcttaagaggtataaaatgaactctgaagaaaagcctaaggcatagaagaaaaataattgacaaatgcctactacgtgccaggaactgtttccaggatcttttaatctcaagattaaagactattgatgtaaatttgtctgtaagaataatgaggaccttattgctgatgcctgaccctcaccaacagaacaagcaaggcaatggcaccaaggctccccctgactaggaaactctggtgatgcagttggaagtgggccaccgaggtttgcaggcatgtcacccaagcattctagagactggggatagtagctctggtcagcaaaaaaggtagatacgccacagcatcgactctggatggatctggtgttgttagaaaataagcacctgcctagagtgggagaggatgcctcccatccttctctgcaatggattttttagctgaaagccgaaaactctgtaacaaaccagcaggtgattttggtggtaccttaagctctcagggagctttcatttgagacattgtcataaaagcagctggaaagccctccgaaacctatatttaggtatctattattcatccagagtccagccagaacatttacctgaaagatatactttcaaaatcagacaaactgcatttccaaaacaacccatgttagcagacactaagccttaacatgtgcctttattatgcattcacaaagtttctgctatgaaagtcagaatccagctgaccctaaaggtatggcaaaaacaagcaattttaaaataatgaccttttgctcttataaataccctcagcaatgagttcctacacacatttagtcataaactccagcaagaaatggcacatgatatcacatgtccagggacctgaatgcattgcattgaaccttaatagatgaccaaatatcaaggcactaagcaagttctatgagagcctgagcacttcctgattcatatgttagaattctactagaattctactggttcattctggtagaaatatttcttgaatagctaaaatatccttaactgtgaggcaccaacacattttagcattattttaaaattgagtcaacattctaagtttcccttaaccttcttttagaaattcagacaaattgatatatcagaaattcatgtgtgcccttccccagggaattttcaaataaaaatagcaaaacaacaaaaaacaaaccctaagcctcatctttaaaaaaatttattaaattgttgccattctcaaagtttttttcttcctccatgaaatattagcaatttaaatgttctcaagtcctcatgcttgacttatttggggatgcttcatattaacaaagtatttttattgcataaccattactttctcagacaatattcggttttgcacagtttacttttcattctcacttgataccaatactctagttcaagacaaatcctcatctggtacctgtcacggaatttgataattctgagttttacaaactgaagggaatattgattactcaccatatccaggaatgccttctaaagggaaaattattcacgtgcatcatgttcgcagatcttctgtcattaatatttttcttgtctcctacgttacatgtagtgatttttacagatgaattccaactctcttgtttgagcagctatcgtgggcaattattgcaacaagtattgaatcccaaaaaaaaaaaaaaaatctccccccaccaataaaaacaaatagcaattacaaaaggccttccaggatttgaaaaaagaaacatcacagagcactgcaggtatgggtccatccatttaggttccactagttagtcaacatactaaaataaccagttcaactaataatcctaaatggtggcaaatattgtcctggtaaaatctaaccgccttgagtgtaaattaatgcatccttaaggaaggactctggaatgtgggaagaaaggagtcaaaagacagtttcttgatatccttgttaaagaagtgttagaagggaaatggaaaacttcaggttgctttgccatgctgtcctttagaaatgaatattgctttttcttctttcttaggcacatattcatgtatggtcactttaacgcagtgctaccgtctgagacgtgtcggacaaaggcctgggcagaggggctagaaaccatgtatcaccaaagccaacttctttcccagatttcagaattgctggttcaactgcaaaagtaggaaggcaatgagtaatttctgctctgcaggacaagattaccattaactaccatcatgacttcagaagatgctgtcacgatgaaattcatttctgctgcctaaccccataataaggctggctgttctctttaagtaaaatgactaagctattgatcttttcactgcagaatcccctttattttgttattatcaaaaccatgtgggagcttttcatattttgccttggaaagaaaatgaatttcacagctgcaagtcagacgttgtctaagaattcttcccccgatgtctttcttttcttttttttcctctctcaatctcttttgtttttcaccccaaattcagttttccaataggtgtcatttattctgatgctctgacatcttctgaaagattctcatgcccaagctatacagaccttgcatgcttttaaaacacaatggcaacaggctcctgctggagtcccccagcgccgaatttccagcagaacctttggaatcctcgcagccgccttgtctgccctgggctgtgccgccccagctctgatcagctcaggacacttgcaggctccgtggtactgtacattaactctgcagcagcctggctcagctgcagagactgctgcctgacaggggatgtgctggcgtcaagggggccctctaggtgggttcccagacattgcagagccgcgcactccttgctaacctccaagtaagagcaagcaaaaggggttaaaggaatagctcgccctggaagagcagacttctttcagtaattaccaggcaagaaaagctaaacaaggagaagcctgtaaaacacctcacagggaaattacgccttaaacaaatacggagggaggattttttgtttgctcgttttccttcttacccagtgaaaaaaaaagaaataaaagaagtccagagataatttgcaaatgatagagtttggtggatttcactccttaaaaaaaaagcaccggggtggggaagccttgtttacttgatgatttgtaaccatttagctgcagatgaccacatggtgatttttggacaggaaatcctatggaagccggttctgcagaagtcagttgtacttcaattgcaattgcgcatgccataaaactgcttgtttgattagggggtgtgtagatatgaggaatgctgagataaaacgttgcaatccctatcactgatgttttgcatttcttcatgcttgctcctttgttgcaaaaattctgttcaataatcccccaaaagcaccccatcactgttgatgccattttggagcaagaataaaatagtaaactcttgtaatagtaggttggcacttaaatggtatttgtttgaaatcagtgggagaatggactttgcagtagaagtacactcaacattaatataccacttttaacttaggtatttaaaaaggcttttacgcaattgcttgatattaaatggaataccggcaacatttaatataacatgctattatcttcatttaggatttccccagtgaggtcctgtcattgcagaaaatattacccaagattgggtggagggcatgtcccataaattcaaaacctagtataaagaaaactaatcttaaaaaccaccataatttggagaattttcattttgatcaaaagatgatcctaaaaggaggattcctaggaggaagaagaactgggtgattccttaaaagcaatgtgaacttgtaggttcagaaagatgccactacagcataaaagaatcttgagaatatttgttgagatttcctgtagcctaggcagtgtcctcatgacccctttttgctaaagggactaaatctcttccataaggtcatttgtaatctggcccagaaaacttcagcctacattgtttttaacaagctttgaatgttttgaatcaagtaattaaaattttgatattatattagacatttaaatattattatttaagagctaggaacatctacaatgccccaggtcccattctaagatagttacagtattaccccatttaatccacacaacagcactatgagttaaggactgttactagccctgttctccagatgaggctattgaggcactcagatgttaagtagcatgtctgaggttaaatatctagtgagtcactatctgaatcaaggaagtctggctccagagcctgtacacattaccacaatattctagcacctctgtaatcataataataccaccttgttatacttttatactttctaaaatattattgttatatgtattattttggcatcacagaattatgctgaggagattaagacatttattatgcccattttggagatgccaaaaagattgtatttgttcattatcaggcatcttgtgagcagtagatctggaagagaattcaaattatttgactctggttagtgatctttgatcatgatgatgataatgatgggttttaattattttaaaactaacattcagtccttatacaagagagtaggtctccatagaaagtagcaaatgcaaagattttttaaaaagatgtaaaaatatattttcctttgtaatgaacatcatttatctgacattattttcttagtccattttattctactctgttcatatgtcaaaccatcacctatgggtgataggatagtaagaatacctctgaatctttctccactaccacacagttcaacattcaatacttgttagctacatttccatttgcgggcaatgatataagcaaagcactttataaataaaatacaaatgatttggccattaaactactaaatatacttaaactaagaggacattttagctgaatatttttaaagtgaattttcgttggatttttatttttatacatgcaactgtctagaataaagtctaacaaattagaacaaaaggaaacacaactgagaaactatgataaataacagaaaagccaaatttctgcttgaaagatagcaaagaaaaaactgtaatttatttcacagttcagagaatcaagactacacattattaaacaatccaaaattgaatatttttgcagacataaggcaacaaatataaaagaataggcttgcttagaaaatagaaataactcatttccagcattttattccatttatattagaaagagggtcttaagagttatgtctactaatttataggctgatactttacaaatttaatacttcctacatgtatggccttcaagaaacaacagttaggcagaactaataggtttgtaatctaaaaacaagttgtcaaaaatgaaaaaatgttgttgggttagggtaatgctaatctattttgttacactaaaagataatcatcctttcatgaaacttttaagaaatatcaggaagccagttctggttgctcatgcctgtagtcctagctacttggaaggctgatgcaggaggataacttgagcccatttcaagaccaggctgggaaacatagactctgtctctaaaaaaattaaaaagaaatatcaggagtaaccataaaagattatctttatggctaatctcagccccattatttttatcaatacaggagtgcgaattattagcagggcaccacaaattggcataacctcagtgaagtccctgcagctatggcataacctcagctctactagagcaaagactggtttgttgttttgttttgtgtttttttttaaattttaatcccacagcaagcacaagagtaagtgaacttatattaactacccttaaatgaggctgattcaataaaaagctcaattaattgataaactacaaactcagagcaaaccaaaatactttcaacattttcattgaaagatcgcttaatgcatccagaatcagagccagaagtattaactagccggtgtcccacgtccttttccaataaaacccttttctctcatggttatagggttatgctcataagagtgaaggttttcaaactaagtttctgggaaccctatggtttttcaaagttgcatcaggtcagctgaggggcaaggtactttgtgctgggtctaggaagccaggtactttgtgctgtttcaacaagagctcttctgctttaactagttttatctcaaagtttgataatacatacaaaaaaagtctggctctttaaaaaaaattacaaaaatgtaacagtagaaatacagaattaatactttctacacaaattcttatctctgtaatatcagtttcagtatttcatcctcttaaaatgccttcaacttacacacttccttcacaatgagcataaaagaatgattaagttcaacctttatgctagtataagcatagtataataaagtcacaccctagttcctgaggttgggtatttcctagactctttagtcacttgtacttatcagagggtgtgatgagttacttcattgattttccctgagtttcactttcagaaagtaactttaatgtcaaatgttaaggtatatttttttgtcatcattgcattttggtataatcaatagctaatgtcaatgtttgcctcttaaataacttgatgaaataaaactcctgtatatttagacatcaaagaataaagacctaaaagatgacttatttatcttatatgaataccaataatcagttcagatatttttggaaagtctccattctttcaagaggctggattacttttgtcccttagatgtcaaaaacaaaacacttggtccctgtattctacatattgggttcatataaatatatttacacatacaaaaacttctatgtacttttcttagcacattctatatactattaataacagtataaatacattatacacaaggatatagaagctactgtcacctggatatcttgcaggatgtgactttttgcctcaagctccccccataaatatatattttttaccaataaaaaataaaatttacatgagttttcacatgtgtgtatgtatgtgtaattatacatttttttctttttattgcatatatcatcaactaataaagaggtgagtgtgccatcagaatgagacctgaggtggctgtgcttccaaccccacctcccagcaagaaaagaacattcaagaccaaattctctatctcacctttacagaaagccaatcccccaggaacagaacagtgtcttcttctctatatttataacaccaaaaacattgttggtactcagtcaatgttaactaataacgatgttgatagtcatgactttccactcctggcaagttctagcaaagtctgaaggcatgctgttctgaacatttataactgaaatacgagaagcctttcatgaagccgcagtttcagttgctgagagtcagggaaatgcatcatgtttcagcaagttgctagtagctactacattcaatttctacatattctcataacccagggtacaatcaccaattagaaaagaaaaaataaattcattaaacacctagtttcatcacctaaaaccagcaaatgctttgttgggacttttcatgattcaactaatataaaaagccattttggatcatactcctcaaggttaaatcttctaatcttaaatgataaattcttttacagaagaaaaatctcataatatgaaatatatttcataattggaatatttagaatgcttgttaaattttacttttaattttttttttggaagtagaagacttaaaagcctaatactgaaatacaaagaaggcacttaatatttatacttaagaatcaaaagtggaaaaatgttcacagcaagtttaaagacaaaaaagtcaaatgtgtataccatcttggagtcctaagatgtgaacccttattttcaggttctgccttttactttttgtgtaattttgaccaacgcatgaaacctctgtgagacacaatttccttatccgtagcatggaagtaatacaaacacttagattattataattttaacttattataatttaaaattttttaataagaagagctctttaaatgttgtttgcatatacctttaaaatttgcttagtaaaatataataaaatacagatcatttgttttgcaatttactggaatcaaaatggaaaaaaaagaaaaaatacaaataatgtaatgtcaaaactaccttctgaaatggaattacatttcatttatatcttaagcttttctaaaggctttgtataatatttgtttagaaaattcaaaggagcaaaaatatttctcatgtaataaaataaagcccaacttcaaaacttactcatattatcagctgggcatggtggttcgcacctgtaatggctctcaaaaaaaaaaaaaaaagagaaatgttgtaagaatgcacacttattctttcatttatcctgattagatgtatccaaaatagatttgctttcactggaaatttaattgattgttactgattgataatttaattaaacttctgatgacagttcttctatcactcaacctcccagtaaaaaagtaacataatccagctttcagttcctcacataaggagcttggaagttgccaatctgtcctaacaacaaaaaagctgaacaaactgaaaaatcaactcttcttagatccataagagaagtgaggtcacagggcaaactgctgcccaaaccactggtgagatagacagtaggctatggagaatcacaacataccggagcagaaacctccaagagaaccagtgctggggtagaaaaacctcaactataattgacaaatcgttagaggctgagtgcaggcaagtctgaaagttgaaaaactccagaggaacccagtaatagggaggtccccacaattctgtgtgttttacctccaggagtgctaccaagttctcacagtaaatattggagaaaaattctctcatgcttccagcaagagaagggaaaaagtacacatctttaaatctgctgaagcttggttcttcctgaggagaaactagttaatcagagcctaacctgctggggttttttgttccattttgttttgttatattagagcctcactgacctggggaaagaaaaatgcccaactccagcccactctagcctaccatcaaggagaaaggaaatactcaattccagcccacgttagccattctctctcacctatggtataagaaaaaaaaaacctgaaaaacacttaggagattcacaatccagaggcccaggctcaccaaaagtctgaaacctaattatggaatgatagaaagcttcccctccactgccccttaccacaccaccacccacataacttttttattttatttatttatttatttatttatttatttatttatttatttatttggcagagtttcgttcttgtagctcaggctggaatgcagtggcacaatcttggctcactgcaacttccgcctcccgggttcaagcaattctcctgcctcagcctccccagtagctaggattagaggtatgtgtcaccatgactggctaattttcgtgttttcagtagagatgaggttttaccacattggccatgctggtctcaacctcctgacctcaggtgatccacctgcttccacctcccaaagtgctgggattaccaggcatgagccaccatgcctggcccacccatataacttaaggcctatttacaggagttccttttatccagtacatgcccagctatgaagaaaaaattacaatgcatagttaaaggcaaagaacacagtttaaagagacagaagaggcatcagaactagacatgccagagatgttggaattatccgtatgatacaaaaatggaagatatacatcaatataaatttgtgcaaacccatagaatatacaatactaagagtaaattctaatgtaagctatatgttttagagataatgatgtatcaatgtaggttcaattgtaaaaaaaaatgtaccacttttgtgggggggatattgataatggggtggctatgcatgtgtgggggttggagtaaatggaatatctctggacctttctgtgaattttgctgtgaacctaaaaatgctttaaaaaataaagtttttacaaagttacatgacaagcattaacattttatacccagaatatgtacaatttttatacaatttcaaatttatggatgctaaaattgctatttgtaatgtcaatagattccattttctttacaattgcttgaagcaaagatgtaattttatcaagaatgtttaacacatattttgacaatctatttataaaatctgaaacttatcacatagtttcattttaactagattcaatatcatttaaagtttctttttaaagaggaaacattatttcatttaggaaaccatgcaagttcaacatgggaaatacaaaaataaaataaaataaacacacaagaaagaagcaagtcatccataattccattcccaaaagacaagtcagtatacttctttccagtcttcctcccctccaggaatagtgggtttaccaccgatttttatgttgttgtaagaatatttcaccgacctctgaatttggtaaaaagtactgcctggaaaagaactcttttatttgccagatggcacatggtaaagaaattaccatgaaaatactcaaacctctccactctcacaggtttactggggaaggcagttcaatcagatggggcttacaaaagttattattctctttaaaactcttgtgatgaatttttaccagtagatgatctcaagagggtattcctctggatgtttctattcttaactctttagttttgatccacctttaggtctgcttgtatatttctttttaaaaatcttaagtagtatatcgctgcatatactactacagtagtaggacatagtagatgtattgtatggtccaggtaaaactaagaaattattcttcctacttttagaatggaatacaatgtgtggtccaccatatatattgtcaatctaatttaacgcttctttaatattctgccagtactggtttttagtgctttttaaaaattatatatatatatatttttgcagtgttttcagtcactttaataggaagctggaagaggctgcatcagaggctgcaggtaaaatgccatttaaaatccaaaggccccatccaccacttctaacccatgcacatatataattacacatcattggcagttaacagagttaggtataaaagcaaatatgactatgttatttacaaatacatatatttgtatatatttataacatatgtatattacatatatatatacagacacatatatgaaacattaaaaatgaaaatatttcatttagaaaaccatgcaagttcaacacgagaaatacaaaaaaaaaaagaaacacacaaggaagacacatatacatgtatttttatttcggcatcttgaattgactacgcagagacattgccactccatttttaagttatttttgaaatagatgactaaagattatcatcagcatgtagtggggtacatgctctaggggtagtggggttttctggtctgttttgtccttggtatatcctctaatgcctagaatagtatctggtgcataataaggactcagagtccttattatcttgacattgactttgttaagtattttattatcataaatatttaataaatgagtctctataccaaacatgattacttatgtctgcctatgtttccttctaaagaccttgcctttcctacacttcaccattataaaatctgatgggaataagcatgataacttgactcactgacatctgattcatttactaggcagcaaatattaatatttgctctttggaatgtgaaatgtcctaagtgaaattgagactctaatcagttcaaggtggggttgaaccaaaatgtcctgtagactcaggggctgaagttaccattttgggttcagtgcaaactgataactaaagagacagtggcaattacagggagaaggcaggaaagaacagaaacacagagacaaaaagaaatcggtgattgtatggccccaaagagagtagctgccttaatttcagttttcctaatccaataggccctgctatacttgtttctgttaatttctgtatcttcatagtaactatgttcccccttttctacaggagctagtctgagtcagcttctttttttgcaatcaacattgtgatgagtcatcatataagaaaccttatgttgctattcataaattatttccttccctcctgaaataaagtcatttaaaattaatgctatattgtaatattgaatagctacaatgaatgaacttgacattgaattaatggttacatgatcaagtggcttaaattaaaatgcacagagtggcgttaacaatgtatctacatctacatccacatctagatgttctggagactgttctttttctctgactgacatctattacacttccaatcaaaatactagcttctcattttctcgaaccccttttcacagttttcttcattaaatgtcagtttgtttcagataaggagaggtgagagagagagaaagagagagagagagagattttggaaaaaaaagaaatactgtgatatttttagatttatagagagaataatttagtactcaaaaggcagaattcctttttaggaaaaaaaggatattcagataaattttttcaaataatcatttgaaagcttaaaaatataaaaatgtatttaaactagaacccaataatttagaataattaatagtttcaaagtcactgtagtataattaagtagaataatctttgcattcaagtgtagaataaattcaaggctagttattaaatactagttgcccattgtggacagatgccctctcattcacctagcattttacacactcttccttgctgtttttaacattctgactcgagggtgaatctataatgctgagcacttgaaacttttaactcgcctacctctctctataattggcatattccattcctaaaaaaatcgcaatagactatataaatcacttaataggcacaacaaagcaaaacatgaacaatacacgtcccaaactgatgagacacaaaactattaatgtgaaactgaattgcctagctctgtatcttatacttttctctctgggaagcacatttgaaatgtgggaaataattcaatggggaatataatgtgattttatctgttgtttttagttccaagatttgtaaaatacataaagacacaaaagagctttaaaattttccacaaaataaagtagcaaacctgatcaaatagtaaattcatttttaagatttctcctcttttctcactgaccctccctttccctttagattagcaatcaaacagggactggagcaaaaataaaaagcaggaagtgggcaacatagcacatgacaaaaaaggattttgttgtcagaatcctcagcacgttttattgatgtttgaaattcccaactcattttcaaaatgaaaatgctacaggaagcaggaacaaagttaatgaaaatataaatgcacttttctcctcgtcttccataaccactcactgattagaggcacagtccatttgagatgaggctgctgcctgtgtgtgtgggagggttgaatattttttgctctgggaggagcaactgtgatagccccaaatccctgacagcctctcttcatagactgcaggtctagtgtgcaggtgatagtgctaaactcccagtccaagggagtctaaaggaggaagccgtgaagaaaaaggaaagtgaaacagtggactaggacagaaggacattactattaatactaattttcagccagtgcagtggctcacacatgtaatcccggtgctttgcaaggctgaggcaagaggatcctttgagcccaggagttcaaggctgcagtgggtgacaaaatgaaaccctgtctctagcaatataaaaaataaaaatcctaactttcccattccccccagtgacctgctgttttccacaccttgaatgcacatctcttttgggatccatttgctggagcagaggtgttttaaagatcagaagcatatttgctaggaggcataaataattttcccctcaaatattagagtaagaaaggggaagcacgcaagaaagatacaaatatgatatggtattgtcaaggtagttaaaaatatttgtaaatggatatcaatattgtaacatatttgctgaaaatgaggacatgtagtagatagcaaaatgctgttttttgctttttctttttttttttttgagctcttgttgcccaggctggagtgcaatggcgcaatcttggctcactgcaacctctgcctcccaggtttgagtgattctgctaccttagcctcccaaagagctgggattacaggcaccaccaccacacccagctatttttatttatttatttattttttttttatttttagtagagatggagtttcaccatgttggctaggctggtcttgaactcctgacctcaggtgatccgcccaccttggtctcccaaagtgtaaaacacattttatttgctttcaaactgtccctttaaactttatttataaagaacatcttatgacttttctgggtactgttaggcaatagagacctttgcattcatgctaaaccatcatctcagactctatccagaaattagaatgtccatttcaaattgtaacccaaaactctaaacttgattgaacttacattttctcccctctcccagctgggcccaccacagagtctctgtgtgcagtggagtaagtgggtggcattgagactgggttgctcttccccttccttggctatccaggctggctagccgttggtattgactcctctgggattggaaggcacagaaagtggtgaggaaaggaagaaaagagttttgttttgttttcctgaattagtgccatcgtaagatggcatcacatgttggagacctggcagatgttgaaagctgcctctttgtctcatggtacttttgtgggttcataattggtatccctgctgggtcctctggctgcaactcctttgactcaagcaagagccttgttttccaattgctgctgattaaccagcacccccatcaaggccttggttttctagtggttccatccctaccaactcttgctcttggagccaaactggctttcccagatggtcctcttgggaaggacatcaaatggctgaaggccaggtctctctttgagcttaatgtgagttagataactgcagcccgctttaagagagggtagggttggactcacggcactactcagttctctctctcttaaaaatatatcttcacaagttcttgctcaggcatgaaagggtgcattttctgcctttggtcctggtgtctggctatgactgtccatcctgtgtaaatgaggagagtaagtctgagcaaaaggacaaagtgctaagatggcaaagcagaacctgggtgatgtgtttgaacctcttaataacctaccctggaatagcctaccttgaaaattcatgttataagacagtacattttcctcatttgtttttgttaagccattaagttgggggctccagacttgcaaccaaaggcatcttaacttaagaagtttaccataaatatttattataacccacacaaggggatgtctcagtaggtaatccagttagacagcagaggaagtttatgtttcctcacttttcttcttctttccaagtagctggtgggtgagctcatctgctacaaaacacacttcaaaataagatctttaagttaattttcaaattgaaattgctattattgaaacaacagttgtgatagcacctgcgataacaaatgtaaataaaaacaaataaaagctatgctcaatttgtggacccatcatttctcagtaggcttggatctctagagttcatggggagacccaagaggtttctaatattacaatgtattaccaatatccagggcaacaatcacatttcatcttagaaaatcagaagatgatgtatgtgccaaaaacctttggaaattgaattgtgctttatgctgaattctgtttggaggatctagcaaggacccattttactgttccatcctatgatgtgggtgtgcttatattaaatcactttcagagaaacactaggtgactaatttgtgacaatgatatgtttgcagactaacacattcgtaagaacagcagaataatgagctaatttgtaacgtaccagatggaatgtactgaaagctagtggcctaagctatcataattgtcctttataatccaagaagtcatttctagtaatcttgctacccacaacattgtttttatataaacaggtcacagtagaactaatcctcttcccgtgaaggcaggcctctgttatttcagtgtgcttgcaactggggagctgctgcagtgtgtggttctggtttgctttttttttttttaactcctatgtctgaatggcaccctataatgagggatcattaatcttaactgttctgtagcccatgtcattgttgttattttcttttgaagttgtttcttccgtaatttacacacatttaggtatattcaaatttatacttgaactgtctttctttttcctctatgtttgtgtgttccagctcactgaaataggaactgaatcctcagcacttttgagactgcccatcccaaatcaatccagtgattactttaaccttcttatcattagtctcactccctctcctttcgtgctcaaccaaaacttgagatttataaatctgaaccccaatttcagctctttctccattacatctcctcagagccccaagtgtaaactagctaacttgtactgctaggttaatagaaatttttctaaaagaataactaatatcaattttcctcaaactctttcaaaaacttgatggggtggaatacttccaaactcattttacgaatctagcattgccctgataccaaagccagagaaggacactacaaaaaaagaaaactacaggccaaagtttctgatgaatatagatgcaaaaatcctcaacaaactagccaactgaatttaaaaacacaataaaaagactgttcaccatgatcaagtgggattcatcctagggatgcaaggatggctcaacacacacaaatcaatacatgtaatatatcacattaacagaacaaaggacgaaaactatatcatcatttcaatagacgcagaaaaagcacttgacaaaattgaacatcctttcataataaaaacccctcaacaaattaagtatagaaggaatgtacttcaacaagcaaaggccatatatgacaaacacatagttaacaccatacttaacaaggaaaagttgaaagcttttcctttaagatccagagcaagaaaagatggccactcttgccacttctattcattataatagaaattgcagtatacaaaatcaacatacaaaaatcagtagtgttgatatacactagcagcgaactatctgaaaaagaaatttttaaaatcccatttataatagttacaaagctgtataacattaaagatgacacaaatgaatgcaaagatagttcgtgttcatagattggaggaattaatattaaaatgtccatatctgaaacaatctacaaaacaatctacagattcattataagccctatcaaaattccaataccattcttcacagaaacagaaaaaaacaatactaaatttcatatggaaccacaaaagacattaaatatccaactcaaccttgagcaaaaagaacaatgccaaaggcatcacattacctgacttcaaaatacacaacaaagttgtagtaaccaaaacagcatcgtacttacataaaaacagacatatagaccaatgaaacataatagagagccagaaataaacccctacatctacagtgaacttattttcaacaaaggtgccaagaacatacattggggaaacacaatctcttcaataaatggtgctgggaaaactgtatatccacatgcagaagaataaatataaacctttatctcataccatatataaaaatcaacctatagtggatgaaagacataaatgtaagaataggggaaaagctatatgacactgatttaggcaatgattttttgaacatgactccaaaaccaaaggcaacaaaagccaaaatagacaagattgcatcaagctaaaaagcttctgcacaacaaaggaaataatcaactgagtgaagagacagcctacagattaggagaaaatatttacaagctatacctctaataaggaatttgtatccaaaaatataagaaactcaaacaactcaatggcaagaaaataaccttattgaaaaatgggcaaaggaactaaaaagacatttttcaaaagacttacaaatggccaacagacatatgaaaaactattccacatcactaatcatcagaaaaatgcatactaatactacaatgagctatcacttcatacttgttagaatggctattatcagaaagtcaaaagatattaagtgttggcaagaatgtggagaaaagagaacccttgtacactgttgatgggaatgtaaattagtacagccattataaaaaatagtatggaggttctttgaataattaaaaatagaactaccatatgatccagcaatcccactactaggtatatatccagataaatcctgcatgatctcattcatatgggaaatttaaaacagttgagctcatagaactagagattagaatggtaattaccaggggctggggcaactggaaatggaggtgcaagtgtgatattgatcaaaggaaacaaaatttcagttagataagaaaaataagttcaagaaatctattgtacaatatggtgattctagtcaataacaatatgttgtattcttgaaaaatgttaacagagtggatattaagtgttttcatcacaaaaataaccatgtgagttaatgcatgttaattttctagatttagtcagtctacaatgtatatatacttcaaaacatcatgttgtaaatgataaatacacaattttattggacagttaagaatatagatataattttaaaatttacttagatgtatatcaagacatgccatatgtttgaatacagtcttgtaaaaacagtttttctgaagaaagcgtggttttctggaaggagcacaggcttttagtatcatcggacagacctgagtctcttattaccactttatttacttagtctcatttcccaaccttaaccaaatcttaattttttcgtctggaaaacaatgatacatatctcctagatttcttcaggattacattagaaggtatagattaaatcatgtagcacatgcaagtactcaatgcatagttgtttcccttgattcctcagatgtttgccatttaacctgctgactgcaatggtgagaatgttaaattagggaagcaagaaaacagcagtgtagaaataggagaaggatgaataacataagcttctaagaagcaattattaatgcaacgtaagctgggagggtcgactgtaaacagccatggtatggttttggtatcatttgccttaaggagagtctataaattagagtaagaccaataacccagaagaaaaatgggacatggatgcaaataaccatcacagaaggggaactataaatagtcaaaagccatttgaaaagatcttcaatctcactgataaccaaaaataaatcaaactacaatgaggtattttgcctatcacattcgtttaagattttttttaaaagactaaaaatatgcagattgtgagggggtgggaaacagtacacccatacacagttgttagaaacatggattaggagagacattttggagtacaatttagcaaatttttaaaaatgtaaaccatacataccatttcagaacaattacatttgtaagagtttatcctacaaaaatgattgctcaagtgcacacaaacatacacacacatacacacattcattttggcactgtttataagaccaacaaaacaacaacaaaagtctgtttctttctctctgaccagatattaaattcctggggagaaggtcagacctttctacctcctccccagtaacttccaaacccgtaaacatgtaacagggttgaaggtgcttaaaactgcatattggctgacaaaacatcagaatatttttattatgtataaagacaattatatagatttataaaatttgtaactgacttgctatttccaaaggtgaaaataagtattcaataattggcaatgcaaaagtttatttttttctatccattggaaatttgtgaacattttacacaataattgagttttatcaactttccaaatataagtatttcttatttgtatttcagataataaatttgttatttctagagacttaaagtatttaaagaaaatcaaaacatcccatcaaacacaattttgttcttaagtctctctttcttcttttattctccaaccctgcctcccatggtatatacaaagctttgctttgctgccagactttctctaacatctaaaaagtgtagaaagcaccgttattataggctaaaattgatctcatttatcccaggagtaccaacattctcaaacaggggttcaaactcctgttactataattcttgggcctgttatttcaatgagaatctaattttcttgcaataacaaatggggagatgggagacagtgtcttccaattacaaagaccatgctcctgatattatcagcaaagcgtacctctgggtcactttcaccagaagcaggtttgggccttagttacaccctctggaccaaagtgatgtgaatttaagtgtatttgttagtgaactgtctgatctgggctatggaacagactaaatggaactaatccatctaaacgggaaactcattagacaggtagtcagcctaacttggctactttattacagatagatccaatattaaaaataagatccaatatttaaaaataaaatagtaccttctttttcagggagaactatactaaataagaacagttgatatacatatattcatatgtagatgcagacatatatagatatatacatatgtatatacatgaatatacatgaagtaagagtgttacagtattctcagagcaatgtgctaggaaaacaccctttcatctatgtgaaccccagatcaactcgtataaattctgtatttgtatgtttctagcactataaattgagctgagcttctcaaaagaatacattgtattaactaaaggaattcaattaataattagcaaagaaactaatcagctttcttccacataccatttagaaacatgcaacagcacattggaaatggcagcaggaggagagtgaaataaagttaatattttttcaagtctgtcttctggggaagactttgtgcattgagacttagacaagttatttcctttaatacaataaccttataaagcatgtactaatattccccagtttatagatgatgaatctgaggaacctggagaggttaagttacttgcccatggacctggagagtaaatggctgagctgtgcttggacaccaaaacctacctttgcccaccatactgggagaccagaattgtcctgtggattcggagaaggctggacaggactggttggaggggatgcaattatggaaagagtagatggagtaataaagaacataaccttcgtaagtagtaaatgccaggcactgtgctcaatacttgacttgcctttcctcatttaatcttccacaaaagtactactagtttgtccactttacagtgaggaaaacaaagcacagaatagttaagcaaatcacccaaagttacacagccagttagcaagtcttacaattaattcataatattatttcattgtttattttccccatattcatctctctttttgttttctatttctttcttacagaagggggggaaggggacatgttttataatttactgatttcatatacctttggaagttttagtgccttttggttaaaaagtaaccaatatttttccctacgtttcagatgccaagaggctatttagagatattgggaggcactttactgacgttctgcttatgtcaacagatacgcgtagaattaggctgtaatttgattcctaaccctattgatgacttcctaaaccctcatcaaaaacattttgttttagttccccatatgcaaaatcaaaataaagaggtgtctttgtttaaaaatgctaatatatgatttggcaaaggctgacattttatcttgtctccttggctgctgttttaggattattcatctagcactgactgagtgcccagcatccatgcccctcccctttcctatttattatcaggctgctgcagtgcagcgttgaaacatctgatcatttagatcattaaaaatcaatccaatgaccaaatagttctgtacgttttagagaaatgacagaaagtgcagtattagattgctattaacttgctctggggttttctttttacagctgccaggaaagtcatttggtaaaattgattaaaccagcatgccaaggaggagagcggaaaagagcagagaaatgcaaacacagtgagcttggaggggagggcaatgtttttcttgggaatgaagtgagatgtcagtagaggaggcagcagggggtaggtgggaggagaaaccttgcatatagtgagcatactataattagaggtacaagagattcaagatggtaggatacaaggaaccacaatgcggaaacaataaaggaaggaagaaggaatgaaaaggaagcaagctatccatgcgcttctaacatactgtctgcattggttacactgcacagtttgtctgaattaatccaagagacatcactggtacaataagaagaagctgatttgaggatttccatagataaggctctttcaatagcaggagtaggtagggaagagtgcctagtttcctacacagtgtggtttatttctgtaagaacaattaatgaagaaaagaaaataaacctctctacttgtgctcaataggacgatgagtgcataaaaattcacacatgccttcccctaatttgttattatagtggccatacatattccttccctccaaataggaactgtgttccccttacagaattgcatttctcctttaacacgtttcaacaattttttgattaatccgaaaagaaccctggtatgtgaaatcagagagtgctgacaaggatggattttaatgtggggtttctgccactttgcctctatttctaattcctccctatgtcctatttaaagtcacacttagctcacacagcgcatgcttctagagaagaggataagcaaaaccatcaagaatttatttgctgtgtattatgtctgctaacatttcaagtataacaaccacctaaacacaagggacttaaaaacagcattaaaactttaaaaataaagaaaatattctgtggatgagtgcatgtatttccttggatattggacattgaaaatgataagacacaagaaccatttaattgcataggagaacaccaacactagtctaaatgaagtaacccccttgagagaagttttaaattgcatttaccctgtcctgggtatgctacttggaagaagctatgatttagacagcaatttttggcagccaagatttacataagagtaagtagccttcttgaatgagagtggcagccagcttccatgaagtctcccacctcctggcatttaacatacatctttgtagagtccccctcccactctatcccaggattggttatcagacagcagtgatgacatgtcactttcaagaagagattatgaaagactgtgtttgacttctgtcttgggatgtctctgtcttttgtctccgtctctgtctgcctatctgtctctctcatctctcactctgggggatacaagctataatactgtggttagccctatagagaggcccacatggcaaggagttgaggctttccaacaactatatgagtcactgaggaagcagctgagccttgagatgactgtagcccaagccaacaactcgtgagagacccttagccagaaccactaattaatatagagaaatactgagcaatttacatgattgaagatcatatgtagagagatatgtcataaaaggcaggattggatgggaagtagaaggatatagatgcaaaacttcaaggaagaaggtgtactcatcattggtgctattcgtcaccattctcagttctccctctttaaggcacatggcaagattgcactttcttgcccctttgaagttaggcatggtaaccttactttggcaaataaaatgtgagcagcatgagaaacacgtatatctctctaatttgtatatgtacacacacacacacacacacacatatatatatgtagttaatctgaatatcactatgatttgatgaaacaagacaaaaaagaaaaaagatatgtgagcagaagcaatacgtgtcacttctgggggaaaccactgaggtctgtgtatgaagtgccctgtcttctgccacaatgactgggaactttcccgactgtggtgtctcccattaactgtgttcctaagtgaagagcagaaccctctccctccaccacaaacctgtcatgaacatgtagcttgagtgagaaataagcctctactcttctaagcaactgagcttttggtgttgttcctgtagcccattctcactaaaacagaaaatgggtctctgactaagaattcactctacagaaaaaaggaatctggtatgaataacccgaacctcagccacaaactctgagcttcctgaaaggtgtagtggttcttggcagattgtggtgactggcatatgaactctcctaatcatatcccggaaatacaaagagttgtgtggagaactgaaagaacttttttcactagattcctagaatttgagagctccagaagcagcacagctgttggcttcccctgagagagcaagaagggagatgtactctcctttctactctgcaggtgaatagtgttctggtactgccctagatacaacagagaacattcatagctggaacaaactggttggtgtctgccgttaggcaatcaagagactaatgaacatgggtcaaggtcactggtagagcagagaccagtacaaagtgacatcctgggcagatccatgcaggggcaattgcaaggcaccccccagagtctcagagatgctaagtgaaagaggttgtgtgagttactgaggtttatgctggagaatatgagcatagagctattgagactggagaactgattttaatgtgacctaatttatatctaccagcttgaagattaaacatctaaaaccctattacttcattactaattaattatgtgtttgttacaataatctatctgacatcacactgtatcatgtggcattatatggttccaccttgatcagctttcaactcaagaatttaaaatcctcttcaccaggatcttattttggtctagaacagattaatctattctcaactgccacatgtttttagacactatacaaataacattttaaaatgttcattgattcaaagcttagtggcttacaattcagtgcaaaaagacatgggcaatgaagcaaagatgtgagcagttcagctgaattaacattttgagtatatgcacattagtcctttggatgggatcatgcctcaaacccattgaaatacacctcaatgaaacaataagtaaacgagggggaaaaggagactacatgaggttttgagtggtgaagacatgaagtctgtaaggctatggagaataattaaatgtgatatttatatttcaaaataggtaaaacttgataatggcagaaggtaaggagtcagtggagaaaaacagaaaatgctggcagaaagaaacaggggctaggggtacaaggtctcttagaaagtgggaagaaatgggatctagaccacaaatctggatgtccttacagaggattcacatacaaatcttattcaaatacatcatggattcgtactgaaccttcagggtagattttaatgacaacctggttgtcttagtccattcaggctgctataacaaaatacctgagtagattagaaatagcagaaatttattgctgacagtcctagaagctaagaagtccaagatgaaggcatcagcagattggatatctggtgatggtttacttccttgttgatggacaactatctattcactgcaagctcacaaggctcaaggggaaaaggatctaggcttctttcataagggcactaatcccatttgtaagaaccctgccctcatgacttaatgacctcccaaagccccacttcctaataccatgatattgggggtgaggatttcaaaacaagaattttgggaggacacaagcagtcagatgatagccctggtttaacccatatggctcatgttctctcccctagcacccttgtatttccccttgtaacactcatcacaacctgcacttgtatattcatttatctgtctgaatgcccgtctccacactaggatacaaacttcttaagggcagggtttacatctgctgtggtcactgttacacaatctccctagcacagtgcctggtacacagtaaatgttccataaatattaatatttgtggattgatcaaatcaggatagacacaagaacaaatttaagattacttagcttattgtcccaatctcactttggcccaccttactttgtcacttaaatgaagtcctagaatgaactgtggcccagtagtccttatacctttgtaaaacttcattgatattgagggatttcaatccagttttgataatatagcagccaaatctatccacatcactaaagccaatcagccagactgtcattcttactctgatgctatttagaatgtgcaatgagccaccggattccacttcctaaaaactaatttccctagagcttctgctctcttattttatcaatgcccctgaggtcagaaactatgattttgtctctcctgaacagcacaatgtctcattaaaacttcttcctataagcttgagtttttctttagaactgcaaggaagtttcaaggatcatgaaggacctttggtttgatatcagctatttttagtgctttgagagcaacagcacagtcaagttcactaatgacctaaaaacaattaattcaatatatattctgattccttgattgacactgttttttttgtttgtttgtttgttttagatttggaaaaaaattactgcttgttcaatcttttaaaaatggatgttctaatttttttttttacagattccaacaaccaagttggattatcgtatttgaatataaatatgggcaagtctgacaatccaataatttatattttatatagcctgcttctacctaaggagaggaagatagacagtaattatttatctattcaacaaatttttattgactgccaccatatgctaagaacaactctaaaggccagggatatagcagtgaactatgaaataactagggctcttgagtcgtggtaggagagatgaaaaataaacaaaaagaaaaagtgaaatctatataaggattatatgataacagtttgcagggagaacaatttaaaaagaagaggggatggggaatgccaggaacaggcatggtgaagatataattattaaaaacaaaataaaaggatagcctcactctgaagatatccaaataaaggatggaaagaggtgaggaaagaaaacaatggcatatcaggctgatgcaagttctggctgaaggacttgagaacatgaagtacctgaagcaggactttgcttggatagttgtgggaatggaaggagaccagagtgactggaccagaggaggaggagtaggagctgaatctgagaggccacaggaaaaaatagtagattattataaagaccttcaatttcattttgaggaaaatcagaagttactgaagtattctgagcaaagaagtgacctaatgccacctagactggagcagcctcactctgctgaggggtgcaaaacaggctgaagcagggacactggtcaggaggtggtgcagcaacacaggtgggaaagttggtggccggaaccaagctggttgccatggtgatggtgagaaatgggcaaattctgggttatattttgaaagaatgctggctggatttgctgattggattggaattgggagtgtgaggaaaaaaagagtcaaagacaacaacaaagtttggtctgagatcaggaaggctccaggaggagcaagtttgctgggaaagagcaatactttggttttggacatgctcagtttcaggtatagaggagacatcatggtggaaatgacaggaaggcagttgaatatgaaagtctgtatcaggtgagagatccagatcggtagagacttgacaaacaatggcatatagactttgaagtcttgtgattagatgaggtgtaagagatacgcagaaggaggacagaagactgcaaggactaagcttgggacatgtccatgctaagactttggaaagctgaggaggatgcagcaaaggaggatgcagagtcctcaagggaaaagggggaaagccaggggaatgagatgccttgagaccctggggaagagagttgtcttctctaaatggtaggtattcagcatcagtgtagagacacctgctttgtaatatttatttggtcatgggattcacatgccttgacttacacataggttaacattaaatttaatttgcatattttggagaattgaccaatttataagagagaaacaagaggaaagaacaaatgccagaacttatgaaatcttcaagattaactgattacatatcagtaaaccaaaattacattacattaagactgccgttaaattaatttagtaatgcttcaccatgaagattatcttaatatttggctcaatttttaaaaaaaacttttttcttaatttttttacaaaaaaatttttctataactcaaaaaaatattttgagttacagtttacacattaagggggaagccattctccattcacatattcccatatattatataagttgaacttttttccaggcaactgcataatttaagtaagttctgacccatttcttagtcactgccctgactggacttgacctgactggggagcacacattgagttcaaagaacactctgctctgacattagccccataggaataggccactttaaaatgcaaatatgtaaaattaagaaggaagataattatattggagtaagcatcttattttggagaaaaattagaactgaattttatgccaatgataatattcaagctttgtattatcatagaaattatgattttgttttatcttttaactaaaaccaaagtcaaagatttcttacaagtatgagaaaagtgaatttaaaaataaaatagagctatatgagatatgtgcagcattgcttctattattgcatacaatcatagctcagaactgtaagagtctatgttactacacataaagcaacaatatacaaacttctatgtaattgtattttccccttttagaaatggagagaataccaatcctgtttacctaatcagacaagattatgtattttaaagcattttaaaaactatagaatatcgcacaacaccaacggagtaattcagtgtgactttcctttaatggatgaaaagttttaaagcactagttattcttcagttggtaggaaggcatttatctgtaaattgatacatcctcaggcaactgtgctgatattcaaatttagttattcaaaatgtggctttcatttttttttttttttggtggtagggtctctctctatcatctagacctgagtgcagtggcacagtctcggttctgcaacctccacctctcaggctcaagcaattctcaggcctcagcctcctgagtagctgagactacaggcacgcactaccacacccagctaatttttgtattttttgtagagacagggttttgccatgttgctcaggctggtctcaaactcttgagctcaagcgatctgcaggcctcgacctcccaaactgctgggattacaggcatgagccaccacgcctggctgggatatttttatgttgaacattcccattctagccatgcgcttcttacctggacttcattaatatatatatacatatgttagaccagcattttgaggttagaaatcatgaatcaaacagtaaggtttcctgggatatattagacaaaacaaaattgaaccctggtatgtttgaattgggagtagtcctggtacactatgactttctggttcagagataaaagccttaaatggcctcttaaactttaaggattcttagccattcaatatctccctatgccattttgatgagactagtgtaaatgaatcataggcacatagattaaattcccccacgaaatactcatgactatgaaacatttaagaaaaagtgggtaaagagtcaaatatgttttgctgactcctcaatattttcaagatggacacagacacagtcagcacattcaaaacaagctaacagtgaccaaaagtgtctgcatttgctcttatatcaccagtctttatgtcttcttcaattgtgaggaagaaaagctcttcaacaatacagttcacatttcagtctcagtagctggggtaatctgatctcctgattttactctaggcttactttgaatgtgaccctagtaagtttaaaattctttatactgcctaccttacactcctgactagctagttagctaaatagaaatgagggttagaccaaaagaggactatcttacagcgaagtataggtctaggcagttttctatctatttagtgaattattacagaagtcctcaaaatggccttctaggagtctagaaaaagtaaacgtattttccataagcatccacaatctgtctttttttttttcaattatactttaagttttagggtacatgtgcacaatgtgcaggttagttacatatgtatacatgtgccatgttggtgtgctgcacccattaactcgtcatttaacactaggtatatctcctaatgctatccctccccccttcccccaccccacaacaggccctggtgtgtgatgttccccttcctgtgtccatgtgtcttagtagtaaaaccaagaaataatctcatctgattttaatgcaaattacacccatttccaaacatgctggctttttaaaacaatattttttattaagatttacaatggaatttcaaaaatgcagccatttacactaggttgattcttatttcactttatgtacatgagtggtttttcagctttaaagttttaaagaattcagctcagtattttggtgtttcagcactttctattttgaaaatgagccaaatattgatgtggtcagatctatgatccctcaaaccattaaaagttataactctgtgataaatataatgtagcagtgttccaaattggcaactcatattaagtttaagaataggaattacctacaaaaaatttccaagtcaccatatatctgtctctgtgataatgtcatgctccctagcgatgctctcaaatggtagaatgagtcactggcccttgtcttttcaaattttatccatgaaaataaaagtaaactgctaaagataatctagaattttgtactctagcaggtttcaaatataattgcttctgtgttttttggtataaagttgctcccatggagattataattctgatttttttcctattctatgcatttcaagagctaaaataagtgtgggaaaggatatctatatatatctatacctctatacgtattccaactaagatagtgaagggtttaactttgtgtattacttagacctaataattacatatatatatatatatatatatatatatctccaagattttaaagtattaggtaataagtgcacataagatttcgtactttttgtcgttttcttcttttaaattatgcatcagattttcttgtctccaattgctgagggtgtatcttctcttcttatttgctatcaacattatgactaaaaatatatcctccaacatgtctaaaagtcttattttagataggtggatttcaaaccttgctttgcttatgggtaaattaggcaaagagagggtgctgtggtggaggagctccatcgtcctccatcttcaaccttgaagagctcaatttggaaaccagtgtggtagccctgtatagtgaaagtcatttactaacttctcttccatggcaaccacagtaaatattatgctacaatgtggactctaaaataagagattaaaagctaatattgatctatgaatgtatgacaataatagcaccacgaataaacccaagtccaacactttattgcgtctcccccagaaatcatgtgttgaagtcctaactcctcgtacgtgagaatgtgaccttactggaaataggattgttgcaggtatgattcattaagtgaagatgaggacatattgcaagagagtaggtccctaatccagtgtgcctcacgcctttataaaaagaacaccatgtgaagagacaaacacgtacacagaaggaacactatgtgaagactggatggatgctgctacaagcaaaggaactaccagaagctacaagagagaactggaacagttccttccctagctcctttacagggagcatggccctgccaacacctcgatcgtagaattctcacctccataactgtgagacaacacatttctgtttaaaccactctgtttctagtactttgtttcagcagaaaactcatacaccactcattcctcaattttctgcattctgacttcaactcctaccataccaatgaagtgcttttcactaagtagtggcctcttttcaagtcagtcagctcattctacttctagcttttcaactactgactttccctttataaagcctctcttgatcattattttctgatttttttttttactaacagttctgaatactcctcatttcattccttcaacaatcattgagagtttatgtgtcatgtaaaaaaaagaattcttcgatgcctaaaagtttctatgttaaaggaacataaagttgggtgggagagagaagtaaatcaatgagtagattttcattgtacacagtatgagaataaacaggaagccctcttaagcccattctacaggtttaggcagacatccttttaaaagatgatatatcagatatgagctggaacatgaggaggagttaccttgacaggaatggaagatgtaagacctgagccaagaggaagagggtgttctaggcaaaaacagcaaagaaacaaaggctcagagacaagagagaatcatgaacgccagagaattgtgatgaaaactgtgtgcagaatgaaagagaggacctgacaaaagaacagaacaggcgtcgggttctgatgggccatatatgccatgttacagcttggcctctattctgaaagcaacagatagtcactgaaaagtcttaagcaggaaatatatattatcatatttatcctctagaaaaaaatgttctgagcattgtgtgaaaaacagattagtgggagtaagcaaagccaaacacagaggatacagtcaggaggtggtggtaatatttcagaagacagatgatggtggctgctatggtttgaatgtttctccccttccaaaactcatattgaaatttaatagtcattgtaacagtattaagaggtgggacctttaagaggtaattaggtcatgagggctccaccctcatgggaggcattggtgcccttataagggcaagttcagtcccttcttgctctctcctgccctctcactttccgccatatgatgtcacaacaagaaagccctcgcaagatgctggcacgttgatattggactttccagcttccagactgtaagaaatgagtttctgttcattataaattacccagttttaggtattttgttatagcaacacagactgacttagcttaacctaaagtaatacccatgtatataaaaaactttggagaatactagaggtgaaactgatatgacttgacaattgattggacatgagggataaataaaacaattcaaaatgattatcaagtttctggcttgtacaatttaataaaatctgatgtcactcattcagactgaaatatgggggaggagaaaagggggaggtggtagagcagattggatgagatgggaagggaatggaggcaaggaggctctcttggacacatcagtgagtttggacatcttgtgcagacatatctaaaatataagcctagggtctaggatatccagatgaaagactgataaagggaatgcctgagaaggcatggatgtgaagaagaccaccagcatatcacaatcatctgtggaatttctgaataacttaggtgcctgggccccaatccctagtaattctgattcagatgatcgagcatagcaagcggatggctgcattttaaaaggctttgcaggtgattctgatgcatagccatggctaaatacctctggaatatggggtaacagcagaaagtgctgacgaaagaacactgccatttcagtggtaggcagaggatcaagaaaccccaaagaaaactgacaaactgcaggctgttagctaggagcccatggaggaatagactgttttatgcacagagagtggcctacactcttcaaatactgaagagaatctgagtaaaacaaagactaagaaaaaatttcctggatttagcactaaaaatgtcagtatatttggtgtaggaaagtgcaaaattgagagtagatgcaaaattatttggctgttagagggaggaaggcagtaggcagaggaggacccatgaaaatttgctttagcactgttatgctttgctttttgaaggaagtgttttaagtatgtttaaatacccatgttaaagacttagtccatggctaaagctggtgatccaagacaagtggcaggtgaaggagcaagtcaactgaaaaggcagaagcaggtgggactcaaggtacaggagcagatttctacctcaaacagaaataggatggaaatgtccatgtgaccaagagacagagtttttattgggaaaaaaggacacaaggctgactagagaaatgaatgggattttggcagtattgaggctccatccaattgggtctggagagtatgaacttgctgtggcaccagtgtaagtggttgtgtttttctctggaaacacaagggttaaaaatggggagatcacacaggtggattaatcctggcttgttatctcctgtttgggtttatgaggagaacaatgaagggttagcaagaaagcagttgagaaataagactattaggtctttaacgtaataagaggagctagaaagaaagaaaactatgcttagagtgtgggatatttgagtttaagattttgaggttggttggagcagttctggctgatgacaaagttcagagtgtggccatggaggtgaattgccaaggtaaaactgaagtcaagatcagtggatataaggaagggggatatgagaaaataaggttctcacccttgattgcacattagggtgatttggtggctataaaatctttcaacacttcagccccagtgaaatcaggatctttgtgggtagaaccaaagcatgaatacttttaaaagtacaaagattgagaaccacagaactcagctgtctgttttgtctaactgaattttgaagtcactcaaggtcatgaattgtagggatatttttggtttcaagacttttactcagcaaagtattgagatgaagagaatggcaaaatagccagcatggggaagaaacaaagaattccaacagctcttaaatattttgtggtttattataaaaagataaatggaacaaggattgtattgtcagacttctttcttatgataacctagagaaatctcctatactctcatttcctcttttttttttgtggccccctagagtaggagtataaataaatccccactttctttgtaaaagttcaattgtaaaagttcaattaggcaagttagagctataagcctataaaacactccagactcaactctgcaatttccatcttcacacttcaggtggctgtcttagatttagtttcttagactagggcctgcccttattagtttttcaattaccaccctcttccagagactgggtaactgatcaggtctattccagaggttgtatattagcaataccctttgcttcacacaaaaaaagctaaaaattaatggatatcctttatgtttcctggagtgagcaccttcatctgagatgcattgaataggaagccagctgagttcttcttgtcaccatggtgactttagcatccctgaattataggttctcacaggagttcacccaggtgaaggctttgaatatgatcagaaagcaaacctgctaggcccctaaatgatgcttcagcttacaaaagtatcaaaataatgattgggtattccctagcatagtggctaattcctagtagtttctcactgattaaatctgaaagatattttcctccctgttctccttcctgcagcaacaaagcccaggcttttcctgggaagtctaaggttgcaaaagatcttggttataaacaacagtagtcagaatgtccctaggaagccaggcttttaatttatcaagcattccctggcagtgaggcatccaaatcattttacttgactttttccttacctgataaatcagcaaagaacaagaatatgatgctaaattagtctgtgcaagaatgaaagccaaagtttccaaattttctgtgcccaacaactatgtgaaatctgagaaatgaactccaatcagtaacattaatgacttaaatttgtatgactttacagttcagtatatttatacgttatagtttatattttcatatcttttatgtcatctgatctttaaaagagttacaagtattgcctctttttaaaagaaaatgacttctggcttcagaagataaaacttgccagaagttaaacctgaaattaagtggctcactggaccccaagttcaaaatcagatattttgacttagaaaacagagttctttccgctacactattttctttatatatatatatgcacacacatatgcacacaaacacatacccacacactatatatacgaatgtatgcatacacacatatattttaagaggaaaatataattccagggggaaaagtattattgcaggtatcaataaccatttgggacaaatttaaaaggtcttaattctaatttgctgtgaaaagtcatgccagagttattacagcatcaaaaagtaaaacaaaacaaacaacttcagttccatctgatgtagctgactttttgatgagactaaaactgtgtagttcatcatctccatccaagttcagatctcaagtctatgatcttgactaccttaatgtatggctattattatcttgatgatcacattggctttgctttcggcacaccccgatctctctccctttcttctgattttctccactcaaaacaagaggggtatttttctccgacatttgtctcttccatgcccaatcttaaggaagacctactgtagttgccaaagcgcatcagcacctgggagactattttagaatgactgacatcattctcctgacactcaccatcagcccaattctcaaacaacataaggtctgagaacacagagtcgggtgctgtaaactcaaagaagtactttaaaccatggcaaattcatcacccctccaaagtgctgactaatatcttggggctagttcttttccaactcagctcatatcccattatcaccacatctcttcagtctttttgtcctgattctttatcgttgtgatcaccacccagtaagaaaacccttcctttggccttgctcttaccatatttcattgatattatgatgacactgattgtgagatgcattattaattgcttaatggtttttcaggacaaaaataaacactaaccttattaaatgagcacatcaattgcatgactcatccaaatttcagaaacgttaaaataataaataatgcttcaaaattgtcaaaaatacagaatatccttgctcacatcctcatttggcatagtttcttctgctccaacattttctgtaagaccctaccctctcactttcctgtacctctagtacagtgctgttcaatcgaattttctgtggtgatgctaatgttctaaaatctgtgctgttcaatattagacaactacatcttacacctaggccaaactttttcttcctaagctagcttgccctgttgccctcaataacaaccttaatcacagtgataatttcttcagactcacctccacttcactttagaaagacaaagtcgtggacttggtcacctccagccctgcatcccagtgcttggagctctgttgttctgttccatctccgaggcttgaaactgtctcaatttcccctctctaaataaatctattatcttcctatcacttaaacttcctagctcaccctgatcttggtatgtgccctcatgagaacaaccaggtccccagagttccaattcctgaccttttataaaccttgatacccaccgccttctgtaccttctagactgttgagcgttactagaaaaaaagattagtcatcttgactagatgttcaatgaatcgtgctatttacatttaaggagggttcaatgtttctctgcaatgctatttttaacaagtgattgaaaagctttatgttacttttaaattcacaacattacctcactttcctttactgtcaatagaaaataataatggcaatgatagtaaaaaatagctaacatttctgtgcatttataatgtggtatatgctactctaagcagtttatatgcatcatatcagttaactatcataaatattatttggccttactattttttatcactttacagaagagaaaatatatataaagcagccccgttgtgttgagaggatagaagccttcttacatgtaattgctttttctccctcatttgaaaccactactcattttctgttcttttcctgtatttcagaaaaataagattttcactttccagactaaatggatccatgcacgctcttaattctatccccattctatccttcaggacgtttctcctaattccatcccctgttccatcctttggggccttctctgtctctgacatcttcagtctatccctcctttccttcacatactcctgccccgatcacaatggttctttccactctatctacaaattctcacttaatgaacagaaagttaaaagatcttctcccgaatttgtcatttttttttcagtctcctccctttgctttacccctttaagcttcctgagagactgggaagggcagtgtgatgcagtgaggaacatgttcccaggcagccatcagggaggaggccacagagacgctgtggcacaaacgtggtagtactcggctttaatctgcaatggatgagaatgtctgagcagactgatgcacagaggaattatgtggcctctgccttgttatccaactattgagacatttggtctacatctaattaagaattatttctggcagtttttcaattacatggttatttcttcattttgcctggtagttctttatttctcaaatggtagaactcttagcattcctttaagcctttgcagtatgatttctgcctctatcaattctgattgctataattgagttcctaaaaagtcaacatgtgaccaagctttttggctgtgattattgtctttcttagcatttaaatacaagatgatcagccaccctaatcttctctccttttcaaatataatggaaacactgcttaaatttattgataggaattccacatcttggctaatacacaattctaagatgactcctattaccctcagccctggtgttactccacggttatattactttacatggaaaaaggaatttttgtagatgcaattaaggttactaatcagctgaccttaagataagattatcagggtgggtctaatctaatcacatgagtcctataaaacctataaaagcagagtgctttctttagctagaagcaaaaaaggaagtcagagagatgaagtgtgagaggggaggtcttccacggctgagatgaagatgaccaatgggataagaatccaagagtggcctctagaaggtcacagggggctacagccaacagctagcaaaagaagagggatttctatcctataattgcaagaaactgaattcttccaacagtggcagtaatgatcttgagagatgaccttgattccagataagatcacagctggttagcaccttaatttcagccttgagtttgagactctgagcacataaaccagccctgttatcctgaatttctgacctaaagagctgcgacattaaaaaaaaaaaaggatattgttttaagttgctaagtgtatggaaatttgttactcaacaataaaaaaagactatagccaaaacatctggataatttattgctgcatccttcatatcttagataagaagacggtgtctcataactctgaaacataaatttctcaatttttctttaaaataaaggtttgctcaagtgtaaattagaaaacatatgctttattaaaagaacattctctttcaaaaataaatacacgactatattattcatggattctttatggcattacaaaccaatgactgggcgcggtggctcatgcctgtaatcccagcactttgggaggctgaggcgggcggatcacaagatcaggagattgagaccatcctagctaacacggtgaaaccccgtctctactaaaaaaacaaaaatacaaaaaattggccaggcgtggtggcgggcgcctgtagtcccagctacttgggtggctgaggcaggagaatggcatgaacccaggaggcggagcttgcagtgagcccagattgtgccactgtactccagcctgggtgaaagagtgagactccgtctcaaaaaaacaaaacaaaacaaaataaaaaaaaccaatgcctggtttccattttagggtccgttaacattaaagtaatgtttgttggattctataaaataacagttggcctctgaagtatttaatgaaatgaggtttctatacatcaaacatttaaatgaaagtcaacaagagaattagatggtttaaacacaatggttatatggaaccatggtaatggtcatttcataaagtttatgtgtatatcaaaacatcaagttgttcactgaaaatatatacaatttcaatttgtcagttatatcccaataaagctgaaagtactattgaattcttaaaaaatatgttgaaccatgcatttctttattcaagggtgactgctttacagaacaaatgagtgacttaatttcttaatttggaaattctattatgtaattttagttaagctaactgcaagtttgcagtttacaaaaatggaaagcttttttataacagtgagatcccatctctacaaatttgttttttaaatgctaaactaaaatagaagacattaatattttaatagtgaaaggatgagcattagtttaactttcagtggtaaaaaaatcatattaacatccaaatcatgtaacaagttatttgcagtatgagaatagagtcaatattttgattaaataaattaaggtaataactttaatgaacgctgagctaaaatactaaaatgcattgatgaatagaggcatgtctagaccttgcaaatatatatgcttctattgcttcctatgcctcaaacataaataagatctttaatttctgtctttattatgtctgataaatatgctcctactttgcctttgttggctctataatcctccaattataatgcttctgttgtttgtcttattcttcaaaatagcccaaaagacctatcaggaagctttggattttgtacacatttaatttttcatacttcccctattcacttcctaatgaagggtctactctacaaccacattcaggcaataagaattagttaggtaccaacttagagtctagtccttccagtagcatttttagttcttcaggtaattgtgacttgactcacttaaggtcatcaattaccattcctcaaatttaactggatggtgataagtttgaaggtgtgaatggtattccaatagagaataccctgtgaccatgtattcttttcagaaaagtcacaaagcaggtgggatattttgtcactgttcaaagattaaaatgatagtaatagaggttatttaaaaatgttccaaattctagggttttatcttactattctttttccaaaactggagcatattctaagttcattgccacatgtatttcatattttattcttacctagcactgaattttatataagcaatatgctttctatcactttctaactgcattatgtattatcccttcaccccaccccaaagccttttgttaagccagtgatatcaatgaatgcctcctttaggggtgtggttcaggattcagtaacacattggagtatgtgctatacttcaaggcacattggagtatgttccttgaagcatcagatttttatgtgaagccaaaatagttttataaaatatagattgttattcatagcaatggtttttactgccaacaatgagagatgtttgctagcctttggttacttcctgagcataaaatcaccccagcactgcttatccctaaggcagaggctgaacaaggatggtgagaatctatatactttccagggttgagggaagaaatgagcccacacgtgacacctgctgactccttgtacctgcacccatattttatcctcaagtaagggatatctcagttcattgtccttaaagacatgtttctcaaagagtcattcttaaagttgtgtaaaacagaatctgtacattaattatctatgcctactgcttacttatctgaatagcaaagacaacaacaattaaaataaaaaattgctgccacagaattcactataaatgttaatgggactctcaagacaacccctttacagcttttcaaaacttcaaggggtatttttaacttaataatggaagaagaaaatgcttgcaatacacccaatacacctggtaccataaagaagaacaaatcaactgggagctgtgtggtgtcatgagagggcagcaatgcagggcagtgttgtggaatttggcaggcagcaccgggtctgaactgaattatcactattatatcctcatctatgcttctatgtctagaaatgtcccatagaacttcctgcagtagcagaaatgttctatatctgtgctgtccaatataatagccactaatggatatttaaatttagatttattaaaataaaattgaaaatttagtttctttcacatatggctagtgaataccaatttggatagagaatgagattcttttttagatacttataccacctattacttattgagccctaacctcaagccagaggttaaggatctattttgtaccaggcactgttctccaagcccagaatagaacaacctccaagacaagtagggccctggcaccatggacttcagactagtgtgggggatagaaaaagaataagaaaataaatgattctatgatttactttggcatattatatagggcaagggactgtgtgtgctaggaaagggtaagactgttcttagaaaaggtagttgtattagtccgttctcatcccactaataaagacatacctgacactgggtgatttataatggaaagaggtttaattgactcacagttcagcatggctggggaagcctcaggaaacttacaaccatggtggaaggggaagctaacatgtccttcttcacatagcagcagcaaggagaagtgccaaacaaaaaagggaaagccccttaaaaaaccatcagatctcatgagaactcactcactatcatgagaacagcatgagtgtaactgccaccatgattcaattacctcccacttggtccctcccactacacgtgcggattatgggaactacaattcaggatattttggtggggacacagccaaactacatcagtggtcaagcatggtctgtctgagaaagtgacttctgagtgttgttatgggttgtactgtgtccccctatcaaaattaatgttgaagcctaacctctcagtaccctagaatgggaccctattggaaatagggtttttgcagatgttattagttaagatgaggtcatataggagtaagatgcaccctacttcaatgtgactggtgtccttgtaataaaagggaaatttggacacagagacatgtacagagagaagacaaagagaaatttggacacagagacatgaagggaaatgtggacacagagacatgtacagagagaagacgaagagaaaatacagagagaaggccatctacaagctaagaaaaggacctgaaacagatccttcctcacagccctcggaaagaaccaaccctgccaacaccttgatctcagactcctagcctccagaacggtgagataataaatttctgttgcttaaggcaccaagcttgtggtattttctatagcagccctagccgactaatacaagtggcaacttgatgaggaagccatgcaaattgcgcatgtcatttaatcctcacagctaccctatgtgttaggcattggtgtgtccatttatcagatgagaatttcaagttcaaaactatgaaaataatttgcctgaggaaatattgctcttatgtggcagactcaagacagaagtctgagttagcatgatccctgggtctcagtgtttcttattatactcttttactaccttgacttatctaaatacactcacatctgattcaatgacaatgaaacaattaattttacaagtaaatagattagtttatatggttatgtctataccgtagtttcagttaaaataaaattttaaagtctagcaaaggtgtcttatttggcttttccttcaaaactaactccgtatttgattgttgaatctatctgtgaatattagcctttgaagtatggagatacatacacttttatgcatatgcacacatacgcacatacgtctatatataattttagtctattttatagcttacattttagattaatttaagcattgtgatgtaaagtctacagtactcttttctcagccttttccccactaccttcccttgtattttacgtgtccagcctgacactcatattatcttgcttcaggatacatctatttcttaaagtcatttttctatgaggacaatcacaatccccttataatgaatacaagcatgtttatagaccctcaccttcatcaaagaggcttcaatgttctcttaagagtgtatgaagctggaaatatattctgaaaatataagctcaacacctgccttcctgaaaatatgggtggtggaaagcccttgtgagtggatagcccatgatttgtttgctcaattagtgaaaagaaacacttcaattggcaaaaatgtttgcccaaatgagaatggctttatagaaatgttctaaatatggcctgactctaatcaagcaatgccatctgcttgatgagtgacaaggtcacaacttctataatagaagcagtctccagtgccagaaatgaatatacagaagtccaactgctgcctacactaaacatggctacctatgttgtaggaggcctgcacgtgtctgttagcttcaggtatgatcttaccaagaggcactttcattggtcttgatcctgctaattatgaggtgtagacccttggctgagtcacttaatattcctgacgctcggttttttttccctagaaaatgtagctaacaatttctatgtctcatatttgtggaagggataaaatgaggtcatactcttgaagacatcttgtgaaatgcaaagtaaaatgtaagcaaaaggcacaatttttccacctgtaaggaatggctcctagaataaaaaattactttgaagtactttttgagtacttattttgtaccaagcacatggccaataactttatttgcattatgtcattttatctcataatgacactatcaattatgtattattacaactgccatcttccagaagaggcaactagtagtgcttaaatggtttaggtgagttgcccaaagttccccagctagtaagtgccagagagtagatttgaacccacctgtgttcttaactatttcttctcttatcccttatgcccctgccaacagttaaaaaagagcaactattcttaaaactatattactgagataatttacttgcttttgtttgtggagacaaaaattttaagatcattatttttcaattgtaagagaataaagatggccaaatagaaacagctccggcctgcagctcccagtgagatcaacacagaaggcaggtgatttcagcatttccaactgaggtacccagctcatctcactggacctggttagacagtgggtgcagcccacagagggcaagcagaagcagggtggggcgtctccccacctgggaagcacaaggggctcgggaactccctcctctacccaagggaagtcatgagggactgtgccgtgaggaacgaagctacccagcccagatactatgcttttcccacggtcttcactagccacagatcaggagattctcttgggtgcctataccacaagggctctgggtttcaagcacaaaactgggtggctgtttgggcaggcattgagctagctgcagtttttttttcataacccaatggcacctggaacaccagtgagacagccattcaatcccctggaagggggctgaagccagggagccaaggggtcttgctcagtgaatcccacactgacagagcccagcaagctaagatacactggcttgaaattcttgctgccagtatagcagcctgaagtcgacctgggatgctctagcttggtgtggggaggggtgtccgccattactgaggcttaagtaggtggtttttccctcacagtgtaaacaaagctgccaggaagttcaaactgggcagagcccaccgcagctccacaaagttgctgtagccagactgcctctctagattcttcctgtctgagcagggtatctctgaaagaaaggtagcagccccagtcaggggcttacagataaaactcccatctccctgggacagagcacctggggggaggggtggctttgggcacagcttcagcagacttaaatgttcctgcctgccagctctgaagagaacagcagatttcccagcacagcccttaagctctgctaaggaacagactccctcctcaagttggcccctgacccctgtgcctcccgatagggagatactcccagcaggggttgacagacacttcatacaggagagttctggctggcatctgttgggtgcccctcttggacgaagcttccagaggaaggagcagggagcaatttttgctgttctgcaggctctgctagtgatacccaggcaaacagggtgtggagtggacctccagcaaacctgcagaagaggggtctgactgctagaaggaaaactaacaaacaaaaagcaatagcatcaacatcaacaaaaaagatgaccacacaaaaactccatctaaaggtcaccaacagcaaagaacaaaggtagataaatccatgaagatgaggaaaaaccagtgcaaaaaggatggaaattccaaaaaacagaatgcctcttcttctccgaaggatcacaactcctcgccagcaagggaacaaaactggacagaaaatgagttagatcaattcacagaaataggcttcagaaggtgggtaataacaaactcctccaagctaaaaaagtatgttctaacctaatgcaaggaagctaagaacattgataaaaggttagtggaatagctaactagaataaccagtttagagaagaacataaataacctgatggagttgaaaaaacacagcacgagaacatcgtgaagcttaccacagtatcaatagccaaactgatcaagtggaagaaaggatatcagagattgaagatcaacttaatgaaataaagcatgaagacaagattagataaaaaaagaatgaaaaggaatgaaaaaagcttccaagaaatatgggactatgtaaaaagccaaacctacatgtgattagtgtacctgaaagagatgggaagaatgaaaccaagttggaaaacacttttcaggatattttccaggagaacttccccaacctagcaagacaggccaacattcaaattcagaaaatacagagaacctcacaaagatactccttgagaagagcaaccccaagacacataatcgtgagattcatcaaggttgaaatgaaggaaaacatgtgaagggcagccagagagaaaggttgggttacccacaaagggaagcccatcagactaacagctgatctctctgcagaaaccctacaagccagaagagagtgggggccaatattcaacattcttaaagagaagaatttgcaacccagaatttcatatccagccaaactaagcttcataattgaagaagaaacaaaatcctttacaaacaagcaaatcctgagggatttcgtccccaccaggcctgccttacaagagctcctggaggaagcactaaatatggaaaggaaaaactgataccagccactgcaaaaacatattaaattgtaaagaccgctgacactatgaagaaactacatcaactaatgggcaaaataaacagctagcatcataatgacaggatcaaattcatacataacaatattaaccttaaatgtaaatgagctaaatgccccaattaaatggcacaggctggcaaactagacagagtcaagacccatcaatgtgctgtatttagtagactcatctcatgtgcaaacacacacacaggctcaaaaataaagggatggaggaagatttaccaaacaaacagaaagaaaaaaaaaaggtgttgtaatcctagtctctgataaaacagactttaaaccaaaaaagacagaaaaagacaaagaagggcattacatattggtaaagggttcaatgcaacaagaagagctaactacctgaaatatatatgcacccaatacaagagcacccagattcataatgcaagttcctagagacctacaaagagacttagacttccacacaatactagtgggagactttaacaccccactgtcaatatcagacagatgaacgagacagaaaattaacaagaatattcaagacttgaactaagctctggaccaagtggacctaatagacatctacagaactctccaccacaaatcaacagaatatacattcttctcagcaccacattgcacttattctaaaattgaccacataattggaaataaaacactcctcagcaaatgcaaaaaaccagaaatcataacaaacagtctctcagaccacagtgcaatcaagttagaactcaggattaagaactaactcaaaacagcacaactacatggaaaatcaaaaaacctgctcctgaatgactactgggtgaataacgaaacaaaggcagaaataaataagttctttgaaactaataagaacaaacatacaatgtaccagaatctctgggacacagctaaagcagtgtttagagggaaatttatagcactaaatgcacacaagagaaagcaggaaagatctaaaattgacaccctaacatcacaattaaaagaactagagaagcaagggcaaacacattcaaaagccagcagaaggcaagaaataactaagatcagagcagaattgaaggagacagagacagaaaaaaccctttgaaaaaatcaatgaatccaggagctggttttttgaaacgattaacaaaacagaccactagccagatcaatgaagaagaaaagagagaagaatcaaatagacacaataaataaaaaatgataaaggggatatcatcattgatcccacagaaatacaaactaccaccagagaatactataaacacctctacacaaataaactagaaaatctagaagaaatggataaattcctggacacatacaccttcctaagactaaaccagaaagaagtggaatccctgaatagaccaataacaaattctgaaattgaggcagtaattaataacttaccaaccaaaaaaagcccaggaccagatgaattcacagccaaattctaccagaggtacaaagaggagctggtaccgttccttctgaaactattccaatcaatagaaaaagagggactcctccctaactcgttttatgaggccagcatcatcctgataccaaaagctggcagagacacaacaaaaaaagaaaatctcaggccaaatatccttgatgaacatcgatgtgaaaatcctcaataaaatactggtaaaccaaatccagcaacgcattaaaaagcttatccaccacgatcaagtcggcttcatccctgggatgcaaggctagttcaacatatgcaaatcaataaacataacccatcacataaatgaaaccaatgacaaaaaccacatgatcaactcaatagatgcagaaaaggccttcgataaaattcaacactccttcatgctaaaaacactcaataggtattgatgtaacatgtcttgaaataataagagctatttatgacaaacccacagccaacaacatactgaatgggcaaaagctggaagtattccctttgaaaactggcacaagacaaggatgccctctttcaccactcctgttcaacacagtattggaagttctggccagggcaatcaggcaagagaaagaaataaaatatattcaaataggaagagaggatgttaaattatctctctttgcggatgacatgactgtatatttagaaaaccccatcgtctcagcccaaaaactccttaagctgataagcaacttcagcaaagtctcaggataaaaactcaatgtacaaaaatcacaatcattcctatacacaaataatagacaaacagccaaatcatgagcaaactcccattcacaattgcaacaaaaagaagaaaatacctacgaatacaacttacaagggatgtgaaggacctcttcaagttgaactacaaaccactgcccaaggaaataagagaagacacaaacaaatggaaaaacattccatgctcatggataggaagaatcaatatagtgaaaatggccacactgtccaaagtaatttatagattcaatgctattcccatcaagctaccattgactttcttcacagaattagaaaaaactactttaaatttcatatggaaccaaaagagagcccgtattgccaagacaatcctaagcaaaagaaaaaacaaacaaacaaacaaaaaacaaagctggaagcatcaagctacctgacttcaaactatactataaggctacagtaaccacaacagcatgctactggtaccaaaacaggtatatagaccaatggaacagaacagaggcctcagaaacaacaccacacatctacaaccatctgatctttgacaaacctgacaaaaacaagcaatggggaatggattccctatttaataaatgctgttgggaaaactggctagccatatgcagaaaactgaaactggaccccttccttacaccttatacaaaaattaactcaagatggattaaagacttaaacttaagacctaaaaccataaaaaccctagaagaaaacctaggcaataccattcaggacataagcatgggcaaagagttcatgactaaaacaccaaaagcaatggcaacgaaagccaaaattgacaaatgggatctaactaaactaaagagcttctgcacagcaaaagaaactatcatcagagtgaacaggctagagaatgagagaaaagttttgcagtctccatctgacaaaggtctaatatccagaatctacaaggaacttaaacaaatttacaagaaacaaacaaccccatcaaaaagcagacgaaggatatggacagacaattctcaaaagaagacatttatgcatatgaacaagcatatgaaaaaagctcatcatcactggtcattagagaaatgcaaatcaaaactacaatgagataccatctcacaccagttagaatgacgatcattaaaaagtcaggaaaaaatagatgctggaaaggatgtggagaaataggaatgcttttacactgttggtgggagtgtaaattggttcaaccatcgtggaagacagtgtggcgatttctcaaggatctagaagtagaaataccatttgacccagcaatcccattactgggtatataatcccaaaggattataaatcattctactatagagacacatgcacgtgtatgtttattgcaggactattcacaatagcaaagacttggaaccaacaaaaatacccatcaatgatagactggatgaagaaaatgtggcacatatacaccatggaatactttgcagacataaaaaaaaaaaaatgagttcatgtcctttgcagggacttggatgaagcttgaaaccatcattcttagcaaactaacacaggaaccgaaaaccaaacaccgcatgttctcactcataagtgggagttgaacaatgagaacatatgggcaaagggaggggaacatcacacactggggcctgtcggggggttgggggcaagggaagggataacattcggagaaatacctaatgtagatgatgagttgatgggtgcagcaactgaatctggttttcaatacttctgttgaaagccataaatatgatttaatatggactataataaggtactattctgctcttcacttcaaagacacatcttttgaatatggcaagtagctagggaaatatcaaaagttccagtattatttcgttatattttccaaattctccactaatctttgagtgtagacatttaaccaaataaaatgattcatattacttaatgttgttactcatgccaaatatatttcataataaaacaaagacatctgagtgtagagagaggatggataggaaatgacaaagaaagtaaagtgatttgagaagggattaggtctaatcagttgggtttatttttttctgggaataattaagatatttactgaggcaatgggttatcataaagcaaaaaacaaagaaactcctaactcactccatgagatcgaatttcataaaagcatttctataaaaatgatgaatagaccaccagaatcgaaatgtatgcaaattgcaaagctagttggaggagtgtgtgtgtgctgccttggtctctcaagtctatcaaaaaaggggaaaaagaaaaggtgacttgctgcctgagcagttctatgcctaacatcagatactgtaataccaccattaaaaaaagggaattcatcataaatgctacttaaaagacagtaaagagccaacacacatgtttgagaacaagtaactcctatcagggaccttaaatgagagagatacggagcttaacctgagggcagcagggcttcctcagtgcccccaccctctacctcccaatccttatagtatcacttttctttagcctacaaagatacgtgtgaacacagttttttgttgttttttttttaaagaaatgtaaggacaaagcacatttgtaaatagagggaataggacatagtggattaaggacagtgtatagtgttttatataaaagattctacaacaaattttcttgaaaaaatgaggcaggtatgagatgtcctgaagcccccagttctcataacttttaggatatgagtaaatttgttatatggcatttcacaggtactgaattgcaggattttggtcagtcacagtttcttgccagaagcactatcttttgtaaagggctacatagcagaatttttgttctattttagttttattttgcttttgtttggtgggaagtaggaagagaaaaattcttactaaattccattacctagaaatatttttatagcataaaacattttccacaaatttttctatgcacattatttaataattttttataatatcatttccaaattattatacatctataataccaatgtaatgactattgtgtatagtctcgatattactgatccatttttgagatattaaggtttttttcctttttttactataataaacaatattgtgatgaacagcttcttcacatatattttggctaatttatctgactatgccctaaagttaaattcctacaaagaagagaaaatcttctgttttggaaagataattggtgctttagaaagatagttcttgctggtggcgatggctgggttgggggagagaaaagactaaaagactaagaagcccataaccaaaactcaggcagtggtaacagaagtgcagatgagggagagcagaaaggatactcagaaggtagaatcaacatggtacagagactgatccatgggaagctaaggagagactcaaggagagagaaaagtcacgggtggcctgaaggctcctagcgtgaacaactggggagtacataatgaatttcaaattgaacttgttgagtctgaggtgccttcaaggcatcctagtagaaatggtcaatgggcagtgcacagtggaaatatatagcattccaggacacagacccacacattcctgacaaacacaaatcaatttggttttacaggagttcataatatcacccctgccaattttaaatatagtgtctatagtgtgtgtgtgtgtgtgtgtgtgtgtgtgtgtgtgtgtgtgtgtgatgggatggggattacacaggaagtttctttggttgttgtccagtcactgcatttgatgtacatttgatgtaacagttctttttttttttttaacattaatgccccaaccttaaagaagagcttttgtcttattataaacaatactgaattaaaatttgcaaatttaaaactagagcaaatatggaaaaagttattgaaaagtaacaatcaatccatcaatgctcccagtgaagaataaacatcatcataagaatgcccaatatttgcagtgtctattgttttttgaaaaagatttacacaggcataagatatttgatttttaccataaccttggaaggcacattagtttttattgctaatttacagatctaaggaaactgaggttctgaaaaggtaaacagtgtttttctgttgttcaaagctgggaaatgcccaaattgaaacttgagccctggctttcagactctggagccggagttcttcctctcacccttcagctagctgcattaagtcaatcaatcaataaataactttttattgcctgttctttctcttcctcctccttattctaatcaagatattttaagttttgaattaaaaatttatctcattcttatggcaaagtaggtttcaagccatttcacggaaatttatacaagtgcctttgtgctacaatggctgaaccagagcacccagctctcaggcagtccccactgtggagacagagcctgctgtcccactggacagagcctcaaccctggctgactcacagccctgtgtatgtcacttggcagcttcttccagtagcatgtccttccactacattcttcagtcacctttctctactgcacaaatcctgcctgataatatgtgtgcaatgcaagcccacactactttttggaacctcattcaattgtcacctcttgcacagaaaacaaacaacaacaacaacaaacaaaaagctatttttgagtgtgcctgtttatcaagagtgttctctaaaaatttatcataatgccattatcattctgtaactccatggttcagatttaaggcaattctatatctctttgtctcttgtgtagtctccagtcaacttcattctcagagatttatagaaaatttttcccatatactgctactcagaagtcacatttatttttcaggttttttaggctgagtctgacctggaagcactttttttatgggttcagtttccctactcttgaaggttaaagtgactttctccggcttcctagtttattttagaaagccattataactgtgacagaagaaatctaaccaaaatagcacaaaaatattctgaccaaactcagtttttacttttggctgaaagctatttaatgtatgtttggtgccacttaaaaaaaaagtttcattgagatgtaactgagataaaataaactgcacatattttaaagtgtacaacttgacaattactgcaaatgtatacaccagtgagaccatcaccacaagcaagggaatgaacatatccatcactcccacactgccgacttcccgtgtgttccttcagaatcccttcttttccctcctttgccacatattctggaaagggagagcgaatatcgttaaaacttcaaattctttccagcttttctatagatctaactttgttttaataaaaatcacaataggagtcttaaaaaatgtaaaaacattgtccagaaataaaagcactttaaaatgatgttacaaatgaggaaataagaaaacaatgaacacatcaatacaaaaccaggcaaagtccataggcagagaatgctcatccctctgaaatggctaataaaaagactgaaatctaaatctaaatcttactaataatcaaataaataaatgacaattaaaatagcatattcatttacattaatttttgtcaaagatttagaagacaatatgatgctcagaatttaaagctttttgaaagtagacactaatatattactgaaaaaagtacagatttccttgtaactattgcaatattaaatgtacattatttttgatgtagcaacttatctaggaattaatactaaagaaataaataaatgaacaatggcaacaacttgggagcaatataaatgtctgtcattagtaaactggttaactatctaatggttcattcttataaaggaatcaccagaggccatttaaatggtaaagtttatctgtatgaattaagtggaaagaaaaagagtggaagtaaaggagatacatatagaatgatttcttttcttttgtacacaaaaataatccactgtgtttttcaggtgtaggaagaactctggaaaaaactatataaaatttaagtaaagttttctctgggaatggaagtaaaacagctttcactttttactatatatatatttaattttactaaaaaatatttactacttttataatttcaaatgttttcatttaataacaatatgtatatattcttattaaacttatatagttttctatgtccctctaaacatatacactgatacggtttgactctgtgtccccacccaaatctcatcttgaattatactcccataatttccatgtgttgtgggggacacccggtgggagataatttgaatcatgggggaagtttcccctatactattctcgtggtggtgaataagtctcacaagatctgatggttttatcaggggtttccacttttgcatcttcctcattttttcttgccgccaccatgtaagaagtgtctttcacctcccaccatgattctgaggcctccccggccatgtggaactgtaaatccaattaaacctctttttcttcccagtctcaggtatgtctttatcagcagcatgaaaacagactaacacatgcactaagaacaaaatcctaaaaaatacactacaaggtgttagagtcattctataaccacgagaagtcttataaaaaatttgttcatctgatttttctaatttttgtacaattatttgttataagctgtataacaaaatacttctaataaactcttgtttaggtaaaatcaatataacaaaaaattacttaaatagtataaaatagtcaatctctacatttttttttccaaatgctgacaataacaataaagtaaataaagtcactatagggacttctgcttcttgcccaaaggagtcaggtttatgcttgctcatgaaagaatggaaaaactggacaaaatgaatgaaacaacagttttcagaccttaggcaacagttagcttagcatggtgattagagaaaatgaatacaatgagatgacgcctatggttgccccagtgtacatgctggagagcttccaggtcccagcataaggaggagggatcactgcctgacctgaaagtctccctaagttgaggagatggagctgggaattcagggaggtcaaggtaactagaatttgctgaaaagagaggagacagtggcccagagagggaactcagggacatctgcacaggccccctcttgagtcttcagctgagtgttgatcagcctgaggaaggtgaaatttctgggaaaaagctggaggaaggaatgacaaagacacgaggaaacttttgggggtgatatatatttgtgtactatctcagttttggtaattttctcacagatgtgtatacctatatcaaaatttactaaattgtgtaatttacatgtagtttattatatatttttttccagtggagttttaaaaacaattttgtaaagaaaaaaatgtatggtgaaaatgaactgatgggataggatattactcaaattagctctttgtgtaagcacggtacaattagcatcgatttacatttacatctcttcaggttgacaagaaagcaagtatggataccaccaaaaacacctatataatttgcatccaaatgtagtaaattactttgaaaaatattggaagttttccctagtggattaaagttttcctaacatgtgactttaatcattggcctattactctaagaaattgtaattcactaataatacataaggccatagacctgggtctgccccctccctcaatatcaataataccaacatttgtagaaggtatataaatgttatgcacttcaagaagagaagtatgccaagagagatgtaataatgcatgagatagagtctagagaatttagaacaagccttggtttagatgaacattaagggattaagggctattcttccagtaggacatttgtaggagaacaggaaagccaggtgaccatattctacagggcaggcctgagctttatctatttcgtggctggatgttgcatgttctctgaatcagcaaattgtcagtgggaaaaatgtatctatattgactgctctcaaccagcttatttaagataaaatagtaccttggcagccagctgaagagattttttggtactgtgttggtctgagtaatggattattgatctacagttaaactgatctgaaggtcagacttctaggatttctctcagtctcacattctgaatccattgttgtcttttaggaatggttatatcagaggtacctgactcatctttggccagaacaacaggagcaaatctggtattacagtatgtgggctgcaaatataacaaaattagtgcctctatattttgctctgcagattgttcctgaattatggtcccacagtcatgctgcattgctcactggaagtttctataatgagaatttaacccacttgtttacactggaacttagttcataggttctcatcacatttatttcaggctttcaggtgaaataccctgcctatttgagcttacaacatttttatttctaatgtaaacgtgtgtatctgtacgtgtattttaatcaataaaatgacagattctcagcttctcgaggactatgccgaaaaacctaaaggataatccaggttacaaatagcacattctgttcagtgaattgggctttcatcccattatcagacaatgccattggttctttaaaattaatcgaggggaatatttcacatgaaagggattacttcttcctatgcaagtcaaaaaattggaaaacaaatgaacatttaaagcctactggagcccagctgtttgccccctgaaaagattatgctattcaatgactggagtgatttaaagaagtagcatgacatttgaattattggctatcaaaaagaacttgtggaggagacttcataaaatgaacttctaagaaataccccttgagaaatggtgctgaactctaggaaaaaaatagaactatttctgtttaactgtaaggacagcttctgtgtttccttaggcaaacagatttcctgtggtctagaaatgtttctgtctaccacagaggtggatttaccgtgaggctaggaagggtgaagcttcagggcccctcacttgcacaagctccttcctaaggcactggaaaaggctcgaggggtgggatggcatgctcctttgcttttagaattttgcatgagtgagacattttaactgcagaagtttaagatcaatgtctacgtactgattttgcctatatcacacttttcccttgggttagttagcactggggtgactgtgggccattttgggatctggctaattagaaactgagttaaagattcatttagtttcagtttggtgtgattatattcttgtggttctcagtctcttccctgtacccttaggttcttgctggctgtctgggtgtagcttccacgaacacacctgattaccatggtgctggtaacatgaaagtgcaagcccagagatcactccaaaatcaatgtgcccagagcttcaggcaccacaagtctgtgtggagtgaaggagacacaatgttcaaaacatataaagccaggaactgctctttgaaaattcttccaaatcttacagttcacaaatgaaagacatttgatagagatatttcccaagtttggtcacagtcctaagaatgtatatgaaatcacccccaaaaattgagaaacttgatgtaacttttctaaactatcggtaataaaatgacagattacaatcaattatactagagaaaagactgcattatcttgttattctcaacatagaaaacataatagaatcatgtaaaatgaagaggcaatcagagaataagcaaccaaaactacagagccaaaaaaatcatagaaatgtatcaagcaattaattttctgaaaatgaagttaattttataaattttgttatccttgtagaatttgtcagctttattaattttataatctggtgtgatttagttttacatcctaaataaatattcaatctccacattcaatacatattccaatgatgtatccatttctcttaaaagggactcctcgagttgtataagacatcagttggtataaagcctggacccactccttgtcaactaccatagtttccctgggatatgaagaggtaacttcctttatattacaactaagtaataaaatggatataaatgtattagccgaactgcaaattgtgatattcagcattttaagggactgattctgttggatactcagaaatataaataggccaaatcctatgaccaataaattaatcaattgataaaacaatgtatctttttcttgattacactaaaaatttaaaatattatattccttatacaacatttttaatttaatttgccttgtaagtgttggtagtatatgcatagttctccagaaatatgtttttaaatatctttatatataaaactgggttttaggtcctcgatttgtggcaaacgttttgaacgcttgtttggcttaaaattcacaaacatataaactagcaatgacatcatgataggctttgtgcatttcttaccaaaagtgataaaatttgtagacaataggccgggtgcggtagctcacacctgtaattccagcactttgggaggccaaggcaggcggatcatgaggtcaggagatcgagaccatcctggctaacatggtgaaaccctgtctctactaaaactacaaaaaattagctgatcatggtggcacgagcctgtagtcccagctactcgagaggctgaggcaggagaatcgcttgaacccgggaggtggaggttgcagtgagccgagatcacgccactgcactccagcctgggtgacagagagagactctatctcaaacaaaaacaaaaaaaaatttgtagacaacatatttaacaagtctgtcatacttgttcagctccataatccttactacaaaatgcacataatctggcatattcacagccttcaagttgaaatggaagctttcatcaagttcatcaaattacacaaatcacacatgacaaaggagagaccacaaagctggtgtacaattgtttaataatttatatgttaatattggtaaactaaagccaaatataaaaatgaaacatatcatcaatgacatcttcagataataaggataagattattattttaaaactgtaaatttagataaactgaggtctgtataattcatggtaatatttcctatctttctctatatattattcatatatgtacattttaaatatatttttgaaattagggatttttcaaagtttttttttttttaattaaaatagtgattttaaatatacctatacctgtttaaatatatctgtaaaatgttcaggttatgacacactttaaataactaaaattcatcttaaaccgtatcttctaccacatcatttacatgtgcaggagataactgcagataagactgaagaaggatggaagctgaaggtttacagagaacaaagtttttgatacttccaactgtgaaaacactttaagtattcagaagaaaaggttgtatcataaaattatatatatgtgttcacatttaaaacctcaatattctataaagatctgaattaaaattaacttagaaagtaattttgtcttatgagatgactgaatggaactattaaacacataacttattcatatgattttatttttatatatctttgcaggaaaaggtatatgtaaaatgaggtagaactaaatcagtgattcttaacccagaatcactacactgtaatagaaatatgaatgtgattccagtggtacatgtaactctaaaattaaatacaaattctctgtgtgattatgtatatatccagagtttccataagagctctgctacatctacttagactcttggatgattccagaactgctaatagagtgaaacacacaaaccttttagaaaataaatttcactaagaagaaaaagaaatgaagttctaattgtgttggtaatgtcccagtcccacccacacatcacgagagagagaaaaagaaattccaagaaggatttgataatttcaaggaacaaagtgctcaggagatatattcactgaccaattccccaagtgctcatgtgtgagcaattcaaaaattctaaaaatactattcagtgacatctcaatagttcttcaaaatatgagattgaaaaacaaggcctttttccaagtcactctcttaaatatggttaacattttcattacacaataattttgaagagtttttgagcctatggataccttagttaccaaaatactatgaatgtgagcttctgtagtcattaaagaataaagatgactaattattaatttaaaggttatgaaaacactcttaaatattaatgactaaacacactaactgataggttgtgtttggactaacactgacagcaagcttcttgtgaagtctgctggtcaagttaccaaatcagaggtgcagaaagacaagaaaattctcaaaaatgcttccacaagaagaatccttgaagtaatttaggcatctaacctcaaaaaaaaaaaaaaataaggtttaatggaggaaattattgctgtattctcttgcattatcaaggctaagaaagattattagaattattttgtatctttctggcaacatgcctcataccaaagggaggaagtggcagggaaacaattcattacaaagaatatttttctaaaaatgagtcctaggcaacaaggaaagagcttgtcttacgagttgatgttctctcccgaaaaggcaattttaagcattgagaatgttctgagatggatttctgcagagtaggaagttggattcttatatataggaaatccctgtcagtacttaaattctacgattctatgatttattaagaatagccacttgtgaccacatagggcacaacctgaaaacagggcagccgcctaagagaaggcccttaaatagttatgagtgaatgcccaatgtgaggtgaagaaagggagaggtcattagaaaggaagttgtgtacaaaacacaagattttactgccttggtgaattttgaaccacagccaaattactttcttctctgagaagatatgaggaagagaataaaactcttcaaggcaacagcatgatataaatccaaagcattttcatactttgggaacgtgcttgcatgcagaagtgtgagccgggggaggaatcttgggtgataagaaaaacacgtcagcagggcagagtggtgaatggccttcaagataaggataagtaattgaaattggttaggaaagcaacagggagccagaagaaggaattgaaatgagtaatgggaagccagaagattagaaaagctagacggattaccttgggaagcaggattttgagatggtaatggccaaaggggagattgtagaatcaagacaggaaacaaaaagacaaggatggatagacctattcccgaaacaggaatagtaccttcatgaggtcccagagaggcagtttgtaataacaaaaatgaggccttcactgaagcttgggagttatataacactgatctaggatggcatgcttacctgtcaccgttgcttggtatccatcaggaaatgtttgttgcatgaatgaagaaaaagacacagttccattctacataaaataatcattcaaaatcaccaatttgggaaacaacaatcaactattagattgttaaaatgttgatagtttgtgaacctttttttttttttttttttttttttttagcaatgacccaatgtcactgtagtgtttcttcagaactgcttagacttttgtgtagaagtaaaagaaaagaccatcagttcttaaggtctgagcctgaaaacaaacgttctttattttgaatttgttttcaatgtacaaaaggtttacatgaaaaatacaggcaggctaatattgcaaacaacatgtaatttcaaagaggaaaaatattcagtactttccctctcactttttaaattagattcagtaacatgattaactcttacctacatgttttcagaactaagatgaataaattagaggggtggttcaatttaaaacaccttttccttttagtaaatctaatgtttatggtagtcaataaaagaattgctcttttagtcatagaaaagcctcagaagctcttctaattcttctattctgttgattgatgcaaattatctctacagggaattaattttaatagttaatgaaatgaggaggctgaagatgcagaaatcagtgccttgagttatctttgtgtgtctgcaagggctaactctgcactctgctgtatagccagcaatgacaagtatcctgaattgactgaggaacaatctgaaaaaaattcacaggaatcttaaaagactcagcagcctttagccaatatccattcttaagtgtgatttaagtgacacttccaagtcttattaaaaaaaataagtaaacataactttaaatacctaagatttctggttagtaacatctaccatgtttaatgttatggtcgattttattgtagcagcttgataaaagatcactacttaataagtaaggtcattctattaccaatttgaaatgttgatttcatatatctatgcactcacttctccataatttgatgtttttgtggttgcctcagaagctgtgcaatagctaaataaagaagaaaaaatgtgactaaccaggcaacagcccagcccaaatgaatgtgttgtagtttttataaagtgctatttgtataaattcattaataaacttttattttataaaaataattgttggccgggcgcggtggctcacgcctgtaatctcagcactttgggaggccgaggtgggcggatcacgaggtcaggagatcgagaccatcctggccaacatagtgaaaccccatctctactaaaaatacaaaaaaattagcctggcgtggtggcaggagcctgtagtcccagctactcgggaggctgaggcaggagaatggcgtgaacccaggaggcggagcttgcagtgagccgagatcgcgccactgcactccagcctgggcaacagagtgagactctgtctcaacaataataataataataataataataataataataataataataataattgctaaatgagagcaaagcttttcaaatcaatagactgtttcattctttctcaacctctaatacagaaaacaaagatcttttatgtcatatttagtgcatgctcaataaatgttctttattttttcttttctttaacaccgagtgaaaaaataattttatctgaccttccttccaaaattttatttggctgacagaatgctaggcttacatagacagggaaggtcacatggagtacttgggtcattcaatatatgaaacttttccgtggaaaatattaataattataattgttgagtgtaataataatccatatcttgacattaaaagaattgctgagttttatgaaaatgattatttcccttccttccttataataactaatggcctaattctaattcttaaaagtatttttggagaagcactagattaggagacagaaagaaagaaaaaaagatagaataaaagaaggaaggattctatccacctggcatttctcagtgtctgctggttccaaaatatagcaccatttgtagtggatgatgtgaagattccccttcaagaatgaaagactcattttcctagattctacaagtgctctcagctgtcagccctctgtaaattgccttagctaaagagcaccattttgttccagcatctactatcaagtgaccaaggatataaaggcctaaccctctcacccgaatttaggacaactctcaagggcatgccagcttcggaactgtctattggctctgctgaggccttcctcaagactgcattgcagaccaacttcttctatctggtcccataattctgccttcttccctcccctccataggtgttggtcccaagaacggtctcatatatgcctcttgctaccccatctcttcttcctcagaggcaatcttcttctcttggaaacctaatctgtgaagcactcactgagaacactgaaagtacaccattagtctctgcctgtggccattcattccttaaaagagtttactattaaaattaagctactgaaaaaatgaaccttagacaaattttcacttctccataattccccttatgtacatctatctcctttgatagaatgccacataagcattcacacatatcagcctagattctttgcttgcccaatatgtttgcgttgtgtgctcaggatgtgtaacaataagcatttggagtacactaagagaatttgtccctgcaaaatatacgaaactttcacagctaatattgatatcaatttaaaatagatatcaatgttaacataattaagaggtgtgcatttcactgtggcttttaaactttccttatgactgtatatttgtttgagagatctcaagactttattgtttactcattctttttcccagaagggcaattataaaaccttgtctcctcaaccattcttcaaatctcaatactttcactaattggagctcaggaaacactcatttcaacactcaattcagatcttattgcatgttttttttttttaattccatcaaggaaactgtcagaaatataaatgcaattaacataggattgacaaacaaaatgctgaattcttttatttagtaagccagtgattctctccatgccaagtaaatatcttagtattgcacagcacataaactgaacttatccaactgtttggttatgcaaaacaaatccattgatatttaataatagtaattaaaatttaagtgtcacattccagaaacatttccatccaaaaaaagacactttatagaaatactaattttttaaactgaaagatatcatccaacatttcaaaactgaaacttgtaaaatacaactattggttaggtctacatagatgcatactgaactgactattcttcaaataatgttagcaaaaaaaaaaatttttttttttttttttagacagagtttcactctgttgccaaggctggagtgcagtggcacaatctctgctcactgcaagctgcacctcccaggttaaagcaattatgccttagcctccagagtagctgggactacaggcgcccgccaccacgcctggctaatttttgtatttttagtagagatggggtttcgccactccctgcccagcaaacaaatgtttttaagggcagtaattttatgtgagactgtaatgtaactaaattcctaagagatcatttgaatccaccgtagtgaaagtgatgtttatacgtagaagtggggtgtggtataaataaacaataagcaggacatagtactctgtaggactggagattcagtgacaagtcaaacaagaaaggaggagagaattcatacttcagaacacttcctattagcaattattgcacataggatttgtcccaattctgcatttgcccagtttattctcagaaaatacttcaaaattatgaaattggaacaattacttcaaatgtatgcttaactataattctaaattaattcattataatatctatttatgagtggggaaggagaaaagagtggaaagggaaagacaggagggaagaaggaagaggaaaagggggaaagaagaagaagggaagagagagaaggggagaggagaagggtgggaggggaggggaaaaagggaggggaggccaggtgtggtggctcacccctataatcctagcactttgggagggtgaggcctgcagatcccttaagcccaggagttcaagcccagcctgcacaacctggtggaacaccgtctctacaaaatatgtaaaaattagccaggcatggtgccatgcacttgtattcccagctactctggaggctgaggtgtgagaatggcttaagcccatgaggcggaggttgcagtgagctgagatactgctactgaactcagcttgggcaacagagccagaccaagtctcaaataaataaataaaatgggaagaggaaagggagcacaggggaggggaggaagggagagggaagaataaaataacaatgacttttatcatctagcgtttttcagtacttgctagttccagactatagtaccatatacaaaagagttgagagttgctcacctattacctgcccctggtcattcatccttgacaaaagcatcagtttactgacagactttgtggtttgaggtactttgttagcacaattgcctcccatcctatctgtaggtgttgatttgtatcaggaaggtcatgactggttcctcccaaactattggtccaataaatgaggaggggccactacttaggaaaattgttctatatttagttttaacacctttatagagatgcaactgaaataccacacaatctgcctgtttaaaatgtacaattcagtgacattagtgcattcacagagttgtgcctccattaacacaatttagaatattttcagtacaccccccaaaccctttgaccctcaatcttcaattccccataccccctccaaccctaggcaatcattaatccactatagacttgtctatagtggacatttcacttaaatggaatcatgaaattatgtcattccggcttctttcatttagcataatgttttcaaggtttatacatgtaatagcatgcattgatactgaattctttattgttgaataatattccattgtatgaatataccacatttgtttatccatcagctgatggctatttggattgtttccactttttggctattaagaataatgttgctgtgaacatttgtctatgtattttcaattcttttgggtatatacctagaagtagaattgctggatcatataactctgtgtttaacaatttgaggaactacaatattctatgttttttttcaaccattgccatatattaaaaaaaaaattctctgaaaaaaaaattaatgccaaattctgtcagtattggttcagtttgcggccacacatcttagaccaaagctcctacttaaaattgtcttagttgtttaatgaattaacactgtaagagcttgatgtgcaaaagagattcgttagctagtctttcttcttgatacaatgttccaaatattgccaataaaaattaacttaattccttgaaggtagaagcacttactgataagttcctcactgcaatacctttagtgtttttttgttgttctggaacttcaatataaaatgtaatgttggaaaagtaatgccactaataaaaatatgcaatattttacatccttgtaattgtttacaacttatcagtaactccaacctgaacatattcacttcacccttagagcagtcatttccaacctgctttattttgctgttattgttgatgagtttgttctgttttgttttattttaggctttagcagccagaagccatggtttttagcttctgtctctgttgataagtggaaaagagggatgaggaaggagcttttctggcccaaccagaaacagaaactaagaacccatgactgtattttctcccttggacacccccaccttagagcatttaagttaaaacttctctaatagaaatgataaaatcaagatttaagcaggctaagcgcttccaaatattaaatagatagttacacagctggctggaacttcatactccaaagttcaagtctagatcacttcaagttatgtctgttctaggagttaaaggaatagtgcccggctatgttcatttgtccagtctctactgtcaccttgcctttttacttcccccctcctcctacacacacaatactcaagtcacatactcaattcatgcatatgcagacacagcaagtgcatacaccacacacacgttttctatataccacagacacagatgtacattcctcatacacaatcacctcacagacacacacatcccacatacagacacctcacacacacttcagtcacaaaaaaactcatgcacaggacattcaaatatacacacatcacacacagacttcacatacacattcacaccttacacacacatacaataaactcacatatatacacactcacagaagggaagaaaagttgtgagtttgcaccaccagattacaacgtattggaccaagttttctagggaggggaagttatgtgacaaggacactcatccaaatctctcttaatcttcctttctccagtgctggccaggtaagtggagtcaagatatgctttcaatcttattagaaaccatctgttaagtccacgtgtcatgtggctgaccagaaagcagttatagccaatgacacagatctgctcttaggggaaagaaagtaggggtccctatctcaaatctaaaccacaggcaggatgcagcataggaggatgtgggcattcctaaccccttagccatattgtcaccactacgtgtgagaactgtaggaagtttcttaaactttgaaacgtcagcatatttattatggtaataatacttattggcaagttaggggaaaaaatcacaagtcttgtatggaattgggtgattctgcagagttgcaattgtgacaaataaattatactttctgagacactcttcagttttagcaattacaatagcaaataattattattcataacagtattaacatagcaaatggtcatattccttatagagatagcatttccaagaagtctttaactttttttctaatttgtcatttcagtctctcagaaaacattgtcttctacaatacctgccttttacagttgtcctaaggcctaagatcaaatacaccacataaaatatgaggcacgtggcaagaattcaataaatggtagctactactactattacagctattttcatcccaaccaaatatatacttggaaatgtaattgcaacacaagatattttgagatattgaaaggacaaatttgaaaaacaaaataaagactactcggaagtgctgtctctataaggaatatgaccatttgctatgttatgaatactgttataaataataattctttgctattttaattgctaaaattgaagattgtctcagaaagtgtaacttgtcacaattgttaacaccattgcaactctgcagaatcatacaattccatacaaggcttgtgattttttcccccatcttgccaataagtagatttttttcatcaccaataaattaaggctatgcctgtgccttactctccaaatcattagagctcaaatgaatctaaatcactgaacagattaaagttttagataaaaaataaatgtcatcatttactttctaaaaataacagcaactctgcatatttccctgtaagcttatagtaattatgccattcatatatactatctaaacatttatatatagtatatacatagaacatgtatacaatctatatactttaactcaatgaggagatattgctaacctattgatatttaattcttgcagaatattattcaataaaatcgcaattcttcttcaaactagttcacacttatgttattagttagctcacaacagcagcttaataaaataaattaaaagatagtaagtctccaaagagtgctaatacattccgcatgttataataaggctttttctgaatcacacttttattgtacaaacactgtttaacatttagcaatccaaatttaatcaatgttttgtgttattcctctgcaaattaacacaactcttatcacagatactgaaatatttgaatttccttattacataaaaattcctgttggctttaacctccctatgtaaacttataaactggtttaagggaaaactgaaataatcctttgctaaattatacttaaggtgaagcttaataaacgcatattaagtagaaagcaacgtaaaaaagaataattacaaatataccatttactgttcgcttactctatgccaggtataaggataacaaatttttaaatatatcttatttaatcctttaaaaaagcatgatagtgatattattttctgcaacttatagattaaaaaaaaaccatgaatctctgagtatattatttactaaagtctcacacctagaaagtgttgatcctgggttgctgaattaaaaccctcaagtctggaaactctattccatctacctaagaacccaaaatggagagccagattttttttttttttgagacggagtctcgctctgtcaccccagctggagtgcagtggcacgatgtcggctcactgcaagctctgccttctgggttcacgccattctcctgcctcagcctctggagtagctgggactgcaggcgcccgccactgcgcccagctaattttttgtatttttagtagagatggggtttcaccgtgtcagccaggatggtctcgatctcctgacctggtgatccgcctgcctcggcctcccaaagtgctggaattacaggcgtggaaagccagattttaaaatgagcaattgggtgtttgatgttgcccaaaggactccagcagtcaacaaatatacattgccaatgccaaagatattcctttattgcatggtttaaaaagttggttgagatctttataaataaaaaagtgtgtgtgagtgttcgtgtgtgtgtgtgtgtgtttcaagaaaagtttcagccaagcaggtggctcacatctgtaatgccaatgctttaggaggctgaggtgggagaatcacttgatcccaggggtttgagggtacggtgagctatgactgcaccactgcactccagtctgggcaacagagtgcctctgtctctctaaaacataaaagaaattttaatgcaacttaaatttttaaggtcaagccttctctgtacaatgaaaacctatgcaatccaaggagattttcaccgtcaaaggagatccttatactgggaagggatatgttgaatcagtaaataaaagcaacttttgcagatttgcaacaaatgcctaatgggagaatttgcttagaatgaatcacttgggtgggtgaacaaacttactggttctgcatcagcaaacatagagtaaatagtgtcttaattttctttccaaagaccagaagaattttgaaaagaaaaataaaaccctaaaatattgttatgtcacacaagaagtggaagtaaacaggcagaaaaaacttctaaagctaagcacttaggaactgagtgttagtaaagagaaacaaccaactgcattttggtttcctctgtaagctagctgagtggagaaaactgtgaagaaaatgaaaatcacaactgataagtgcttttcttctcaaggtgtggcctccaggcctttccgataattatgtcataagaagagattaggagtcttcgtaggtaagaagtcttaaggacagtctattcaaaaatgtttttcatttggtactctgttacagctatctcctttctctgacagtgtccagctacagtaacatctatatcaaactgcctaaagaattttagcaatattttgataactcatctatcataatgttcccttgcccagccatcaaagggcaatccttctgctacagtgtgcacgaaatggtctgaaccacaccacacatccttgagctctgaatgcatcaagataccagcagttagaagattcctattctctgacaactctctcataacaaacttgatttattaaaaaataaatattgaagtaggccgggcatggtagctcatgcctgcaatcttaccacttggggaggccgagatgggtggattgcttgaactcaggagtttgagactcacctgggcaacatggcgaggccccatctctactgaaaatgcaaaaattagtcaagtgtggtggcatacacctgtagactcagctactcacgaggctaaggtacaagaatcacttgaacccagaaggcagaggctggctgcattgagtcaagataatagcactgcactccagcctgggcaacagagtctcactctgtcgccaaaataaataaataaataaataaataaatattgaattagtaacttttgcatttcatcccttggtaatacatatttcttctgaaggtaatagtattttattctaatgaactctttctgccccatgtttagtaagcagagctcatttgtaaccatttgggcttcagacaaaaagcttttctaagttttgtttttatgaaaccaatatttaaaaccacttccttttatttattttttctctctcaaaaacaaatgtccatgaggcttcattatttttttcctcccttttctaatttcttctttttgaaagtaatttattttctaaaattgaagagccacctgactacagttactttagggtaactgaatgtggttgtgcttttgccttttaaagagttagttctgactacattcatataaggctttgttttcaaggatgtctggaattcaaacccctgggactgagaatatcacccaggaaaaaaagatgccaaattgaactaaaaggctactttacaattttgacctgtggattttatttaatgagggacaatcaacaaggctaagtaaaatagttcctggaatatgtctgacagtcatatgaataggataaaagctgctgaaacagtgctcaaagcaagttatcaccaattctgaattctgaatattgcacctaaattcacaacgataatagctatttttaaaaataccactcattatgtcttcaaactctaatctaccactcttagatcataatgccaagagtaacccctactggccagtctattttatggctaatgctgaaaggatacaggagaaagggtggttttactgatatatttataatcccaggagcagtttgccagcactgcattttcatgataatattatatatatatatatatatatattttgtcatctagctcctccagtgatactcctgaagatttaacatactttacttttacaaagttttaataactataaacatgttgaacattttaaatttctggcaatataaataatatttctaaatcaacagataaaaggaattctgctcactttaaatagcttttccttagtattactttctgaagagggcaaattatcaaatgatgtttaaaaactccattacctgctccaagttaaggggcgagacagggcacagaatgaatacagtgggggtgtgtcattaggatgctaatttacacaacaaaaattaatgacagataaagtcagcagcatgttgacatgtccagcccacatgccctacattttgtctacttacaaagtgacatatgactctagatgtttgcataagcaacatggagattcccttcattattgcatgtttaggttgctagtaattgagtcatactcctgagctaaattaggtaaataaacttgtgtataaggaagttaccatgcaatcctattaattttccatatcaagatatccaggaataaagcagaacttagacagattctagaaaaaatcacacatagggcaacattctcacttcttcctggcccactgcatctcttgcattctttatgggtttgtaaaaatcaggttaaaataaactaagtgtagttcatttcacacaggaaagaaagtataaatgagcattgtaggccaggataaagctgtggctggggataggcattctgtcctgtttgcctggggtgctaattttatgaacattatatgctattatagactatattattgttctcaacaattcactcttttgccacttgaatgttcaggcgttctgggaggggggatatattgctgagacccattgtctggttagccacaaacttgcttgggctaatggaatgtgagtggagatgacagtctgtcattttagatcaaaggctttaagaagcattacgtgcttcccccagcctcttgctctttaccctgggccacagttccgttgtcagagttccaaccagctgtactctgggcaaggttgagccatttcctctactttcttctaatggatggaatggtctaacccattgaattgacaggaaaacaagaaaatactttggctggaaagaaactcttacaagagctcaggctaaaccctaaggaattcagacttctctttgaaaatcttatttgtcaatggtcacaattcaggagaaaggacaaggtatactgcaacacctgggcctcatttttgctgacaatggagcagatggagtgattatctgtaaccttatttgcactgaccctgaatatctgttgtttgtcaaaaccatttgaatccttttagtttcagtttcccacacgtataatcttattactcataaagtttactctaaagcaaggtttaaaatgaaatctcatgagaattaaacatcatttgtacacttagattgccattcttaaaaaagttacataaattcagcagaaagaaagcactattttaagaaaaccaccttatcctctccttttaattgcttctaagaaactgggcaaaccaccctcaatgaaaataatttgaataataacatatccgttctcttatattttaattttataatattccatatgtgaaacaatggggtaaatattgaagatgagagtgggtgagagtcctagattccagaaagataacttttacttctgctatttattattaattttcttcctttcaaaatagagttttgtaaattgcagctatttctaattctactcaaacctttgacaaagaaggagatgtatacacaaacacattaaagaaaaaaataaatggttacattttaagttggaaaatattattccactttaaatatatcctaagtttaaagaaagtatttattgtgagccaaggcttcacattaaattttgcaatttgtctccttaatacttctagaacaaaagttaattatttcttaaccacttacataggaaataagatttagaaattactcaactcacttatttctgctgatatttttctttgttttttttttcctttgagatggagtctcactctgtctccaaggctggagtacattggcgtgatcttgcctcactgcgacctctgcctcctgggttcatgcaactctcctgcctcagcctccagagtagctgggattacaggtgcctgccaccacacctggctaatttttgtattttttttttcagtagagatggggtgtcactgtgttggccaggctggtctcaaactcctgacttcaggtgatccgcttgcctcagcctcccaaagttctgggataacaggcatgagccatcgtgcccagcctctgttgatatttttcaaatagaaaatcaattttaagtttttctttatcatatgaagcaaatattaaataatcattttatttagtctgatgcttgcttgattatattgtgatatttctaataatctattagattttataataacaattataataattgtttctaagcaaatgaactattttactgtatgttcaacctcctacagaacgctgtataattttctaaataatggaatctatgcagcagcgggatctatttataaattcactgcattttcagtgtcattattgggatatattcctgagtaactgctgtggagacagaaagtatcaaaatatacagcagaaatttgaaccatataaagcctgatgggcctgacaaaggttaacagaataacataacattcagctctactccttttctcaccctcgtctcatctcaaaatatatgcaggaaatgcctcctttttcaacctccttcgcattctgaagagaatgtagaactttgttttaaaattgaagccaatgtaaccaacatttgcctatttttaaaaagctcttccttcattctgattggctttagaaacaggcctaatattgacaagaaatttatagagttagtgagagttttcatgctaatatcaacattttattcttttttgctcactcagttcccaaagatggatgtatacaaatgctgtagaacttcatacatgctttcctacaccttcatttcctcctcctcaaaagattaataagctctgtttattgacgtttttgtggtaagagtgatgtaaatatctcaagccatataatcaagttgtcatgttggtctaggcacctacaatacaactagatctgtgatttaccaaggtgctatgtatgaatatatttattttgacaaacacaaatcagttaatattttgacaagtatattttgataagtataaatcactgaataacagctttcatatatattatttcattttaggtttcagaagtagtcaacagttgattcatgaactgcttgccttgcttgtagaaaatttagcagacaggagaaagaagaaagaaaaataaataggcaaatcccagactcattcctgccataatggtttcattttgcctgttttatatatcagagttttgtgaaaaatttcattcataaagagaggttttctgattttttaaaagataaaatttgaaaatgtctagcagagagctcagtgcctaaatctcagaaaatatttaaggacagagagaaaacatgaaaaacataaatagtatctgcaaataaggttgataagtctaacctttctatacttaaaagaaattcagcttcttaaatggcagagaaaattctgtatgccagattacaatgaatatattctcgtcattatcattatctttagatacttccagttttctgtggatagactttgtaaaatgccatctatctccaaaaagaatgttactaacacccaaggaaaaacaagtttgtagagtcatacatctaattaccaatataacgtaatgattcttttcattatcatgaccctctgcccctctgtagtgacatgtccccctgaaatttgacccaaatagttcatacaaataaagttgcaatgtctccagtcagacatgaactgattgtcttcctagggtctcctggggtagcaacagtcaatttgccacagcagaaacttgagtatgcacattgagttccctccaggtattttggcaagcaaagtttaaaagcaaccatgaccttgtcaccaatactaatggacagacttcagacttctctgctttatgttagcatagttgctggagtaaggttacaatgttctgaggactattattgatcctgacattccaaacaactgtgagttgatggagtaattatcttatattcctgtgaacagactttttctgcctcaggtcactgaaccatttttatttttcccaacataaaatttctatccaaaaagtgatctaatccacctgaggaaaaagactataacttcatcacattcagaataatctctcctcaggtcctctaccaaaatgttatgattgctttaatttccatattgcccatgtacagaagccaacaattattgcagcataacttagagagtacaaataagctgaaatgaccagctatgatctgaacattggcaccctcccaaaattcaaatgttgaaatctaatcaccaatgcaatagtgttaggaggtagggcctttgggaggtaattaggtcattaggcctccagccttgtgaacaggattaatgcacatattaaagaggccccttcttccaagttatagctcccttgccccttcttccaagtgaggacacagcaagaagacaccattaatgaaccagaaacctggccctcaccagacaccaaatctgtagcatgctgactttggactccccagcctccagcactatgagaaataaatttctattgtttataagctacccagttttttgtttgtttttgagacagagtctccctctgtcggccaggctggagtgcagtgggacaatctctgctcactgcaagctctgcctcctgggttcaagcgattctcctgcctcagactcccgagtagctgggactacaggcatgcgccaccatgcccggctaattattgtatttttagtagagatggggtttcgccatgttgcccaggctggtctcgaactcctgacctcaggtgatccaccggcctcggccttccaaagtgctgagattacagccgtgaaccactgtgcccagccatgctacagagtttatgatattttattgtaacagtccaaatggactaagacatgacctaccttactatcagtgccaaaaagactaattctaccattccctgggatctgaagataatttaattgtcctttctctaaaaataatagtaacaaccaacaaacaaaaaatctccaaaagtttattttagaaaaaaggtctaaggaattctatatagttcttgataatttattaaacatagtcacaaatcttttggaatttttcagcaagcaataaagtgtccctgcctaagcaggtttttaaaagctattccaaggagaagccatacagttccgtcactgcatttggatgctgttgctgtgcactttattcataggaatgcatagcgtggcttactggtactgaaaaagactgctgaatggcagattttaaaaagagtaagcaactgaattgtaaaaggtcctagcaatgatagattccacaacccgttagaaatttgcccctacaaccctcctgacttctgaattccaagaagaatgaaagtgatggcttataattagcatgattgtgttaggggcatgacagatgctgtcggccagccttgatgtcagagtaaaatctgtttcctcattcatagtccagctcttttttcacatgatggactgcagcaccctctttctgattacaggcactaggcttcattgcatgttgtaaacatatataaggcagagcctaggtgcatgcagatgataatgtgtcagtctgggtcaagtgacagcttaggaaatgtcaaaatgaacaacaaaaacagagtaattctatgaaatggacaatgtgggtggatattacatttcaatattattaatgtctaactcaaaaatttgatttgccaactgaagtccatttagcaaaacatacacattgtcagttagcctgagaattttcactaggcttaccccacttccctcctagaatttttttttgggggggaggttctgaaggcattatttttattgtgttgtgttgtgttttgctgtgttgcgttgcattgcattgcattgcattacattttttgagacagagtctcactctgtcgctcaggctagaatgcagtggtgggatcatggctcactgcagccttgacctcctgggctcaattgatcctcccacctcagcctccagaatatctgggactacaggtgcacaccattactttgcttccaagttagacataactacttgcatggtctgcttgtactcaaactcagcaaatcacacccagcatctcctcccaatttagcatcttctcatgatttccctatttctgttcctggatcattattctcccagtcattcagacccgaacctgagaatcatcttagatgtctcactctttttcaagcgccatattagtttgtgtaatatggtatcaaaactttgaaatttctgtagcatctgtccctgagtctttccatatctatagtcatcaaacttagctccacattaccccttgctgagtctaacccactagtcttatatttcttagatcacacatccagtctatgttcccacgaaaccattcaagatggatcttcctgcggcattccatcaacatctgcctgctaattctcttcatcctgtacctgagcttagcagctcactggcattttctccaagttgtaccatacttcctgtttttttgcccttgtccagtattctttcctctgtcttcaatttttctgtttatacttctgtggaaatcctatccatccttaaaccttaaaatgtggagagtgtgtccttaagactgcatataatgactatagcagttcaagtctctttgatgttgactaactgatattgaggaaatatgtcaattctgtgggattcaggtactcctctgtaattgggagtaaagggagaagaggataatactttccctgcctctgtcatatctatcatagaataattaaaatgagcaaaaactttaaatgagatgaatatgtaaaagcaagagtaaaagctaacatgctatgcacagtagaaagccttactatgatcatcctctttactgttacatattcaccacatgcagatgaggcttcctcctgggattccacttattttcatcactattatggtcaatactatgacttatctttcagaattagttagcaggtatggtggctcatgcctgtaactccagaactttgggaggccaaggctggaggattggttgagttcaaaagttcaagaccagcctgagcaacatagtgagatcttttctctacaaaatttaaaacaatagctagacatggtggcccatgcctgtagtcccagctactcagaggctgaggcaggaggatcacttcggtccaggagtttggggctgcagtgagccatgattgcaccactgcactccagcctggacagagtccagagtgagaccctgcctcaagaaaaaaaagaagaagaagaagaaagaagaagaagaagaagaaagaagaaagaagaagaagaaagaagaagaagaagaaagaagaagaagaaagaagaagaagaagaagaagaagaagaggaagaggaagaggaagaagaagaagaagaagaagaagaagaagaagaagaagaagaagaagaagaagaagaagaagaagaagaagaagaaagaaagaaagaattagttcactgacttaaaaacaggcctactgagggtcacagattcttttggaatatacatgcatatttggaggacagaatcacaaactgtttgacacattcagttaggttatgaagaaaataaaaggctttggttgtaatatgatcagatggctagttccctttattctttatttttgagatggagtttcgctcttgttgctcaggctggagtgcaatggcacgatcttggctcactgcaacctctgctcaccacaacctccacctcccaggttcaagcaattctcctgcctcagcctcccaaaagtagctgggattacaggcatctgccaccacacccggctaattttgtatttttggtagatacatggttctccatgttggtcatgctggtctcaaactcccgacctcaggttatctgtccgcctcggcctcccaaaatgctgggattacaggcatgagtcaccgtgcccggccttagttccctctattctaatgtaaataaatactctaaataaatgtataattcaaaataaatatttacataaatattgacagatgaagtgctttttgactcatgctgaagttaactagctgccccttgaaaaattagttttctccattaaattattaaaatttaactaattctggagtttttctatggcatgctggacataataggaaccatggacttgctgagagtcctagtctaggagatttccttccagcacctgaaatacttcatgggagaccacagttttcattccatattttgatgttacaatatgaaccataaaaactttcttctatttctattttttactttttgcaagactaaagacaccccccccaatagtccagaattttattcctactttcttcctttttcacttgagaatgtagaaacaataaataactcaaatctacattttatcagtcagtgccaccatttaaaacacagcattttgggcatgatttcatttaaccccttaattgtatagttatgattccataacactgcacactgtctattccttaaaattttcttaagttttactttcacattatgcaaaattaattaatgctccactctgtggactctatgccaccacaccactatcaatgaattcagaagaggcagtgggagtgttgatagaatgtaacatagcattatggtagagtacagactagattacttgtttctcagttttctcctctaaaatatggaaataataataatatatctaattcagagtttttgtgaagattaattggtttaatacatataaaatgtttagagtagagcctgacacacaagtactctgtaagtatcatctattattgttttgttattaataaaggactccattatttcacaaggtaggttaagcatcattaatctgaaaatccaaaatgcaaaatgttccacaatccaaaactttttgagtgctgacatgatgtcacaggtggaaaattccacacctgacctcatgtgacaagtcatagtcaaaacacagccaaaactttgtttcacgtacgaaagcattttaaaatattgtatacaattattttcagcctatgtttataaggtatatacgaaacataaataaattttgtgtttagatgaaggtcttatccccaagatatctcactatgtgtatgcatgtattccaaaatccaaaaaaaaaattcaaaggttgaaacacttctggtcccaggcatttacaataagagatattcaacctgtatatgttaaacatatactaattcttaaattttttgagagaaatgtaattataataaagtggaaaaaactatatcaggtatgagtattaatattttggtttaattactgcaatgatcaacatagctactttaattattattctcatgagagtttttactttttttttttaaatagatggcggtcttgctgtgttacccaggctggccttgaactctgggttcaaatgatcctcctgcctcagcatcccaagtagttgggataacaggtatgcactattacaaccagcccatgctaatgagaattttaatgcatatacacacaacatatacccacacactttcaacacacattttcattatacagagtgtttccataggtagagtagaatgagatatgagttctggttatttagcctggcaactgcagcagagtcaaatactgttagtgtatctatcctggttcatgtcctgttatcaatacaagaggcaaagtataaatggagatcaggtttccatctggttacaactaacagcatagccttgattgcctgctttgagttaggggatcaaaggaagaaatcatcagagatccaaatagcaactcaggcaggcagatcgccatttgaaaaaaaatagtaacttctctaccttaaggaaggataactcctgtttggctagcttgattcctttctaattataaaaataagcttggggtgagtagcaggggataaaaatacaaagtatcatataggagttaataaagaaaacaatcatgataattatctttctaaacagtaaagagaaaccaagtatttcttcatattagaaatataatacaattttacagccaggcatgacgactcacacctgtaatcccaacacttcgggagatggaggcagaaggactacttgagcccaagaattcaagaccagcctgggtaacatgtccaaaccccttctctacaaaaaatacaaaaatgagacaggtgtggtggtgtgagcccgtagtcccagctatttgagaggctgaggtgggaggatcactggagcccagcaagtagaggctgcaggagccatgatcataccactccactccagcctgggtgacaaagggagaccctgtctcaaggaaaaaaaaaaaaaaagtaaagaaataatttttttcaaagaaaccctttacattaaaagcactacttatgatggaatctttaggaaatgctagaattccttgtccctagatttttttctaaaggattaaaatcttcattttctaggagaactgacatttaaatgtatgattcctaaactcaagatttttaaaagatctgagttgctcgataactctatagcacactcttgaagatgagatattcatggaccctccctaaatcttggaaagtcttcaggctaacggcagggctggagctaaagttgaggcagaacctcatttctgccagtaacagcatgcctagccaggattaaaaaatttgccaagaccacacagaaagagactagatggtaagttggatttatacttctctttgcaactgaaggccattctgaactcctgcctaaagttggagaaagtgaagagaggccaaatccagaaaccattagggctcagagataattattatggaaaaccaacaagcatgtacctaatgattccccagagtcactcctagagcaaggaatgaaatgaaaaagtttatatcacccacaaaacaaagattcaatgcagtcaatgaaccaaagaagaaaaattcagctctgaaatgtgataataacctgatattcctcctcaaatctctggatatttggttacattataatttgcttgatgcacgtattcttaaaataccaacactcaattaaattcatcacctaagaaacatggtcattagtaattatttttgcataatctcttttcatttttattactgcaaattttttgtttctaagtccacaaaaggaaacttcaacttgatgtaatacaaaaagtccagagtgtatcacaaattaatttatctagaatgtaatcaccatatagaaaaaatgatgcatatgatcttaaaattgcatccaggtttaaagttctataaaaaagataaagggaaggatgttactattctgagctgatgatgtcttaccatcccaaactgtaaccattgaacatacacatttattgacaaactgctttgaaatcataacaagatgtctcacaaatgtattgtgttttgatgcactagtgtcttagctgtatgaaacagctacatccatgtttttccatctataaaaagggcaatgaaaagatatcctttgagtcacttttaactcaactttctaagtgtctccaattttataaacatgaatcatactcctataaagaagtcttccactccaccttcacgagtgtatatctttgatcaggaagtttaaatggacactctatatgcatccttgtgcttttggggatctgacaatcctttttttgatggaacagtaaatggcccaactgtttgcctaagactaggcagaatgcaatttatcttcttggtttgcagaaaatggctatgtaaactttaccacatttgccagtatttccattccttaagacatagctcattgactaggacccagttttccaagcaagtataagatgtttccttgttactagtatgtttttggaaagcaaaagagaccttccgaattacctcttagaggcatgcttcacttttgtcctcagtaatgattatttcaatatactgtttacaaacccaatcgttactccctttttgaatgcaaagtaacacgtgctaattgttgttttgatgatattagtgaatcaaaaccttatgggaaatacaattgtctcatcttccaggtttctatgtgaaatactcagaactgcacttgcaaattcctgagcagcttcattctaagggaagcatggcgccatctagtgatcatacagaaaattacatttatgcattttctctcaaagctctgtattaaaatgatgagttggcccatacattagaattgaaagaagagaaatagaataaaaattcctagaaactttacctagttatttgctatatgcaccatcctgcatggtcattattaaacatatatgggttataacaataataatatgacattgtccctctcttggggtcacttttttaacttcaacttaccattggtttagtcatgtagtttccgaaataaatatcttcacatggaacatttaattccaatgaactatatttttggttcattaaaagttaatgaagtttttgaaacaattccaaatgatctgtaaaatatatttacttaaaaatgcttcattttatttctctagtgatgccctgctaggatgctacctaaattgttaaatatttaaaaacacagaggaaaaagtaagataaaataaatagcatactatttagagattaacctattccttaatatggaaaattattcctcattgtcagaataaaacatattattgtatttctagtttaaggataatattgtacagatatcaataggataagatatgcttgcctaagccggaatagatgcccactctgtcccagcagggtttttccagttttaccctgtggaaagttctatgaagacaaggaccatgtctgatgcatcttttcatctccatacgccactactcacccaaccctcgcccccaccagcacaatgcctagcatgtcataggaactcaggatgtttcttcaatgaaccaataaattaatttattatgtctgtctctaaaatcattatttagagtctatctaccacaggaaacagcttttcacttttctattgtatgattctctgctccttttctgagatactctctctacaagtggcaccttatttgatattcacactgccacctcctaaattctttaaaatcttgagtatccatgtccaaatggctttctttccatgagttatccatcttacagaaagggcattattcatcaacacatcatttgatgaaataaatccaaaagggtggaaatgagaaactcttatttcttactcttttcaataggtagtattaatattctgtaacaaggagatttcaatagtgtaacacataagatattactcacaatttgaaacaggtgcttttggcattataggcacttggccacaatgcatagtttaatatttgtgtggctcaaaacagctaacttatcttgaaatgttgcagaggaaacttccttaatcacattcttactgtccagtgactgaggtaaatcatggcatacatgcgtcattatgaatcacatactatctatacctacacttcaactacctgtaactagattttcactatacggtgtaatgagtttcagtgagaacattcagataacccattcctcaagtaaatattccaaaagcattttatttcactgtagagaaaatttagaaaaagtagatttctccttctctagtattgctgaattgtgattcaaatctataatacacagtaaacgtctcagaatactactacttttgaagtacaaagattgccacgatgtagaatagaatggctttttgtttttaaccaacatccccatcagtacattcaactcagccttgcaactcccactcataatgtcacaactgtttgtccctaagctaattaagtgtgtctgcgagctgtagcgtgagttatgaagttatcatttctccacactttatagctgtttgaaggatatgaaatggcaatggacaaacagtcatgatatttttggcaaaatatcaaatgtttttgatggaaagtgaaagggctttggagccctctgacctgggttcaaatcctaactcttctactttatagcctgagcaagttactgaacttaagtttctttatgtgaatgtggagatgctcttggacccaaagttctaattttggcacatacctatctttaaaaacaataataattttaaaagtaattttgaaatgtgttggtgaaaaacgtaggcttttttgaaaaagggtctctcactctgtcacccaggctggagtgcagtggcgcaatcctggcttactgtagtctcgacctcccaggctcaagagatcctcccacctcagcctcccaagtagcagggactacaggcacgtgccacaacacctggataatttttttgtattttcagtagagacagggtctcactatgttgccctggctgatctcaaaatcctgggctccaattatccttccacctcagccgcccaaagtgctgggattacaggcatgagccaccacactcaaccaaaaaatatagtgttaagagatcacactgtgacctataacatttatatatttagaacacctttggagctaactgagattagggatcaagatatatgtatatgtatatacacacacacacacacacacatttaataacacaagcatgcacttttgtgaaatagaatacgtaagttctaagcaaggagagtgcaaactgcatttatttttcaaaaacaagaaaaatacagtcataagaggttttaagtaactagttttaatcaatccatatggttgcatacttagagttttcttagaaatacattttacatttagcattgaccttggtatgtctaatattttctaggtatttttcacatatttctaagggctaaaaatatttattcatttatactttcattcagtcaatagatatttattaacagctttctcttatccaagcacatgtttgggaacagtcaacttttgttttatgatacagattaaaccaaagggacatattaatttgtgatcaactaataaaccaacagagagcttctaaaagctgaaggattttctaattttacagagcataaagaaccattttattcattttaaatctcaaactatgctgtgtttcataaggaaatcaaaggatatataaggtgtatacacttaggtacacatatatttttagatattttttaaattgatacataataattgtacgtagggatgtttcaatacatacaatgcatagtgatcagatcagggtattagcatatgttccaacatttttcatttctttgggactattcaatatcctctaagtatttgaaaatatataatatatcgttgttaactatagtcatactatagtgctatagaacactaccacttaattcctcctatctagctgtcatttcgtattcttaacaaatatttctctatcctccccttctccctactgtttccagcctctagtaatctctgttctcctttttacttccatgagatcaactttttctagcttacattttttgagtgagaaagcagtagaaaagaaaatgtggatggctttaaaaggaaaaaaagagaaaaaacagccctatctccaaatactccaatcttgtgaattgaaaaaaaaaagttgagatctttttttttaatcagttgctatctatttgtatatatacccacagaaaaccatagttaaaatgtaggcattataattctaagacatatgtacagaaaggcaaatgctggggggaacatattaaaatgtttctctgacattttgcagtcttacacagtgatttaatttatacgccatccatatattagtgatctggactctcttgatccaccaaaaagcaccctacttagcatttatctagtgttttctaagtagacgtttaaggctctttttaattaatcattttattaactcttgtcacactaatagagacagcaaccaacctgaaccatctagggcagatgagcaatggagatacacagaaagctaagttgcactgaaaataattttttgagaaagaacaacgggagctgtggagttctccaaatcataagttataaagctcagttaaattacttttttgtacaatgtagacagaaatgacaaaatggcagttctatatgcctgtaaaactcaaactgaccaaacactgacacttggtaacagcaggatgtgtactgatgttactataatgatgtttagcagaagagttgaaaatagaaagggtttccgaatcagcccagcaccaaccaagtaatccagggatccagatcattccaatacccagtgagttgtcccctttggcccctcctaggtgtgacccatccaagagaagcattgtatttccctagtctacattgttcccactttgacacagcctatcatatacttctctgtaagtttatgattatctcctccattaaatttttaattcttggggaccaaaaatctcatttctctttgtatgttcaagtgctattaagcacataagtactgaacaaatgctaaatcaacaaataaataatcccatgattacttaaaactgaggtgcctgcacaaatcagcaaggcactaaaatgataaactcatcctctaacaattgatcaaataccttaaactcagtctcaaaaagagtaaaaaaaaatgtcttggcttgctttcaagaaatgagcaatgttaaatcaaattcttgctagattattttcatggtaatagtttttcacaacttcttattgtaaaagtaacaacattatttcaaaatttaattaaggtataaataaatataaatacaaggagataaagaatatttataatcctattactcagagttggtttcatactttagcccatatacttaaaaatgtgtaaagaattacattatgtgtagttttgtgacaaatttcaatgctaatatctctatcattaaaaaaaatatggaagtaccacaatttagtctgttttagttttttgtttgtttttgagatgtagtctggctctgtcacccaggctggagtgcagtggcaccatttcggctcactgcaacctctacctctggggttcaagcacttctcctgcctcaggcgcctgagtagctgggattataggcacctgccacagtgcctggatatttctgtatttttagtagagatggagtttcaccatgttggtcaggctggtcttaaatttctgacctcaagtgatccgccttggcctcccaaagtgctgggattacaggtgtgagccaccgcacctggcctgttttaaacaccaaccctccctagtcctttactattatcaactcattgacggtcaaaatacataaaataatctttgcctacttcttgttacttgaggataaatgtctacaagaggcattgttatatgcatattttgacatggagtgttaccattgtaactgtacaaaatttacaatctctcaagtaatatatgtgtgcctgtttctttacccctttcctagactgagcattaccaatctttctatttctagtaaattgtcaaattaatctcagagaagacttagagacagtcttattcacttagtttattttctctcatgtggcaaaaggcaattataataaaagtcaacgtttacttttaactcatgatatgtattacacaatcggcctctcataataactcaatccttatttttataactctgcaatcaggaaggaacaataaaatttaattccaatattgctaaacctaggataattttgtagactagagtgtctaagtgtcatagtaacaatggctgaaagaaaagatgtttttccataccaactgaaatatatggattatcttggtacaacaaaactcttctaaatttattttattttattagttttggccacatgagaaacagcaagaaattccactgctagtcctccaaataggtaatcagatatatctgtggttatcttccctccataaacatttcctagtgattttgttaactataattctgtaatacaaaccctttgggtaatactcctatagacatcccacaatatatgcactccacacaaagagataaatgacagttatcttctgtaatcaagctcctgccaacttaaggtaagtaatgtatgagaaagataacctaatggcaaggctggcaagtcattctactatgtgtactaagctctttctcaacatcaagtaaccagacttaacaatgatttaaattactatatgaagactttcatggaataatgatttaatattttgacttataacaagactaagtataagaacatcactatttattcatgattaataatgtacatgtatgtaactcacataaaaatactattaaacatattattgctttactttacacaaagaccctaatgaaaagtcttataattaattatagaaagataattttctctcaagacataaatattatcaggtttctctatttgctgtatctttgaggaagctattaatattttaagacctaaacttaactccaagtacgaaatacacttttacatttgtgtttctaacttagctttacataggcattttatccatttttaaagttaggattgcttaattccttttttgaaacaaaaagcataaaaaatacataattaatggcattgcttttatacccaacttttattatctacaataaagatgtgatcatgtacaaataaccagatatgaagagccacaaacccacatatgcatttggaatttactcagaactatgtttgaaaatactcatgcactaacatttgtcccgttgtttccagattatcctgaagtttggtccaagacaaacttgttcagattttctgatttagatcacagctctatactctaggaaaacatggatacctacacctcagttaactgagtcttaaatggtgctagagatttcttattattaaggaaaggaaattattagttgatattttaaacatagaaacagaaaatatcattccagattaatcgattcaactctagatgaaaacaaatttatatattaaaacaaattaactgatccatatttaaaataagtaacagaaccgtgaagtgagtggaagtggctgtgagaaaagaactaaccaagtgaattttgagtacagaattaggcatataaaacataaataatgctaaaagtctacttactgaaatacttttctttgccttacttctctttttccatagaggcgtgagtgggtaattctgaaagtaatttttgaaaccacattccacaggtaagaaaatcctatgcaatatataatatattgtgaataatgggagccaggcttctcaccgtaacttctcacagagttacagatacgaaaatggagaagaacagaatgagcactgcaatgatggattatcattgtgaaatcctaggtttaatgtatacaaatatctgaatatacccatggatataggtatgtgtgggtatgcatatatatgcacacatttatatatgagtatgtacatacatacactttccccctagatatgtctactaaaaggacctagaagcaaaagcacacctactctccaaattttgatttctaaaaaccattctttactgaaaggaaacagagagccctataaaagtagctgattccaaggcttggataaaagaacaagagtctcatatctaaaaccaaaaagtaaaaaagtactcaaagaatgatagtaacgtgttaaaatgacaagggagtcaactagaagtaccttgtactgtccaaatccaggacagtatgaggattaagataaataatgatattaaccaacaatattaaaggataacaacctgctaaataaagaattcatgactccacacagaaacaagcacgaagaaacatttttatgcataatagaaagccaactaataaaagaggaagaaatgatgaaattacaagatttccccttagcaaaccactatggtttgaatatgtctcccaaagttcacatcttggaagcttagaccaaaacgcaacagtgttaagagttgggacatttaagagatgattagatcatgagagcattcccttcatgaatggattactttatctgttatcataggagtaggttccttataaaagaatgagtttgggccaggtgcggtggctaaggcctgtaatcccagcactttgggaggctaaggtgggtggctcacgaggtcagcagatggagaccgtcctggctaacacggtgaaaccccgtctctactaaacaaaatacaaaaaattagccgggcgtggtggtgggtgcctgtagtcccagctactcgggaaactgaggcaggagaatggcgaacccgggaggtggaggttgcagtgagccgaggcggagtcactgcactccagcctgggtgacagagcgagactctgtctcaaaaaaaaaaaaaaaaaaaatgagtttggcccccttctccctatttcttgcccatgtgatacctttcatcatgtcatgatgcagcaggaaaaaggactgcaccagatgcagccccttgatcctgaacttctcagcctccagaaccatgagccaaataaattctattcattataaattacccagtttgtggtatctgttacagcagcattaaaccaatgaaaacagcaaccatcataataacacaagtaactgatttagacaggaatcaccaacggattccaaagctattgggtaagaaattgaggaataacagcatatttacatgctctcatattatcatggtacaaaatgctttttaattacaaaggaggaaaatagtaactttacagtggagaaatctggtaggcaccacttgaactaaatgatcaaagctaaatttgtcagtaatggtactaaacaacagcatctacctctggatataaggagttagcatccctactgtgatattcctgcccaagttgtatgacctgactatcatccccaggaaacacaaaataaactcaaattgaaagatagtctatgctttagactgaatgtttacgttgcctccaaattcatatgttgaaacttaatcagcaatatgatggtatttacaggtgtggccttttggaagtgatgagattatggggacagagccctcatgaatgggattaatgcccttataaaagagaccccagagaactctctcttcctttctgccatgtaaaaacacagcaaggagacagctatttatgagctagaaagctgatcctcaccagacagaaaatctgcttagcacagatcatgggatttctcagccttcagaaccatgagaaataaatttctgttgtttataaaccatgaagactatggtagtttgttatagcagcccaaataaatcaagagagtgtacaaaacaattggcatgtaattctccaaaaatataaatgtcatgaaatagtctttcacgaagactcagaaactgctccagtttaaaggatattaaagagacatgacaactgattgaaaagcatgattttgtaatttcattggctacacagaacattattgggacaattattgaaatttagaataaagtctgtagattagataacaacattttatccatgttaatttgctaattttaaccactgaactgtacctatgtatgataattccatgtttttaggaattatttaagtatttagaagcaaaggagtatcatgtctgcaacttgctcttaatgtgtatcaataaggaaacgtgtgtatgggtagacggatacatagatgattagatagacagaaaggtagatatgagagacagagattgaataaagtaaatgtagtaaaatgttaacatttgggggatattggtgaggggtatctgggaattccttgtgctattcttgccactttacagtaaatctgaaattacatcaaattaaaaatcaaaatcaatataatatattaactttatggcttatagatatttaaagttagaattgtcaagtgacattctggtgaatgcttcaactagttataactattttccaaatattataaagcacactcagcataaaatcctgctttttgataccttacatatttcgaggacaactagatttttcagttatgtctttataaccacactgtacagaaagtaaatatatatcgagcagaaaatagctattcgtgacaaatctcacacctgagattaagagtctgctaaatcgttccattacattttggccttatgccctatatttttatcttcttttatcaaaatgtgatttcttcattgtaatttattagtagtttttagatatagacaacatatttaaatatatagtatcaccatcttttttgtttggtagaatcataccattttagtatgccataacagaattatatacatcaatatttttgtcattcagcctggcccacatgactctgagatgttctgaattggattgggctcatagaataaagtccaaactacttgccaagacccgatgccccatataatctggctttaggccaattttgcagatttctctttgaccgtaatcccataaattccctatgacatgcaaggctctctgtactacaaaccttttctatgctccttcatataaccatgaacttgaaaatgatgcctattcaactgtcaactcctaacgagctagtcaccctccaagacaaaactcaatgtcaagtcctgctttaaatcctccatccctccctgagcactgccctcccttctttcccaaaaggttattcttccttcttctgtctcctcatatcttttgctcatacttcaaacatttctgtcatattttaatgtattctacagtattatcttttccattagactgtcatgttttatcatttttttctgatcctctcccccacagagcatagaaaagtggctagcacaaatgcagctctcgataccatttttttgaataaatggataacaaaaaacaataaatatcacagaaaaatacaagaatttttgaattacaaaagagaatggtaattattagccactaggttgtacagagtaaccttcatgaaggaagtggtaactgatttgggcatgaagaatgagtaagatgtggagatagaaggcattgtaatagaaaataagaaacagaaagaaccaagatctaacagtctctgtgtggggccgtgaggatatgctgcagacctccaactataggaactataaccagcaaagggccccaactgatgcctctgaaattcactgcaacattttagctaaggccatacctcccatgccctgcttcctggtatttactgagcacagagggcatgttgtggcagacacattcctgggaaacaggattcctctgatggctgattttggcttgaggactcccatatgcctttggctagcccaatcaaggatgctctcaccaattctctctcccttctttactcagagtcaaacttggatcatgctttgacgtttccctcagccttaactggctccctccttatattcctctacaagggcatttcctaaaattcttgcatttctaatcccattttggcatgggcttcttgcaagactcagactaacacatagagtatagagtatgtatggagtaaatagggaattaaagctgatgaagcaaattgggactttgttactgagaacaacatgccaattcaatacattgtgccaaggcaggataaatctttattttctaatacgaacataactgtctatgtagtttttagatttcacaagtggcaaggaatttataacttccttttgagaactatttcatagtttaatcatctttcacagctcacgtaggtctttactaaatcctttgtgatttaagatcatttcttccagctcttctgtggtgatagattacagccaactttagacatactaaattaactacatcaactcttagtcataacaggaattccttctacaatattatgcacacatggtcttgcagggccatttgtcactttttctatttgatacaaaattatttctcattaataatctaatcatgaaacacctgtttgttaggcactgaaaaaattttccctgtttgaaagcagaaaaacaaagatttgtatgtttacttcagagaggattttgtgatttctaataggaagcaaacaattgtttttcttttctcaagtcttttaaactactctgccttctattgacagagtaagaaattaaatcttcaattatttaacatagcattttatctaattaaaaataacagattttttttttctgccaaagatttgaaacagagatggaaagcatgtgtgggaaattctgttacctttccagatctctgcttgaataaaataaaggcattttctgaccacgataagcacactgtctgatccagatcctccaagtatgcaaatcaacaggaaaagttccagcagcaagacttacccatctgcacagagtttcaaaaatggtgatgtacttacctaaaatagaaagagagatgacattagtgacattcatcgcagcttagacacatagtgaaaaacacattctagaaggcagttagagcatctgttcccctcaccattgccaagacccagttttaaggcttttgtttatgacacaacaggccagatggtggtgtctctcactgtccaagtttactctgagtacacttcataggtatttgttcaataaatactgaaaaagattataacaatcaactaagcaagaactatgatttaataacagcagcaaatttaacatctattgagggattacttgcctgccaagcccagtgcaatatgctttgcatattttcccatttactctttagatagtggacatgaggtaagtactattattatacctattgtaaagatgaagtaaatgagcttagggaagttcattaacttgcctaaagtcgctcacacaactagaaagtgttggagctgaagttttcacaggctctcagattctagagcccactttcatgatctttatgctatattgccaaaacccactgggaaataaagatatatatcattaccagtactttgttaaataatacattttaaaaatagaaatgatcacaattttagaatttgggaaaatgaacaatgcctagtacacagcagctgttcaataatatctgttgagtgaatgaaagaataagcaaagaaatgtcactgatatttaataaatatacacaggttatatctcaacacaacaaatatttacccacagagcactctactgtacagcttatttctttcttcctacagatgactatgtaccactattttaatctgctgattatttgaaggtgagaactaaatgctcttaagtgagaaagatgatggatcaatctagaccaaatgactggggagttaccaaggagaggatggaattgtcaaatcttcaaatggcatgttactcaacatataaaatccttctgtaattgaagaagcaattaacaaacaccatttaacagttcaactttcttcagccctttggttactcattttggtagaggttctcattagcaacaaaatattaaagaaagaagcagctaagagagaaatagaaacatgagactggctatttgaaagaatgctgtaattgaaaaacaagaaatactcagcacctcaaattcataaagagataatcatcaagttatctcatgttttgacattgataacatattccaatgaatcaatttttaaaataattataacaccctaaaagaaaattaccctctagtagaatgccacaaagatactcctcgagaagagcaactccaagacacataattttcagattcactaaagttgaaatgaaggaaaaaatgttaagggcagccagagagaaaggtcgggttacccacaaagggaagcccatcagactaacagctgatccctcggcagaaactctacaaaccagaagagagtgggggccaatattcaacattcttaaagaattttcaacccagaatttcatatccagccaaactaagtttcataagtgaaggagaaataaaatcctttacagacaagcaaatgctgagagattttgtcaccaccaggcctagaagagctcctgaaggaagtgctaaacatggaaaggaacaaccagtaccaaccactgcaaaaacatgccaaattgtaaagaccatcgatgctaggaagagactgcatcaactaatgagcaaaataaccagctaacatcataatgacaggatcaaattcacacataacaatattaaccttaaatgtaaatgggctaaatgctccaattaaaagatgctaactggcaaattggataaagagtcaagacccaccactgtgctgtattcaggagacccatctcacgtgcagagacacacacaggctcaaaataaagggaggaaggaagatctaccaagcacatggaaaacaaaaaaaaggtggggttgcaatcctagtctctgataaaacagactttaaaccaacaaagatcaaaagagacaaagaaggccattacgtaatggtaaagggatcaattcaacaagaagagctaactatcctaaatatatatgcacccaatacaggagcacccagattcataaagcaagcccttagagacttacaaagagacttagactcccacacaataataaagagagactgtaacaccccactgtcaacatcggatagatcaacgagacagaaagttaacaaggttatccaggaattgaactcagctctgcaccaagtggacctaatagacatctacagaactctccaccacaaatcaacagaatatacattcttctcaacatcacattgcacttattccaaaattgaccatatagttggaagtaaagcactcctcagcaaatgttaaagaacagaaattacaacagtctgtctctcagaccacagtgcaatcaaactagaattcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacatatttaaagcagtgtgtagagggaaatttatagcactaaattcccacaagagaaagcaggaaagatctaaaattgacaccctaacagcacaattaaaagaactagagaagcaagagcaaacgcattcaaaagctaacagaaggcaagaaataactaagatcagagcagaactgaaggagatagagacacaaaaaaacccttcaaaaaatcaatgaatccaggagctggtattttgaaaagatcaacaaaattgacggaccactagcaagactaataaagaagaaagggagaagaatcaaatagacgcaataaaaaatgataaaggtgatatcaccactgatcccacagaaatacaaactactatcagagaatactataaacacctctatgcaaataaactagaaaatctagaagaaatggatgaattcctggacacatacaccctcccaagactaaaccaggaagaagttgaatccctcaatagaccaataacaggctctgaaattgaggcaataattaatagcctaccaaccaaaaaaagtccaggaccagagggattcacagccgaattctaccagagatacaaaaaggagctggtaacattccttctgaaactattccaatcgatagaaaaagagggaatcctccctaactcattttataaggccagcattatcctgataccaaagcctggcagagacacaacaaaaaaagagaattttagaccaatatccctgatgaacattgatgcaaatatccttaataaaatactggcaaaccgaagccagcagcacatcaaaaagcttatccaccatgatcaagtgggcttcatccctgggatgcaaggctggttcaacatatgcaaatcaataaatgtaatccagcatataaacagaaccaaagacaaaagccacatgattctctcaatagatgcagaaaaggcgtttgacaaaattcaacaacccttcatgctaaaaactctcaataaactaggcattgatgggatgtatctcaaaataataagagctatttatgacaaacccacagccaatatcatactgaatgggcaaaagctagaagcattccctttgaaacctggcacaagacagggatgccctttctcaccactcctattcaacatagtattggaagttctggccagggcaatcaggcaggagaaagaaataaagggtattcaattaggaaaagaggaagtcaaattctccctgtttgcagatgacatgattgtatatttagaaaaccccatcgtctcagcccaaaatctccttaatctgataagcaacttcagcaaagtctcaggatacaaaatcaatgtgcaaaaatcacaagcattcctatacaccaataacagacaaacagccaaatccgaagtgaactccaattcacaattgcttcaaagagaataaaacacctaggaatccaacttacaagggatgtgaaggacctcttcaaggagaattacaaaccactgctcaatgaaataaaagaggacacaaacaaatggaagaacattccatgctcatagataggaagaatcaatatcatgaaaatggccacactgcccaaggtaatttatagattcagtgccatccccatcaagctaccaatgactttcttcacagaattggaaaaaaactactttaaagtttatgtggaaccaaaaaagagcccgcattgccaagacaatcctaagccaaaagaacaaagctggaggcatcacgctgcctgacttcaaactatactacaaggctacagtaaccaaaacagcatggtactggtaccaaaacagagatatagactaatggaacagaatagagccctcagaaataatactacacatcttcaaccatctgatctttgacaaacctgacaacaataagaaatggggaaaggattccctatttaataaattgtgctggaaatactggctagccacatgtagaaagctgaaactggatctcttccgtacaccttatacaaaaattaattcaagatggattaaaaacttaaatgttagacctaaaaccataaaaaccctacaagaaaacctaggcaataccattcaggacataggcacaggcaaggacttcatgactaaaacaccaaaagcaatggcaacaaaagccaaaattgacaaatgagatctaattaaactaaagagcttctgcacagcagaagaaactaccattggagtgaacaggcaacctacagaatgggagaaaatttttataatctacccatctgagaaagagctaatacacagaatctacaaataacttaaacaaatttacaagaaaaaatcaaacaaccacatcaaaaagtgggcaaaggatatgaacagacacttctcaaaagaagacatttatgcagccaacagacacatgaaaaaatgctcatcatcacttggccatcagagaaatgcaaatcaaaaccacaatgagatatcatctcacaccagttaaaatggcaatcattaaaaagtaaggaaacaacaggtgctagagaggatgtggagaaataggaacagttttacactgttggtgggactgtaaactagttcaaccattgtggaagacagtgtggcgattcctcaaggatcttgaactagaaatactatttgacccagccatcccattactgggtatatacccaaaggattataaatcatgctgctataagacacatgcacatgtatgtttattgcagcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaagctggaaaccatcattctgagcaaactattgcaaggacagaaaaccaaacactgcatgttctcaatcataggtgggaattgaacaatgagaacacttggacacagggtggggaacaccacacaccggggtctgtcatggagtggggggaggggggagggatagcattagtagatatacgtaatgtaaatgacaagttaacgggtgcagcacaccaacatggcacatgtatacatatgtaacgaaccttcacgttgtgctcacgtaccctagaacttaaagtataataaaaaaaaaaatgggaaaagagacagagccaaactattttaagatgatctagccatgatgtgcaaaaaataagcttaataatataataatgaaagttgtatgtaatactttcctttcattcaataaatattattttatataggaagttcattttataatacatgtcaagtcataggggtgagataggaaagaggcacatttatggccttcattattaagccatatgaggggtaagtttagaaacaaaacaacctgggcaaaatataaattggctataagtaggtcatagatatttacgtttcttgttaaaatatatgataggaagaattcataggtttcatcctctggctttagactgtgatattacctattcatgtgggaaaagttcttcttaatgtataggaaaaaaggttctgatacgtagaatatcctttgttccatttttgaattgatagtgcaattagttaagaaataagacataggaagacttgagaacctaggtattttacagagttttaaagagagagctcttggtcttcttgggagggtcttaaggatccgctttttattgttgtattctttgttcatgtaatttgtgctgcttgccttggtttgaccatggttctatagcaaagcagaattccaaggggattgggtgaaagaagaactcttaagttatggctggttttcccagaaccagtttcttaaatagcctctaaaatcttcatctttttccaaataaacattattagtaatctctttaagagtaaaccccatcacctcatattactctcacgtactgagcttttaatatacatcaagaagattaagcacacacctcaggtattaaaatgtgtttcctctgcaatctcattttatatcaaacatcagtatggttatctcatgttgtagagtattgctgaactagattctatgttggctgagctctaatttaagtttagatacagctcaagccctacatagaagcacatttaaatgcatcgctttagcttgtttctgtagcatttaaaggttctggcatcatggaaatgattttggaggtattctgagtgcctctgttgattttaccagacttgtgaccttaggcaaatggcttaatttctcttcctcacttttcattttgcaatgagaacatgaatattaaccatttacataattataaccaaagttatgaggctaaagtatgagaagagtgacagggacagacaagtattcaaataagaagttgtttgctaaggtctatttaatgtattatagtatgagcaagaaaagttttcagatttgtgcacattaattataatattaaagctgacagggttgagaatatttgctaatttaaaaattataaagttgttcatcagaatgatgtaaatatactctagaagaccctgaaattgtatatgttttcaagttttgaataaacaacataactgaaggaaaaaaatagtaaaaaatatataaataaaataaagaaagaaaattaccctctagtaattcaagtcccctttttcataagcggtgccagagtaaaataaaccaataaaacatgagagacttcactcaaatgtccagaatctttaccaaaaatagtcaacatgaaaagtctttatacctgcaatgttttccactgcttttctcagtattatttatagatctgagttatatattaaaagtggttattaaagctaagccaaaaagaaggaaggctgataaagttttaagcagttttgtttcaagatcaaactggacagatctgcaaagaaaatcacaactatttgcgaattttagtgaaacaaatggaacttttacagcaaattcaatgtttacccttaaagataactgaacttaatgactcaaaactttaattatgaggtagttacaaatgtatgtggttccattttgataaagacctgggagaggatccaaggagcaaagttatttgcaaaaaaagttaggcaagatttgatggagtgtacttgttgaatacgaatgactgaaaagtattttttaatctacttccttgtgatgataataaggttctgtttaacattagatctgtcagtgagcagataaaggaaagaatctaaataagattcactttcaataagctcggagtagtctatggattaggatttatacctccattctactgaatatgtggatcagttctaagagagaaaatattatgaaaataagacatcaaaggttgatgccttaagggctaaagaaatacaggcaactcagaaaatgaatagcatttgaatttatactcggggaggaaaaaaaggacttcaaagaacagtcatatttattcactagattaaggcagacatttttccagtacaaagtctgtgacacaattcttcacccctgtccaatcccagcctccattttcaaatatcttggccatgcagcagtttcttttcaaacgaaatgaaacaaaacaaaactttattattttattgaaattctagtcacttccttcacaaactcccaataactcagtgtatttattcctctataaagtaagtgcagatcagaagaatgagttatacaccaggttggccgtcttcgctgggaagatggttaggtcagcttgaagtgaagtcagtagttgtggtttactctatgtctatgtctggcactgcgcagtgagcctctgttcttaaaggaatcttattttaatcttcttgggaaggcaagacattcatacttgaaacaactattaaatgatgcaaaacaacttacaattaaatgtaaattacacggtggagacatcaaatgctacaggaattaaaagaaatgaagaaaagatgtttcagctgttgtgtgggattacagcaatatgttgtaactgggtgggagactattaagagactcctgatagggaatgtgcatccagtacatcttcttcttgaccacattcagagtcccgcatagagatttctggaagagcgtgggagctgcttcagaacaaagccaatgtcttgagaaggaccatggatctacggtgatgtttgaagagcaagattaaaatgtatactgtatccctatgaccatttgctcctacaaatcacaggttattaattgattataactagtaacacacataacagtctacttctaaaggacttttaccaaacattactattaataacttttgctgaaggatgttcattaattcacacagtaactactcataggtcagctctccaccaaggaggcacagagaggtgctcataatcatgaaactttcaaattgtattaaagtcgggaccccccaggaatacccatctgacttacacttatatctaatcaaggtcagccactttgaaatctccatggtctctaaccttttaggatcttttctttcaaaatttaatgagcagctcaaatccatatcttttatttatcatagaacccaaacatccgggcttcaataatgcttctgcatttttgaaaaaaaaaaaatatcgagtcaaggagcatttattccagtgtgagtcttctgccaactgctaccctactgacccacccctcatttacaagggccccttctttactcttagctcctcacagtatattacaattgcttccccaaggcaggaactgcaccttttattgccataatattataccaaatgtcatctctgtgcataacacgttatgtatgcaacatgtttgttgaaatagccgaattgtttcactagttatctgatagtttaactactcaggccaatggtcaagtcactcttgtctgggccctagcaactctctgcatgatgcatattggaccttgaagtcctttcaagatgaactacacagactggtgacatattcaaaaatggtgtgtatttgattttattctattttttttctttttgagacatggtctgtgtcgtccaggctgaagtgcagtggtacaaacacagttcgctgcagccttgacctcctgggctcaagtgatcctcctgcctcagccccccaagtagctgggactacagacatgagccaccacacctggctaattttttgttgttgtattttttgtagagatggggtttcaccacgttgctcaggctggtctcaaactcctgagctcaagtgatccacctgcctcagcctcccaaagtgctgagattacaggcatgagacactgctcttggctgatttaattattgttaaactgatttcaactcatattatctggctcaaagtcattcaactcgacatgtggaaatattatgttttgaatcattatgtgctaatacctttagttattgtcttctttttaaaatgagaaaataaaatatgatttacacatatataggaaagaagagtaagttaactttttaaaaagtcaacttttgttactatgaacttgctggtttacatgtattatgcattccatcctcccaacaaccctagaaggtaggggcatctgggaaatgaaaggctgaaagtaaataatatgagattatatagccaagaatggtaaagccaggattcaactcaggccatttttccagagtcttagtgtataactgccaatccctacttcattcataatttcatttaataaatgtccatcaaatgactactataattgggcacttattctagggatacatcaatgactacacatcctggcccacatggagcttacattctattgaagggagacagacaataagcaatatcttaatatacattatacagcatgaaaaaaagtgacaagtgctatgaaattcattgatgtggaaagagagggtaagaatggcgctagtggagaggaatgcatttgcaatggtaaataggatgttcagggaaggccttgttggaaaagtaagtacatctaagcaatgatctgagttatactttaacacatttatttgatgagaaaccagtaaaagttgagaatacaatagagcaaaaaactgcaggaaaatactgaagctcttggtttttataaggtatttattccagtctcatactttagtcaaacttgcacatgttttgtcacttgtattatttttttaagttccttgaccggaataactgtgcttcacacagctttaaatccttccatagtgcttagaagagtggctgtcacaacagaaagtatctgttgaaggaatgaaggactaatggaaagagatacacatatgagaagtaaaaaacagaaaaaagaccacatcaatagttacaatcactggtaagaaaaccccaaaatagatctagtctagaaaataaattcaaggaagagtactttctgatcatggtaatgaaactgagagaagatatttgggaatagaaagagagtagttttgctaatcttgaggatgagaaagttgaataagaaagccttcctgatggggagtaatttggggtgaatctaaattaaaggccacactgagcagactgaataaagttattcatccattgaatcagcatttactgtgagccacctaagtactaggcactagaggaaaattcattaatagatagtccctgaatttatgtgcttatattctacaagagacagctattaaataaaaaagttacataatcaattaattataattgtgttaaatgctataaaagaggcacatagagggccaaaggggcttaatctttctgggggtaccaggaaggagaacctgagacctgaagggcaagtgtgtgggggtgggagtggaataacaggaactttctatgttctatgtactacaggtattcaatgaatatctatcaagaattgttatgttcctgcactacatacaccaacacttaccatctcatttactcttcaaagcaaaccaatgaacaaagtttcactatgctcatttaacagaagagaaaattgaggctcagagagataaaatatcttgaccaaggtcacacaggttgtgagccaagattccagtccaaacctgttcaggattttcccatatcagtcaagtgtcaggcaacctgttaccaagatctctgctattctgatgagttgttattatgtacttgctaagaaacaacagcctaggtaggggctcagagttgattcaggtcagggcaggttgatatcagctagaataaccaatgaaaagccctgttgaattgtcccaatggatctagcccttggtcctacttgatgtaacaaactttcctgcctttatttactgattttatgcagtggacaaatactgaagctctatagacatcagtttcagcattgtgaacatgaaaatgaattatacatgctcctctctcaagcagtttagtctagtgaagattcagacccataaaataaatggagtttaatatggcaaatgttacaaaaatattacaaaaacagtatagaaagcattcatcccactataagaggctcctaattttgcctgaagtcttctaaaagaaactggactttggcttggaggttaaatggagccacaggatattaagcagagggatggagaaaagcattctctttagggacaagataaagtctgccatgtttttcaaacagcaaaatgttggttggctgagatgtatctgagtgtgttgaaggcgagggaaatggccctgttcccacttaagcagatcacatagtaatcatcttgaccccggactttctacattgcatggatatttgagaagttgactatgttgtggtttactttctggcatgagcgctttaaaactattacccaacatgaagggtcaagcagaaggaaagagatctgaagcaccaccacatacacccacattcaatcctattacagcaaactttacctgtaaactgacttgtttaaaaacattagaacactaaatgtaaaaagaatgacagcccacacatagtgcttagagatattttttctatttatttatttatttgaggttgaaagatagcaagaacatgaagaaatggaatttgcgtgacagtcccaaagcaaatctattcaaaagaaaaccataattacatatgcagctctcttgacagggatgacagcagtgaatcaacattctgcgctgaagacctaagtcaatatgcatttgattcaaaaaactaccttcattagcacagactatcattagtgatcacagatctatataaggctgaaaaacctaatctctgtgtctctgaaaactgcaaaaccaccttagcagttgcctaatttccctgagagtggaggtttcacttggccattgggctcaagaggccttaaagtgggcaattagcttgctggattatgcagtgtactttgtacctcttcattacattttccaccaggcttgagtcgaacagaagagcttacaatgtcaatgactttgaccatttgagattttgaagcagaatttcttaaccttttcatttctactgtttctcaattgatctacagctggggaaatgtaattctctcataattctgttaaaaaattatattaatagttccatggaacacacagaagcaggtatgttaaattatcaaattgaatttgagaggggagaaataagaatcagaaattatgtaaattaacaatttaacatactcaatgtggcaataaattatagcttcatagctggtggttataagtacgtcaacaattaaaagaaaaataataaaataaaaagagttagctctctggccacatcttccaaaattatataaaatagaatcatgacttattggatccccaaatcatttttaaattatagaatcagcttttcctgtgggggtcttctattaaaaagatggtattaagactgcaggaaattaagaatgcaggctttggagctagaaatgtctggttcaaacacaagcagacctgagtgtccaagaagtggtagctatatataattatgatggtggtggaggtaatggtgactgcagtgacctaaacaaaaaagaggaagatagaaatgatgatttggtgatcaaagatcaatggaacctttgtttatggacactgacttttgtcatttttctgataagtacttaagaaccaataatataaaatagggactattttacacctctttttcaacctgtagcaaaaaggtatttattttttcaaaatcttatcaaggtcagattgatgccaattaagtatcagtatatccctcatttcagtcaccatctactagttagatccaatttagatagtctacctcctaagagaatcttaatagcttcatttgcacaggaatgatagactattgatcagacagcctcaggcaggatccctttagtttgagtagatatatttaatctaatagtgcattgaaaatctaatagctggtctcctgggatccctggtcacaaattttaataccctgcacaatgaaattgcataaccattactgaactctatcctgttgccaactaggaatatctagaaaaccaataaaaggaagaacaaaacattcagaactgcagggctgtgtgattacagtctctattgtttctggtttaaagtgaaatcaattaattgcaaacacaattaaagtaactttgcagtagttggctaaatagaaaaacattttgtggtattattattttaccaacaacccaactttggcctatcatacctatgacacttttattttccttctataaatcatgccacaaaggttaaaaaattaaataacgacataggccttttattacaatcaaaatgggtaagaatgtgactttgcagagattaaataaaacagctatctcttcatgattcacatttattgaataccaaaaataatatgggagaaaaaaatcacgtagatttcacacctaataaatgaacaaagaaggagaataagtgtatagatatcttatataaatgtataggcatatttacttatctatttacatgtatttacatgctagatttccccaccaatgccatggacagaacctcaatccccttattacttccaaaatttacactgcctatccccaaacctcaccttctttggtcttatttatcaattaccaatatcaactcagtaaatgactggtccccttctccagttgcattcagatcacatgccaatcatatccactaaacatttatgaaattagcattctcctctcaatcccgtagaatcacaaagctagctcaagcctatgtgatgttttgcccaagccacagcaggagccaccttttacattcccagccttcaatcttgccacttacatatttattctccattcagcccctagaatctgatcttgtcacataattgcttggaatgcttcatggtttgaggatgaacccaaagtccttaacctggctcacaaggtccccagaacctaaaccttatttatctccaggctcatgtcttgtcactgaactactaaatcatcccttcatcacaaataccatgggattccttgcatcagtgtctctgttcctgctattcctctctccctgaaatgctcttcctattcctctctccaccctacattcattctttaagactcagtttaggtcacacttttcaccccagaaaaggttaggttctgctttttgccactcccataaaatcttctgcatagtgctaatcacggcactcactacacattttccctgataatctacgtaaatatttgcttcccctgctccaatttgaactactttaatctaaattccctgagaaaaggttattatttgtattatttatgttagtgtcttcagtatacctagaacatagtactgtagatacccatacaggttttgttaaatgagtgaatgagtgagtgagtgaatgaatgcttttctctagaacaattaatactgaaaagcaaatgtaagcacaatggagaaaatgccattccttagaattcaagaatgagtgtgagggataagcccaaggagtttcacaattatggaaagtcacactcagacagtgagaatagaagtgctggttgtggaaggtgaagactccaagaggagcaacacagaggtgaggagatggtaccagcaagacaagaaggctgtgtggtgcatagttgatgtgaatcttcttcacaacttctcaaagctttagtacagttcacacatgctatgtgttcttggatcccttgtgaaaaacagctcaattcctctacagctttgcatccagacctgaggcccagcagaaggtaaaaacatataagatggacacagagttctggaggcagagagtggcataaaggtgtcaggtgtggcactaacatagaggtcatggcaaaagttaatcacatttccaagggccaagaaagcactggtcaatagaaatatgacagaaaagaatgaagagggaagctaggtgaaagaggttttcatacatcaacagcaacatcacctggaaacaatttttgattagttaggcacttactaattattccctgcttttctttttttgagatgaagtctcactctgtcgcccaggctggagtgcaatggcacaatctgggctcactgcaagctccccctcccaggttcacgtcattctcctgcctcagcctctcaagcagctgggactacaggtgcccaccaccacacccggctaattttttgtattttttagtagagacggggtttcacaccatattagccaggatggtctcgatctcctgaccttgtgatctgcctgcctcggcctcccaaagtgctgggattacaggtgtgagccactgcgcctggccaattattccctacttttaaaataaattataatcgtgctgagagaataaaaaaattaaaggaaagagttcagtgagccgtgatcatgcaactgcactccagcctgctcaacagacaacaaacaaacaaagttatcattcaaaatgtttcccatggccagatgcagtagctcctacctctaatacctgtaatgcccgcactttgggaggccaaggcaggaagatggcttgagtccaggaatttgtgaccagcctgggcaacatggcgaaacctcatctctacaaaaaatacaaaaattagctgggtgttgtggcacatgcctgtaattccagctacttgagaggctgaggtgggaggatcacctgagccaggagaggtcaaggttgcagtgagccatgatggtgccactgcactccagcctgggcaacagagtgagaccctgtctcaaaaaaaaaaaaaaaaaaaaaaattagaccaaaaaacaaaaacccaaaaagccaaaatgcatccaagtatcataagtgaaaaagtgagcttcttagcagccaatatgcaaagggaacataatctcttacacagtttggaattactcagaaaacgtggaactgtcttcaatcctaaagcgtcacatagaaatgttccctgagtctcactgggacaacacactgagcaatagctttaccagaatgttttgtgaatatggtatgatatcaagagtaataaagttattttggaaaaaaataactttagaataatcacttaaaagtctgctgtttttgaccataattgcacatggatatattgccttatataaactacaaagaattgtctatttcacatcacattttacaacttacattgcaaacctcacttcagccttgaggtacaactatcaataaaagaaacaggtcttatttttaaaactttttattattcatatccttggtgactttcagacaataattaacatgtggttagtatcaccttaatggaggaagtaccttatacttcaaacaacccttaccaaaagaacagataatacatatgtattgatacagcattacaaattgatgataattcaaaaaggcaccatgtagcttgtacttgagaaggaattttccctttgcatattgaagggggttctggtggtgttttctttgtccccagccgacttcacaatgaaatgtttctactttgcaccctttgggttcagttgttcaaccagttacaattagttagattagtaactggttgaacaactgtaatcaaagagcacagattgacttgttgtggtctactagagagagatttgctagtggtgttcagcagggctctgtctgtcctcttcaatgtgtgcatgaatgacttgaagcaacatacatacattcaagaaaaattcattaaacattgaatcatcatctaatatttgcctgctattatgacaggtcctgagggaaccaagaaaatgtcagttacatggctctgatgcaaagctgggaagaaggagaaggagtcagaggtagaggcagagagagtaaaagaaagagggagaaagtgagaaagtgagacagagaaagagagggaggccatgttacacaacaggaaatgtaacacatgacctccagctcgaaaaatttgaataaaaagatatttcaaggagtgcgagggaggtaacccttacaattattagaatgaacatttactcattgtcaacactatggagcacatatttgggaattcacctttatttatgccacacaatattatgtaggtgacaagctaacccgtcgtatttaacaatataaacaaaaacacaaatatcctactttattaaactgaaagcagaggactctcatctccccaaagcccaggccattccctgatattagtaaggatactaggtgaaactccttctttcaacatttattgtaattagtgaaaacatgcttaatgggacaccatcatctacaatgatgacaccatatctcaaatcactaatctttctgccatggacagatttctgtatcaggggacacctttgtcattttgtcatccaaattttgaggattctttttcaattctccagcattgactgagaatttaaatggtgccagcattgtgctggaaactggataaaaactgagataacacacttgagttcctactctcagagaatccacttattggattgctttgctataattcctgaatccagtgagattaactggtattttctgttgttcaaaaaactacttttcccctttttgtacagatcagcaataaacatttacatcgagattgtgtggtgtccatgaacaaggcattcagtagggtccaagtctagacttgaatggcgtctctcacatttttgactaagagacaatgtagacataaaagtatcataatccaacttacatacaaaatggaaaaaatggaaccagaacaccttaaaatgtttcctttgaaatatgtgtgtgtttccatcaggtttattttagttctctaaaactctgtaatactgaatactccaactaccaatattagtcaaagctgtttaaaaccagccttcccttatttacaaaaggcagattttacaagacaactatcagggataaacacaaaaagaaatgaaaactgttccatgtctagcaattcgccagagtaaactggctgtatattgaacacagctgtttctgtgagggatttttctttttttggaatttaatattgactgtgctcttgtggcaagaatatagtaaatgaaagattgttccaggcctgagaagaagagaggccagaaacaattgttcccctaggtcctccccttccttaataaccaaactgttgtctggagcctccttgagttaaaagcctaccatttttcatgtcaattacacacaaacaggacttttcttgtcaccttccctaaactgaggaagacacaaacccagcaggaaggcaattgtaaagataaatttaaaagtaagaaggcaagcctgaaatgcaaacataggaaagagcctcttattccctacacttctcacttttcatggaccattgaaggctgtttcttaccaaattgaattctttgaaaagagaaaccatgacaattttccccaggctacggtaaatatattttcttgcacatttagtttttgtttcataacaatcctaataaaattagatgcttttagcaccttacttaaattaagaagacctttcctgctaatgtgcccagaacctatctgggttactaatattaatagttccattttatcatgtacttaactttgtgccaggaattgtacacagcaccctatacatgttatggtatttattcttcccaatagtttgagggaatcatgcttgacatagtaatccattgatcacttcttactttgatctctacttatcctcttgtaggatcaactatgcaaagtggtggattatagcacaatgttaaagggcagtgctctggagttagatggtctgtatttgaatcctagctgcaggaagttggggaaagtacaaaatgaagatagtagtgctaccaatctcaaaatataaattctggagattaaattaggtttaatatgattgtttggtccatctctagactagtaccttgaccactagtactctttcagagatttttttatgttttcaagaatgacaaaaacgaaattctatacacaccctgatatccccaaagacactagtgccctggggattggccatgtgggttactaggttccatttatttggttatggaggatgttcttcacccaagttaatcctttcacaaaagctcatttttgttctttttcctgcagcttccctcagaagaagctgtggccagtgaggatttcagggtcgcttgtccccaggtgatatgggagtttcagctcaggaagtgactaggttagatgtgggggcaaatcaagaccttttcagccactagcttaaggctaacccaccacagacctaccttcttgaacaacactgggaatttgggtaattaaatgctaggatatcagacatgatgtgattaaatcgaagggctgaaacaaatctgacattctgtgctcaaattataaggttagcaaataagaaaactagaaatatctctcttctaggcaagaatgagaacataagtctacccaaatgtgctctacagaggtttcaggtttagcatcttgcttaaggatgatgcttcatggtttagagagaaatgaattctagaatgtatcctttgcttataggacataacccatatttatagagatattttcaatatggtggagctagtggtagggtagaaagaacataaaattgactataaggaaatataaatccttttccgagctccttctccttatgcacacatatatacatatttgataaaataatggccctgaaaaaatattagagtggttttcttaaaacctaaagaaaatggtatccacatcagtgatgctcaattgctttttattatggacaatgaaaccaaattagattaatcataaggcaaaatttcaaatgaaaccagtaatacagacatagtgtctgtaaggttttatagcagaacatcagcaagatagcagaaacttaatgcatgaagtaacctctcaaccttgttaaagaatttcttttatatttcttgataaaatagtttttgttacagttagtaacattattttaaaaactgtacgtcttcttagctgtacacagaagtgagacatcactaaccagagatttcaatataaatatcttcaagtaaaaatgacatagtacatgttcagagatagcaaatggaaaaacagtggattgatttttataactcttcgtgaataaattctttaatgcaacaaacatttattgaattactgtttttcttggcactgaggggaataaaaaatgagaaaatacagtctctgcctttatggagctctcagtcttgtggaaactcatccacaagatggtcacatgcatatgttggtctagtcccaggccttaacaaactatggccctcaggccacatctagcccatagcctgtttttgaaataagattttttttaggtttttattttttttgtttttggttctggggtacatgcacgggatgcacaggtttgttacataggtagatgtgtgccacagtggttgctgaacctatcaacccatcacctaggtattaagaccagcatgcattagctacttttcctaatactttccctcactaaaccccactccctgacaggccccagtgtgtgttgttcccctccctgtgtccatgtgatctcattgttcagctcccatttataagtgagaacattcatccacgtccctgcaaaggacattatctcattcctttttatggctgcatggtatcccatggtgtgtatgtaccacattttcttcaaccagtctatcattgatgggcatttgggttgattccatgccttgctattgtgaatagtgctgtaatgaacatacctgtgtatgtatctttgtaacagaatgatttatattcctttgagtatatactcagtaatgtgattgttgggtcaaatcctatttctggttctagatctttgaggaatcgccatacagtcttccataatggttgaactaatttacattcccaccagcagtgtaaaagcgttcctacttctccacaacctcaccagcatctgttgtttcttgactatttaataatggccattctgactggtgtgagatggtatctcattgtggttttgatttgcatttctcaaatgatcagtgatgttgagcttttttttcatgtttgttggctgcatgaatgtcttcttttgagaagtgtctgttcatgtcctctcaaacaaaccccacagctagtagaagacaagatccagaacagaactgaaggagatagacatgaaaagccctttgaaaaatcaaggaatacaggagctgattttttgaaaaaattaatagatagactactagctagactaataaggaagaaagagagaagaatcaaacagacataataaaaaatgatcttccatgtaagacgcttatcacaatgtctaagggacagaaagctgggagtctatggagcttatgagaataggctttatgatagttgtggctccttggtaacaaaagcttgccagtcaacaaaattcagtccaaaatctgctttcattactacattagacatgatggcttagttgtgggagaggacacctatgtaccttatcctctttcaattaatgtagactatgatattcaccaaaaagactctgataaccatgaagggtcaaattagctatgtcaattcatgatgattaatttgaacataaattattaattttgataaagaggtattacctaagctttaattaatgaacgttccacttctacttaggacgtgaaagtcaccctgagtttatgtcaatagcattggctgaaaagtcttaatttctcatctggctttttttttttttttaatcgaggatatcccttcctccaacccaaatatattttcagcaacactcatgccaacccttatctgatgttgagaagctgtgaatttgatagcagaatcataacattttagacttaaaaagtgctttaaagatcatctacttcttctacccactcaactaatagttttatacttgaggaaacagagttgcatggaagtaaaggaactcgactaaaatgatcaagctagagactgaaccaggatcagagccctttcccctgcagccccgggaaaaagaattcatgttgaggaaataaggaaaagtgtttaatactttcagctaagcataaaattcctaagaactcttctctataaacagaaaatctaaactctccaaaagaatcgcacccccttagctgtaacaaagtctctgcagttatttcacagctgaaagccaactgacactgattcctgggtggtttcactaaaatagaattttctgaaatgcaaactcacctcccaaggaagaatatgaatttgaaagaggaaaggtgttagtggcgccaacaacttgctaccctgctgagaagcttccagatagccagaaacacagcagggagtagcaagaaacagaagttacagatgaagctgctctttagtcacaaacttgtttctgacagctcttgttgaaaaacctggggacagctgaacagaaacgttagtccagaggcagcctcagggctcaagtgctcaaggatctcatctcagtgtaaatattccaacttcctctcatccttctcctactgaggggaggaggagaccaaagggagtagacgatttgaaggcagttgctaaatgagaatcgctgggtggtatgcagaaaatagcatggttagcttagatcctacaaccagttttcaaaaataaaggaagtaataaccattagcataatgagaatacaaatcccaagtctccattactttagacagaactctgcaggagaccacctaaggaaaatctgggggaaaagaagtttccaatcaattgcagcagatttaactgattcccttctgtgggcacagcatggtattgagagctttggggattattagggaaagagaggacatgctttctttccttgagagattctgattctgggtgagacatggtgactatgtgcatctgaatatgctacaaggatataaacaattatacaacgaaccagaactatgctggctcagtgcccagggaagtcggaagaattcaagtcaggaccttgagtcagggatgaaacaggaatggttttatgaagaagtcaatttttcagctgagttttatacatgaaaggccatctcgtttagccgaaagtacaggaagggcctgtacttagcatgagaggcaggaaagcaagaaagcctttgtataaaatatggtgaaagaatcaacaaaagcttctgaagcctacatttatatacagaacttattctttatccaaaatgtaatgtggggattcatgaagatggcagaactccagtattctgcacattaataatgcaatgagcatgtctatggcactctaatcccttaaaatttcatttgtaaaataattatccttgttctcataacagggaaaataaaatcctaggctacagtaacaaaatatattatttaacttaatgtcaatgttaaaaataaaatagtaagaaacagtctgatattatatttcacagttatcaggattgtgattgtaaatcctataaatgtcatatcctgattaaccttttaggagaaaaatactccattggtgtagttctaacactgtttttgagatgaagcaaaatttctcatcaatatttctattctgactgtttggatatttaaaagtcatataacctaatttcaattatgttataaagaatagggttaaccaatagctaccacctgaggagcactgactgaaccaggcatacggtaggaattttacatggttttatatgtgatactaacaatagcctaataaggtaccataactccatgtacattttacagggaaaggaagatgtggaaagttgaatgaatgtgcccttgttcacaatgcaggcactccaaaccacagcatattaaccaatttgacaatcacctcttagagggttctctattgtcttctctaataggacctgcagaggaaaagatacaaattccattctgctttacctctgcagtaagtatggaaatgtatctcacattgtttcttattcatgtcttttcaatctgcctatgtcttcagagaattcttatcactacattgggaaaattttctgcaagctgacatatcacacttccagggaatttttgttgatataagaccattattttgtcccaagagttctcataattgcccttagtataatcccttaagtctctttccactgcagtatttatcttcttttaaaaataatagttaaataaaaattaacaatgtaaattagctaaaaaaattaaaaaaaataatatatccattcatttatctagccaggctgtaaatactcctctgttgcataatctttcaattctttcatcatactttcttctgctctcttcactcccttcaaattgtctgcatattttttatccactaggattgagtttctgtggttgaggctctgcctaaaagctagttgggaatcacaatcaaaatggattgttcatcatttactacaacctaactataacttcctagtttttgtctaatacaagatctgctctttatgccttcatcatttccaatgccaaattattccagcgatttttaattggtagcatattattaatacactatgcatcttcttttgtatattatgatatattacttcttgttgacatctcaaccagaaaaaaatggttgaggaaaatgcttataaaggttatataatgttcagatcttattcattagcaactctcatgaaattttctttggtaaggaaagggaaacagcccaatgacatttgtgcttatttgtggattttacttatccattcactctttcattagctctcatatttgactacaatttcctttgccaattacattataaaaatcaagtacatttccttcaggccttttcaaagttttccccagtgagttttaatttgacttctgatgcatggacctgctttgacaatatttaaatagaatatttatacaaactgatgcttcttttctactcgttttagagtatataaactgatatcagaaggctaaaataacatcaaacaaagttatcctagagcagtccataagtaaagaattataatcttcagctccatctctctctaccatattcattacctttccatagtctcataatatttttctaaccttatggtctaaatgatctcgttctgtctgtctatccatttgtctgtctctttctctccctctgcaaatcagataactacattatacaaatataagaataaaggttaatattattcatatatatatatatatatatatatatatatatatatttaagttgttttattctaagttctttatgttactcattaaaaccccaccattgttaccagggatttataacagatttattagtccactgaatttacccaacattgctaccagggatttataacagagttattagtctactgaatctattctgccaaaaaatgtgctgatacagattctgcccaatgagcataaagctatttttaaaaatataataattataataatatatctataatgtatatacgctatagggttaatagggtaagtttaatttgcaaaacaccaaacacaaaattaatttcataattactgaaactagaaggcaaaggttctgagcaggggcccaagatttatgtttcaggcataataacattggtggacaaggttgtcacatttcagagatgtggttatcatatctcacatttaaagttacaattattataatgaaataaataaggttgacaactgtttaaagaatttttgagtgaatagtccagtataaatgttttactataacactggaatatttaaagttacttatctaagaatttaaatttcaactgctttggcatggatatcatcattctgaggttagaacttctgtgacataagcaactattttaggaatttgacagcattaaaacaaagttaaatagtactgttcaaactggatgcaagaactcacaggaaaaaaaacaataagtgaacatttgagaagataggcaactttgctagcaattaggaaaaaataattaaaacaatagtgacagacatacctcatctgacaggcaaaaattttaaaaatctgatttaaggaaaatgtatgcgctgcagtcaataggctgaggcagacatcaggtccagcatgactcagcaagtttggagtgcaggtgcacaattctgcacattatgtaactacaccacgtaaggcgcattaggtgatcacccacatgagcttgtaactggctcagagccactattgtctgtaaaaggtataactaccggactgacactgtacctatggtttgcacctacggctcacactcagacagtaaaggcacgttgaaactgtgcatgattcctctagtgtttttccagctacccaccactcacccactgactcccctcagacctcagttagaacctgacaattggcatcacgaacaggatcccaaggtgggcgagcctttggtccctgctgattctgggttggcaatgtggccacgacatgggttgtggtacctggtcacagctgtgctgcaagggtgaactctgttggaaacctggccagcagtagatgggtaccccacgagcacggagaaagcactgaagcagctggaagtgcagagcaccgagaaggaatgagcctttgacagcagagttggatgggcattttttctgtgctacaagaagtacactcccaatccctgagggatgcagtgcaggaaagggccttttgggcacaggcagggtgcctggaggcccagctacacagcttagaaaaagagttagaggctgccatgaatggggatctccaggtgcaggtggggtgcctgaaggcctggcatagggttggaaagggagttagaggctgttgtgaatgcaggcctgggtccgtcatctcagccagagacccctgcttggtctgggtctgcactgtaaaaaaggggaagatgccccacctgcagagcctccccatcatggaagaaaagggggccccaacaagtgacccactcacagatgtggatagatttgactttggccagggttgactgagagaaaatcgataagcagcccaatgaagtactcttaactttgtggagataactgtctcaagagcagcaattccaggaaatgcagaaggggaaggaggacattgctgtatgacctggtcccactcaggtgcttcaactcaaagactacttgctgcagccaggtggaaatgttgagctttttctgtttgattagggaactggctgaggtgcctggcctggggggacaccagacaaatagaggccacatgtgaaattagcaatccactggtcctccaccaacatacagcaagtgctggcactggtaaacaccagcgctgatatattctgggggtggatgttttacatggcctgacagccatcccatctattacagatttgatggaccgcttgatgatggaatttggacagtgccactatgtggtggacttgattaatgcattttcaattaacattgctctagagagccaggaacagttcgccttcacgggaaggtgacagtggactttcatagtgttgctgcagggatatatgcatagccccatcatatgtcatggtcttattgataatattatgttaacctctgattctcttgcagatttagaagcggcaatgctcctcttgcctagaattaagatagtgtggctgagactgacttcctggcagctaaataggctattcagcaggcacaagccctatgggtagttgaccaagggtgctcatttgagttggatgtgcatgtgaccacagatggttttggctggggcctgtggcagagcatggagtgcttgagaacaccagtaggcttttggtcccaactatggaaagaagctgagctccagtattcactgatagagaagcagttagtaactgcatatgctgcccttcgggctcatgagagcatggcaggacaggctacagttgtcgtgtagacgagttacctgatagcaggatggatgtgttcattgataacaaccccccggactgggacagtgcagacatccactttagcaaagtggggcacctacttgaagcaacagagtacgctgagtacaagtcccttagcagcagagttgcaagaggtcttgagaccagcagtcctaatgcaagataaggccatggggcctaaggacatggggcctgaagcacccctacatgctgagccttcaccatttaaggaagggcatccccccctatgcccgatggggcacggtacacagatgggtctagctggggtgctgctactgcctggactgctcacagtccagcctagtactgactccatatggtttcataccgggtatggacaaagtagtcaatgggctgaagtcagagcaatatgaatggtgatcaccaaagaggtgacacatatgataatctgcaccaatagctgtgtggtctatcgaggcttaaccttgtggttaggcacctggaaaatacagaagtggctagttggccactggcccatgtggggctaggccatgtggcaagacctatgggaggaaggatgacctcctatgaccaggatggaaacggatggtaacctgttgttgcatgccccaatgcccctaaaggtagggaaataaaaacctggcttaatgcataaagtaaattcgggtaacatcatcatggggtgtttgcccgtcataacctggagttgttgctccttgtattactgctgtggcctctgggtctggggttccaccctgtgggcatgtttctccatttaaaagactccttcagcctagggagtagaatttaaggcctatgtgtcagacctgtgtgtccagggcctttgtccccagagtgtacgtataaggcctgtgtcttagacctgtgtgtccaaggcctgtgtctcctttggcattgagggtggagtgtaaggaaaatggatgtgctgctctcaaaaataggccgaagcagacatccggtccagcatgactcagtgagtttggagcacaggctcacaactctgcacattatgtaaccacgccacgtgaggcacattaggtgatcacccatgtaagcttgtgcttggcttggagccactattgtctgtaaaaggtacaactacgctgctgacgctgtacatacatcttgcgctcatggctcatggccagagagagagtaaatccatgttgaaactgtctacagttcctcacgtgtttttccagctacccgccacttgcccaccaactccccttggacctcagttagaacctgacatctgacaaaatcaaatgttacaacaatgtgataaacaggtaaccctcatacaccgattgccagacagtaaactagtatagccattgtggagaggaattgagcatcgtatagggaagttggtaatcctcttactttaagatccagcaattcaacctctggtcacggacctcaaagaaactctccaaatgagaacaagcaaacatgacaagaatattcacagtagtactcattcattcatttatttattcatttcacaaatatccattgagttcactgctgtatttgcttgggatatctctgggactgaaacaattctccgtcttcattggtatgttccaggacactgcttttgggtactgaaaagtttaaaatcaccttaaccaccaatgaggcaacaaagtagtgtgtaatcatataatgaagccatgtaactcaaactgtgtgcctactaagcacacaccagaaactccaggaaatcacgacagctgtacactctaattttggacttgtttttgcatcagttttctgaaagattgtcatggatgcaagcatgttattattagtcattgataaaagagcacagaaagaggatgtgaggagagcccttttttccttagggataaaaccctttcatcttggctttcatgaaacccattaccaggcaaaactgatgcgaattcctgactagaagaaaatgttctcctgcctttattctctctcagatgactcccattaattgatcccaggagattttctcattttgctgccttccctgcatccagccttcatttaccatgaccatcaggcatctgcagggccttgacctggaaaagctgccaccattcctagtagaggatgaacataaattctcactctcagaaatgcaaatatttcccttgctgtggggatgcataacttcagagaaaagctaagcatatggagcaccccatgtaaattaccatctcatacaacaactcactgtaaccttatctttatttcttataaatactgtttgtaaagaatataaaaaattgaattccacatgcaagataaaggcacagccacaatttcagaatgacatctaatatttctgaagtaataaaataaatgtaaccctgtggaaaaataaaacatttaaataaaatagttacaaatgcaataggaaactaagaaaaattattaggatagatccaatgttacattaaactgaggacagctcttcactgtgctggcttcattacgatatttaagaaatctgacagttgcaataattagaaacatttaagtttccattccagctagcacagacaagcccttgacaaaacaataatagtggcaagagccaacaatagagcacttactgtaaaacagcagacattgtcctaaacactatacatatatgtactcattcagtcctccaacaaccctacttttataatccccattttgcagatgagggaattgaggcaaattgtcagttacctttgctaaatcagcacgtctcaacttcagtgtacataaaaatcttctgaatatgctgtaaaattgcaaatgctctagccattcccataacccactctgattcagtactgttggtttggtatagactgcccacaatctagtgttacaatctccattttcgagaggtctgaggattgggcttggaaaacactgctccaattacactattcccagtgatattcccatttatcttcaatgcctctctgatgtttgggtcattgtttccatgtttctgaagattccattttgtttcatttcagagtaagaatacttatttcgatccaatgaatttgattacctattctatgtccatctaaagtttaatcaaaacaaactatactgatatgtttacaccttaattatgtcagcttgaaccaaagacataagactgttgaagaaaactcatttctcttttcacaaggaacctctagtaagctggtgaacaccttccttaatttttaaaacactctaaataggaaaatctctggaatctctcctaaacagacatttgcttaagtaaggattacaactcttgaaggcatacatgaaaaattcagaagtttctgaagaatgcttggccatatcatcattcaaacgcacataaagtaattttatcagcacaattttctttcttcagggccctcataaaaggaagattctttgactcctttgcagagctataaaccaagagtaacatccatactgtaagaacagaggctgttagaaagatctcgagattgtgctcaactaaaaaaaattcattttcttattttcacagtgatgaagaatgattttatacaatgaaagaaacaagtcattgttttcttcatccatggcaatattctccctgtctttcaagaaagattgaaaatgtctttcagattgtagtaatttgaaaagttgtaaaagattgtaaaatagaggcatatttatcagatttgggggaataaattttttttgaaaaagttctcagatccttttgaaaggagtttaaattgaagtacaataaaggtacctgctctcttctgttacaactaaagccagccactcttagaattaaaaaaaaaaaaagcctcttgtttctggtttcatataaggagacataagtggcttcaatgctgaacaggaggtaacactaaaggggtgaacttttgagtcaggccatgtaccaaaatgaatttctaccccaaaacaatgggactattctaaacatgagccattggtatgctggtaaatatttatcagttggctctccaggagaaaaaaaaaggcctgatttgtgcagtatgtccatttccatggtgtaactactatcagcatgtcttatttcaagctaccaatgtgatggccctgaatgtggagttgggaagagatttgtagctgcacctcattatatagtatttccacgacacagatacgatggactacataacctcaagagcatggataatagtaaaatataatgaagtacttgggaactaatgagttttgagtattgattacctttgcatttcatataatttatttaattacgggtttatataatttaataatgcctgtgctttccaaccaggtctcaaaatcattgaatacgtaacagttagtactcctgagctggtactactacctggctccaggctaccattgcatgtatctcaccttaagcaaaccttccacaatactgatccacttttatacacatgcattaatgaatgaaattacaatattatttaagtagaagttttatcccatgaatacaagctaaggctttattaatacaactcaatatctacatattttatagcataacactatacatttcagtgttaagagatattttagagatcatctgatccaacccttcctaagactagccatgacaactattggggatgccatctttattcattctcctattccaaaattccaaaattaccactttatgcaaaaagccacattcaattcaaactctgctatttctcaagaacatccataatttcactcaactggtatttttcccataaaattctcccaaccagcatccaacataccaaatcagtggtattctcactatcttctgtaaatgctatgtttattctcccttctgaagctgtttcttccactctgtcacacattcattcatttgcattttcaaggtgtgtatgtttgtgtgtgttttaagagaatggtagactatttacacacttgttaaaatgctcactttttttaagagatgggatcttgctctgttgcccaggctggagtgcagtggcatgattgtggcccgctgcagccttaaaatgctgggttcaagcaatcctcccacctcagtctcctgagtagccaggtatgtgctatcatgccaggctaattatgtagagagagggtcttgctatgctgcccaggcctgtcttgaactcctggactcaagtgatcttcctgccttagcttcccaaagtgttggtattataggtatgagccaaagtgtctggccctaaaatgcccatttcaactacagaataagagtacctgagcaagagcatctagaaatctgctttgtaaacaaggacccctcaggtaagggtaagatttctaaagtttcaagatcaactgatttagtgagtggtaactaaatgctaaggtgagaataagagagcatgaaacacaagatcaagtggtttaatggatataaacctgtaaacagttacaactctgtgttttaagtacaacaacatagtggtgttcaagaccatcattaaagacaaggaacactgaccagtgaagggaaactccttcacaaaagaggggagggctaagccaagtgctgaagaaagttctcttttgctggttctcaggggtcaaggcccagagtggctgaaaatgaaattacatagagtctaaacaagggccttagtatgtttagacttctctaagatagaatttccattatttgcttgataagaatcacttgggttctatacaaatgtagatttccaagcactgtcctcttgtattagaggttctcatttagtaggatggagaagagctcagaaacccagcagttttaaccttaaagaaactgttataggagcaagggccacagagaagtcttactaaaatataggggagtaacactttcagatttatgttttaaactaatatttataagtcttgtctatttttctcagtttagatcgagtttagcacctagtgaatcttatctgattgttatagcccaaactgacctcttcattttatacatcattaaacttggagtttgaattatacttttacttatttcctgtgtattattatttctcttctattgtcaaccctgaggaatagaaagtttgtctctctgtattcttcgtaatgcctgatgcaggcataagaacacagacacaaagtaaaattggttctatgaattctcagtacgtagccctagtttttaggcatgttaatctggaatacaattttaaaagctaacatttaatgagtgcttatgtgctagggactactggaagtaatttacttatattatctcatttcattcaatcaacaatattgtgaggtagatgctagtattgtctccattttacatataggaaaattggggcttaatcattttccaaggtaggctgggtccagatcatatgccctttattaccaagctacactgcttctccctaccctgccccctaaaaatgctgtttaaacaatgaatagataaaagaaagcaacaatgagattataatcagtagcaataatttttgaaataattaggtcagagtcctgcataaaagatgctactataaactataaagcaatccaaattattctaaatattcccaggctgaaatctgcatctgccagctatgcatcattgactcctacctatgctcttgattaaaaatctcctctgtgtcttcacattcccaatgggagtcgcatatcaggagaggcgcatccatgggtgcagcaagagtgacaatacatcacagcctcgacatctgtgacaagcccagccttttgacagtctagtgagggggtgtgcatcttgaatattaccagatgtgtcacaatctttgttccccaaatacttactcccttttggataacaaaacagcagaagacactactcagaacaattaaaaaggtttgaatattcccataccctataattaatcttcattcaatcacaagcatttctgttcaatctattgcttgaaatgaaatgctaataaggcaagaaagcacaactttaggacaatgccaaaaatggccttcgtttctcgtcttttgacataaataagatgcttttgatcatattaatgagtgagaaatgtgcaagtctctaatacaagattcagttaaattacattcatccttggagatgaacaacctgaatttaaaaggacaatttaggctgaataaaaagtcaaagcacagtgcaactaaaagtttattctaacttaatttaaagtattctagaacctttgcaaatcttcattgtcacacattttcacccttttcctccagtagtttttttcccaacttctgccatttctttaattctttccatgttcctatgatagttatatttattctggatttcctatgtctttaaaaattgttttaggtgctggttattatctataagaaatctaaagtgagtagaatgatctgtctcaagacattaaatagaccttgttggggtttattaattatttcttatagagttacaaacagtttagagggcttataggtgaaacctatcataagaaacaatgttatatgttgaacatttaagctccttgtataccaggacattactaggaatttcacttgaatctaactgggctcagtatactcctatataccaaaagcctttattgttgaaggtgcatagtaggaattcagtatatatacatggaataaacgtgtttgccctttttctgttgttgaatgcttttggaaattcaaggaatgaatgtgaatgctttctgatttttttacaattgcttcattattatatagtcatggttcagccttctttataaactaataatcttactaaatgctttcaacactgatcaggatgtgactcacctctgtgtcaaatacagaaggtactgaagtcacatcaaaaccaaagcaattttcatccctcatattcaggtctagtggaatagaacaggaaaagagaatctgcatataccttcaatgttcttgggtgacagaataccttaaaaaaacaagtatacaaggcgtttcctaggacagtcaaatgatgaaatatgggcttcaatctcctgggtcctctagttttctcatgaccagtatgtgaatataggcaaattacctgaataactcaacatgttttcttacccatataagaaaaggagagtaaatacctcatagaatgtggtaaaactaaatgagacattacatgcaaagcatttaacacagagcctagaacagagtaaatgctcaagaaatacggactattgttatatttctgggatttggataatttttactaatgtggataaatacagatgaggcgatcctacaatgagaaaaacagaagttgtgatgtgtgagacttttcatttacatacaaacggatatggaaaatggattatggatgcaatgtccctgataggaatggcaagggcctatttgggcattatactttattcctgaatcatagaagaaatcctatcaccaaaatacccatatgggttttcacattaaaaaatatttaaacactttctttagagatgcattctgagacccacgtaaggagttgtccaaactaatattgaatgcatttgacatgacagctgggtttgaaaaagtgctttcagcaaaagcagaagccactggttaacttttctccttgtagttaattacattaaacaattttatcccaaaaagggaaagagagattaaaatccaggttatggagcattcattgaggttttcttttcttttctttttccttctctccttccctcaggtagcagaaaatcatgagcttaaaaagaagctgacctggcaatgtttcccagacttcttttattcttgacttggaaaaaggaaaaattgagggattgagggatggtgattttacttggtccttctaggacctatttgaagactcttctagagtcaggtgttggttgaggttcacagctaattaatcactggaaacctggagagaatagcctgaggtattacaataacctaggtatgaaggtttctacaccccaaatggccaaattgctggctacttctgggattatctggacacctgaatcctaaagaatatgaagtcccaggatcacttcctcaagatgtcaaattactctgatagagaaagataatttttatcttatttattttttcctttccaacctttattttaggtttagagggaacataagcagctttattacatgactaagttgcattttgtaggggtgtacagatcattttgtcacccaggtaatgggcatagcacatgataggtagttttttgagaaagatgattttcaagcaagactggaaacagaacaggtagcagttagaaaatacatgtttttgtttatttatacttaattatgcataaataaaagtgtaaattatgaagtcacgatgccagtaaatgcttttattggcttgtccacagatgtcctcccttctctaaccccctttctcccaaagtgggtgtgagtgcaccaccaggtggtgacataatgaaatgacacatagggcatataatgtcaggctgaggagaattttggaggttccaaggattgctggaaataactgcacaaacatggctctattactagagcttttgtgtacttgaggttttatttttgtttttgctgaagcccaatacaaatatataacaacattaaattgccatttatgactagaattttaaaacctaagtcaaacatactttcattgaacctggctctgcttttcatttattttgtcacacagggcaagttatgtaatatttttgaacctcacttcttcatccataaaattcaggataataatggctgccatgaaatagtttaattggaccttaagactgactatctctccaagattctttcctcttctccctccattccccaccatctccattgtctactttgttccttggctttacctttccttctggtttgcccgggggggataaatacccacttgtacatcacctcctcaggcagcgctgctcagcccatacctccgtgctcatgccaggactcatatagcctttagcctttgcattctccacactgtttagtgtcacttgtttccctgagttttgctcactgctgggcctgtagcactgggtccatatttctatgcatcttattaacctaggcattacacccaagatataaacacattgtagatattcagtgactttttgttgaatatttttaaagtataacaaaaagcctttgaaataccaagcaaaaaagagtacgtaaaagagcaagaggactttctgaaggagtatattcattgcccaaaaaaggagatctatcccttgagagagaactgtaaatctcttctactcagcttgcaaatacaactattaagatcaatggaatgcactgcatataaagttgatttatagccctggttctttgtaaatgttaatagtaaacctaatttgaaatgttatttaaaaagaagctaccatttcagtctaaagcatttactttaaatcattaaaaattactttgtgttccttctcattgggatctcttggacttaggaaacaatttgaaatcctaagggctttatttaattaaacaaactccataaacattaaagttagttgttttttttcatataaataacagataaggtccctaaaagattgattggaataaagaagacattgatttgaatcagtctctaaacaattatgtgactttggccaaattagtaaacttctgagtctcaatttccccatgaaatggttaagaccaccctaaggactgctatgagggttgaattattaatgcccacaccactgtgtctggcactgagaagggttagctctcttctttcatttcatccacacctactcttcaacatatacatttctctaaagtcaatgtgtttaattttttttaagttcaatgctaacaaatattaaatgcttcttttcccaacactataattttaacaaatgagtttcaggcatatttaaaaatgagtttcaggcattagatcatgtgaacataactaattatgtgaaacatttttgtccaacttctacataaatcatagcttcaaattatatggtcataagcctacaagatactcattgctatgcactgaattatgtccccttcaaaattcacttgtggaagccctaaccctttatgtaatagtattcggagatgggtcttttgggaggtgatgagatcatgagggtggggcctgcaatgatgggattggtgctcttataagaaaagacaccagagagcttgctctttctccaccatgtcagaaggcactgactgcaagccaggaagagggcccccaatagaacctaaacatgctggcaccctaatttcagaactttcagcctccagaattgtgagaaaattaatctgttgttgtgtaagttatccagattatagtattttgttgtagcagctggagctgactaaaaccctcatgtgccaacgtaatatcgttttagttataaatttaatattgatacaactttagctaaaggaataaaatctgtatgagaaacaatataacttttcaacagtatgaagatatagttcttcttattcataaacacacatatacacttgcatacatatatgtaaactatattttgaatatagaagatcaactatatagaagatcaactatatagccatctagtttaactcattgatcatttaattcaacagagttgagcgcctgctatgtgccaggcaatgcactaagcaccgatatacaaagataagggagatacattcttatcttaattgagcccacagcccaatagaggagaaagtcaaaacatacgatatataataaggtatgataaatgctccagattataactaacataatattaaaagttgttctcatactgtagaacggttcttccctaaaactgtatcaactccacctaaattaatccaacaatagcctcctgacatttttacttagagagactaatttagcaggcatctaaggcagaataaagtgtttacctcaacttttctatcaacaatgttagaagtggaaaatacaacataatttttgagtctcagctcctgtcaatttaaatgaaaatagacagttggttcagcatatgttgatttcttaaaatcagaaatagattttcccagcaatacgcctcagggaaaataaaatgtgtgggctggtttatccacgcattaaaagcaagcttccagctgatgtttgattacattcatgaagaaaaaaatattgtaatgagaacatccaattactctttccacaggagtaaaaatttctggtctgagaatttgtttcaaatcagtggttagaacataaacaaacaaataaaaaaggggaaataagtgagaatgagatcctcagaacagctactaaatttgagtaggcagagcatggtttctggagtccaaaagcctgtttaaagtcctgactctaatgtctactggtaaggtgctggtgggcaggtttcttaccctctgtgagcatgttcttttactcagcagtaacatggaaccaaataagacccattgatagagttgctcaaaagttcaagagaataatttgaattctctttctctcaatgcatgccatgtgtctgacctatgacaggctctcaatacttggtagacaataggaattattattattggaaggaagagaaataagaaggaacagcaacttgaaagactactattggcttcattgaaataggatctttgcattttgccttctttatctttgcatcttgtcttctttttactttctcttcacacacgtgacctaataataatagcatctgtagtaactgttgtgttatcatacagtagcacccagttttgtaggtcttattttacttaatttgtagtcagtaaacatattatccccatttgatagatgaggaaattgaggcttagacacgttaaatgtctttcccaggtcacacagtttggaagagatgacattaagacttgagctctgatctatcccgactctaaagttcatggtaatatgaacataatataaaagggaacatagtataatacaaaagaacataaaaataatacaacttatacaatgttaactttcaattcagccctccaatgtaatctgaaagatctttggtttgatttaaaaatcaagtcaaatctttgtatggcatttctcctgggaggctcaaacaagtaaacattctaccctgacgttgttctttccttttctctcctttcaagttattcaaatgctcagtaataagcagctttcaactgaatatggtggggcaaagccagctgctctttctccatgtggtagctcagatggacacctcactcttggtgttactgtgtagctgtactcccttaatagcctggccagctgtcttacataaacaattattcatgattttaaattattaataatttagaaggaaaacagatttcctgtgactatatggcacaatatagtacataaaattgggtttgaatatttgttttctgcacatcctctatagttataaaatgtaactaatgatttgtgtttaatttgtctctcaatccaattttggtagagcaagatttaaaataaatggctgtagatttcctaatttgatcagggactctcagttgttacaagtacatatgttatttcatataaatgtgaaaaaaatattttatgtttttatatgagatccacttcttatgcttataatattatggctcccagatgttattaatgtgaaagtgtttagagaatttcctctgaaaatgtcatcctatccctacacaacccaagattattgcaatagtttcacaaatgtcatggtttataaccttacatttatgaagaaactgttgacatcctatctttagagaatgagaaagaaagaggaatcattctgaacagaataattccaggaagcatcttggcctgacacataggcctgcctagactcggtagattttactaatatgtctttccaattcatttgttgactatatttagctttataaagttaaaggtgagagagcctcaatgtttaatatagcatctactccaatggttctgaaacactaaatcttctccttgagaaagtttgcaccagaccaacagaaagtttcgtatatttgtgattaagctacatttatcaaattagaagcacgattcattattctgacatgatctttaccatttttaaaatttataatagccatgattttatcaaaggataaatgcagagtataggatattttcaaaaatgagctcacctggcaaactaaaagtaggcagtgtaagtcgccacattccaaaaatcaatatttaaaattgcaaattccagaaacagatgaggtctgtagttttactagtggaaccactaatacagtgacttgagtatttttttttcacttagtatattttaactatcttcatactaagaaaatacctacgaaagtaagtctagaaaacccaatatcagcctgtcaatatttatattattcagagggatgtatatacatcttaatcttttgttgtattcctatataattctagctatatttaattctagttacaaattaattaaaaataccactcttaacttttctgggcatggggttgtaaccatgaaaccaacttcttatgccttctgaaaccaagtcaaaagtcagacaccttaaaaatgcagtcttttgtacacaaatgtacaaaatagccccagaatagaaacctaattgtgagtccttagataactaggactagaaatccttcatcgctacactcctggtgcttaggacaacagtgacaggtaaaggcactcaacagactatggaatgagcagattctaagagtcaatacttagggtgaaccttgctctatcacaatacttctcaatctaaatgatactgcagacctagtaatataatttgttccaagccggaaaacttcaggaatgtgcaagctggaatggggaagaaagaagtcaaatcctttatcactgagaagagaaaccaagggagaagcaggtatggagttccgatacgtgcaaagcttcgtagatactaaactggggacaaccaggttaaagtgaaataacattacagctatgtacaaaacatgtttctgcttccaaaccagggtaattaaaaaattagaatgcagttatttattttattagtattagctattagttgagatcaatttttaaactttaaaatgcagtcactttaattacaaacttttactttcagactcacatatgcacggaatagtggagagtagagacatttattatttaaactagctctgacaatgagattcatttaacaagctatttcagatcaaaacagaattggggactatcaatcagtttcctcattctcccctttcatttttggatcagctataaatagtcacaaaatgtgtccatttggcatcttctgtggcttccagggtttaatttcaacactccttgatatcacagaatcactttaaagaacagagaggttgcagatcaattattgtagtcatgtgccatatagactttgtgtgactaaccccagactatttgtctattttaataaaaggaggtcatgattgtgcagaaagtgaaaaactttttattaatctgaatttagcatatttatggtattatacccctaacataatagtatacaggtaatatcatctgatattttgtttgaaaacccttatgttatattgctttttatatctcaccaactaattgcttttctaatcccaccaaatttagtggtgtccacttaactataagactgtggctgacactgctgattgtatatacgatatccattctccctttcattcttatttatataagcctaatgttaatcacccaataatatgtctagttaaaaaaaacaagctcctcagcttccctggaaggtaggggcaagtatatgaaattgttcttgccaaagaacaggttgtcagagaggggcaaggtagctgggtttatataagctgaggattcctaagaaatccttgtttccctgatacagacaccatcccttcctacttcctttccatttctcttctttaccctggaatgaggagatagtgccgtgggagcagtatcgccaatggtcgtgagatgacaagcacaggacaggcccatatgctgaggatggctggcacagaagaaagaataaaaggaaatcacatatttgagggtatcatagaatcactgtactagccctagtttgctacctcctgatatccttttccacaagaccaacaaacccttagatgattcaaccattgttagttttctattgcttatagctgaatgcattttaaactgacaaaaaaagactttctaatgattttgcaataaagactttttagcacacctgccatacttttaaaacatggccattttgaaggagctggtgccagactacaatatttcaagcaaccgccttcttcctaagtttattacattgacacacattaatttaggttttgttggagttaatgtttccttcagtcatttctttgcttacaaaatactttttaaagtaaatatacacaaattatctaccttagaaaatgcaaaaaagcagatatttgtaagtcatctaagtcagctcttgcttcccttcctaaactattcattaatttggtgtaaagtgcattataactgaatgttgttcttgtatttcatggacaccagttgtcatgctaatgtgcacaaaaggttttttccagagtgaatgcatcaagtaaatcccaatcattgccactgcaaatgctgacagactaaacaaaattgctgacatcttccaaaatctgtctagatagatcactgctgcgcaaacatcattgcagttcctaatgaaaaagcaaataattcccatttgacatttatcttaatttcaaaataattattatttaatcatatctaaccatttcctatagttctcttgtaattcattgtacatagtgtgaatttcaataaaattcactttcctcttcctctgttttacctaaggattaaaaatgaagcaagctaacctgtccttctctgaaaacctgtacattaatctatgcttacaccttttgtaaaaagctatattttattattttattgttaaattgcactgtgaatttcaaatgtcaggagacattcacacacacacacacacacacacacacacacactcactcacgcacagagagaaaggaagagaaaacaaagagacagaatttcctccctaccaaaggggctttgttttgatcagcaagtttttttttggctcattgaactaaattcacaaattaacaaaactccactatgaagatctgatggaagaaggaatggaaaactcttgaccttttggatcccagtcccctgaccggcccttttcatcttcccttattaaatggaaatgatcagtatgagctttcagatttaggcaagacagctaaaagcaaaatcttgccttctgaaaaagatggtaaaggaaaaattggagctaattaaataatgaaatctgtttaaatgaacctatttatgccaatgaaataggcagaatcattcattatgtaaatatgacctttaaggacatatcacaagtaagttgtgaataataaccccatgaataattgagaattgatggtatttaatatttattaagtgactttcacatggatttgagttaagtaagtcaattccatgggcccagtgatggtatccatttaatgatttattcagcctctaaatatgatagtaatgttctgtatgacagtgagctagaaattgcacaatggagaattcaaaatgaataagacactgtccttgtttgcaaagttttcatgtggcaaatcccttaaggagaaaataacacttatttacaggatgaaaaggtcagctccacatagttgatcagcatttagagtttgaaataataattgggtgaggtcttgagggatggatttttattggtggtgatattaaaaagagagaatttcaagtatatggaaggtcaaaatccaagggcaatgaaagttcagaaaagtaatccttttgagctgggatacatgcaaaacgtgagataaaatcctggacagatataggataaaaccatgactttaaagggctcactgaagagtttagattattttgagaagtcagtcatggagacagaacaaatggatgagatgtagtataataagttccagtgtctcccataccccaataaggatgtacatgaattataatctaacaaaagagaaggaagcttggaaagtgttaggattctatttctttctgctttttctacttatgattacatggattagaatgttatctgctgtgctgaaacagagttgaaatgttactttaagtaatctggtaagtatgttattaaaatgactattttaccaagattcaaaaaattgaaatgtcaacatatgcctaatcatcaatgttgtttttgtgaatggtaatagcatccatattaccatcttttccttcctctttcttcccttcttcttcacagtctttaatttcttaattatttaacctttgtggatgagtattaagcatataagttagaaaataccaattttattactttttaaatgctgaaataattatttttaatgagagtattattgacaaccacttcttgttattactgaaagagtaaacttgagttttgaaccaatgggttaaggattaaatctgcattaatctaaatagggaattttaaggaattttttattccagagtctatggtatcataaacttctatttaatgaaatagattatcagaatcacctttcaatttcatggtctgatgtaaaaaaaattctccctgaaacagatacagggctataatcctcagattacacgcacacccaaacacacatacacaggtttgtatatatttgccacctccaacccaggtactggttttatttaaagcattcattttttttttcttaaactatgctcaaaccatggttgacagtttaagaaaagaaccaataggataaaatagtgtattctattcacagcaacagactgaaatagactcaatatctgatgttgaactttccaaatatatacagaaaattacatataagttataactcacacaactcttctatctccttattctatttgtcctaagaatttacaatagaatgaagttccttcaagtaagagacattacagtgctgcattgctgagacaagcctataaagaaaaggaagacggtttgattttgtctactgtggtctccttgtagccctggaatgtgaaaatgtacaaaataatctaatatctcataaacaaagtaaagtgggtttttttggccagatattttctagatagatatgagagaactgtcaagaagcaaaagatattaagataactccatgtattaaatcatttcgatttcattggatatgtcatggacttaaaaaaaattctcttttccttttgtaaagaaaagtcacagttaaaaaacacagaaagaaaagagtttggaaatgtgtgagggagagatgaaaaaagctctctacaactggttcagagattaacctgagtgagtccagtcacgtgcaaaggcttgcggaggtctagactgcaatgtctgtaattgaattttaaactggctttacatattcccagagagagcatataccatgatgtgctcatgaatgcaagccttaataggaattacatactttcacaagcactgtgcttataaaaccccttgaaccctattaatcctatattgaggttttatgtttcttctactcagaaaaatatcagatttatctattgcccataggatatttgttttaaagtgatacacttcagttgggcctgtctcctgaagaagttttgtataaaaattattcacttgaatgccaatggaatagttgagtacagaatcccattaatgtatcatagagtgatattgcagttatgaaacataaatcttaaagctgtgaatctctgcatataaacagattgggagtttagacttgagatgtatataaaggaatgattactaatgtcaaagaatgtaatttgaggaaatattttgttttctattaattgtattcaggcaatctgcagcccaaagtttgagttctaaattattcaccaactgccttgaagtaccatcaaacaaattctaagatgtgacacttgagggggatccttctgcctcaattttttaagtcagtggaataggactcttcaatatatcaaactctgaaattaaacaagctttacaaaataagaaagtgagaatggtacattttataaataacactgagattacatatcttgcgttattcaccaaaatatattttagatggaatagatttagtttttctaaatataaaaagcaagcatgctaagcaaaatatctatcacagaaacaaaacttttttttttcgagacagaatctcgcttcatggcccaggctggagtgcagtggcccgatctcagctcactgaaacctccacctccctggttcaagtgattctcctgcctcagcctcctgagtaactgagattacaggcatgtaccaccacacccagataatttttaaatatttttagtacagacgggatttcaccatgttggtcaggctgatcttgaactcctcgtctcaaatgatccatctgcctcggcctcccaaagttctaggattacaggtgtgagccaccccatgcctggccaaaacaaaacttctttacaataaaaatttaaaaaacaaaaaacaaaagactagaaatagttgcttaaaataaagagtcaaatttatgtgacaaaaagaaataaaatacatgtataacattgtgcacatgtaccctaaaacttaaagtataataataataaattaattaattaaaaaaaaagaaaacaaaccaacagataaacattgattcatcaggtagatattgaaagattccagcagagagttcaagcaaatggaaatataaagggtaaacaaacaaatggaaaataatattgagatagtattttataccatctaaagacaaaacatgttaagaaaattatgatattcaatacagctaaaataacagaatattctggggcactgtaacttgatataaattcctttgaaaataattcttacaattggccgggtgcagtggcacactcttataatcccagcactttgggaggctgaggcgggtggatcacctgaggtcaggagtttgagaccagcctgaccaacatggcgaaacactgtctctactaaaaattcaaaaactagccgggcatggtggtgcacacctgtaatcctaggtactcggaaggctgaggcacgagaattgcttgaacccgggaggcagaggttgcagtgagccgagatcatgccactgcactccagcctgggtgataaagtgagattttgtctcaaaaaaaaaagaaaaagaaaaaaaggaaatgattgacaaaatataggagaaatcatgaaagaagcaatcagttccacagaggttaaaaggtatgtgcaataaagatgttcacagcagcattaactataccagtaaacacctggaaacattccaaatatctaacatttgaagaataattatttcaaaggtaggattataacggttttaaaattttcttctttgcaatttttggaggcagtcttcaaacatttaatacaaaagtattactttggtaatcagaaaattacctgttaacaaatatttaaaaataatatgtgcataatataatatgaaaaatgaatataaatgtattaggttacagatgtttttcacagcaatgagaaattactaaggaaacgacttaatactgttatactctttgaaattctctttggtaattctgcatttacataataacatttaattaattatagcactattgtctaattgagtacaatgactttgatgacataacataaagcctaggcttttaaagtcgcattcctggaagtgagggcatttggaataatctttttttaaaaatgttaaaatgttattttatgactattcttggttttgtatagtttctgatatattacaaaatgcctttcggtatgtattaaattccctagctttgtttatagtagggtaattcatgcgtattggacaggcccctgaaatttttgcctagaaatcagccatgaaatttgaaagaaaaaaattgtgacctgggcaagttccttaatcttactatcattttcaatatttgtataaagaaagagttgacatacataatttcttagcaatctaataggccacggtattgtgaaaaacaactttacaaatgtaagaaattaataacataatatttcattaatcttaaattctcacagtacagtaaaacatattgttagtcttatctataaaatttcaaatgtccacatgaaaattaaaaacaagcccatttagattttgcaaagatctgaatgtttaatattatttttatatattgctattgacccaatgtttaaatcattagctggatttttaccattttcatgagtataaatgaatgtgtatatatgtgcatatatgaatccatatagttatgcacattcacatacatactatatataatcaacataacatatagaatcaaaatattatttgtcttttgacttcccggttttacaaaggcagcattagacaaagctatatttctcaaaacacatttgtttttcaagaaaaaatatgcagagccctatttttctatcagttcgtattatacattaaagatttattatgcacttgctactgatgttaaaatactttaaaattcagtgagcaagagatactgtttctatggcatattttgcttcaaatatccacatgcataaacatgaatagattgtgggacaattattatttaaataaatgtctcaattttttatagacaggctaagtgatacatgcaatgctcagtaatacacgcaatgctgagcaacacatgcaacagcatacataagctgacatatttgtaccaaacatcacatttgtcatacaatgtattctgttgtcagatttgcagaatatggggcagtacaatataagaatgacaaattttgaacaaaaagagttcctttccccatgaataggacagagaaaagtggtgtaatatttattataataaatatcttagtaaaacatataaaatgcaatcatgggggggaaggcagaattatttgttttccaaagtgcaaaaaggaactgtctcttttgaatacacacctattcaagaacatactcaagaaaagtaaacacataatagtagttacctctgggtgggaaggaaaggtgatagaattggggaagggtacactaggggccccagttttacctttagtgttgtatggtttgaactctttgatgcataaatggctacactatcatctatttttacatgcctgaaatatttaatattttaacataataatataaaatatatttctatactctagagtatatttatctttaatattctataatttgtaaaataatacctattagtttatcattcatgttcattctaaacactacgcatacttcttactcatttctttttatccttttcaatctgtatcaaaatagtagagctttacacaaatttttatctaaatatcatctttcaattattttcacagtgattaaaaacaaagtttaaaaaaaactagaaaaaaataaaggtgaacattgacctgagggtgaggaaagcttttatatgaatgaaagtcatagatcaaattttccaaaagaaaagtgattcttttgtctatagttgtatattaaaaagcaatgtaataaattagatggcaagcaacaaactgagaaaaatattttttccaaaagtgtgagggagaaagggctgggtgcagtggctcacacctgtaatcccagcactttgggaggccaagacaggtagatctcttgaagtgaggagttcgagactgacctacgcaatatggtgaaaccccatttttactaaaaatacaaaaattagctgggtgtggtggtgcacacctgtagtcccagctattcgggaggctgagatgagaggatcgcttgaacccaaaaggcagaggttgcaatgagccaagattgtgccactgcacttcaccctgggtgacagaatgagactctgtgtcaaaacaacaacaacaacagcaacaacaacaaagacaggaaatgttaatgtctcaataagacactaatgtacaattcacaatagaaaattcttttacactataaaaatatttgcagcctcaatgttaatcaattgagataaattagattttatccaacatattaattttataaatacttaactataaaaaaactcaatatttgagatggtgcagtgatacagcgatacagcagtgtaatacgctacaagcacactgctaacagtctctgaaaagcagaacacgatgtcacctttaaaatgttctttaactctatacatcatatttctgagaatgcatcttaatgcaccaatccaggattgaccttcaagtatgcttatcttaaaacaattaaaaacagccaatgtccaatatgaagagaatggttgaataaaaggtaggaatataaaatcatgttatagaagattatggaatataggatggtatgaaataacataaatataaatctcagtttactatttttaaagactaagtattaaaattctcattggaagttgaaggtttgaatcctaatcactccaacactgtacaattgcattataaaatattttctttacacattctaacacaagagttagtgtatcactagataaaagttccatatgagttatttataaaagtagaaaatactttattgctgctggtgtcctgaaactgaataataaattcatctataaatcatttagtaccttaatgtctgtgggcccacttactgtgttaagtgcagaaaattattaacagtctggactttctaagtacataattttctattgtttattctttgttttataaagtgcccacatgttcaaaatatttttgataatgaccaagtagtctactttcttgatgacctggaacagtcatccttttttttcttgctggtatttttgttctaaaagggaaaagagtgtggaaaaggataatggattactttataagcattgtcttgacgacttggcaacaataatcaatactcaaaaacttttaagttcttaacacatttataccttgtaaataggggcacaatcacgtggaattcataggcagtttgcttttcttgtaccatcactcaattttttgaattaaagattttatatgagacttcggaattaatgatacaaagatgcatgaatgaaaatagagataaacccaattgtggaattaaatatacaatcagtagctaagaacaaggagataatgatgcttcagcaatcttaggaattattcaggtaaagaggggcaagcacagcactttgcactgaagaggactttagagatcaactacccaacactctccttttaaattagaggaaactgagcctatgaggatttaagtaatttgcctgtgatcactcagctaactagtagcataggaggaacaacaataaaggtctagatttacagtaaatttatctattaattcatttctacataactgcttcttgcattcaatgcacctagtgtaagtcaaagtcaggtatgcaatatggaaaatggtttagtctctttgtactccaaatccaggatcaaaacaacagaaaaataccagaaagacaaaaacaaaacaaacaaacaaaaacctcaagagggcactgagcagagatactgaatcaatgacaagctcttcccaatctccttccgtccccatccccaaaggctctgggtcagactaaaaagactactgaactacatcaaacaatttgtgtctatgtcccacattttcctaaatgtgtgaccttggacacttttctgtgccatcctgaacctcagttttatcatctagtcaaaactcaagatgatctctgaaaggtcccttcttcctatatgtcactacgcaggtgaaatacaccaggatttgccctgccttgtctttctgttctttttaaaacccttcgtccagtcaataagcccagtttttaaaaattcttgcagtttctattcaaaagaaaaaaatctaaagggtgtgtctaataacaagtgctctcaatatgaccataattgtactattgacattttggtgtttcagggtaatacaatttactgaaaaagaagaattaactctggctatataaagttgccgtatatttatttaaaatttcacgtattttcttccacaaaacttgattttcctctttcaaatcataggatatgaagaacttttcattagtaacatgaaagctactgactacatgtctaaaagattcatctttatttacatatctaggttcttctcttttaatcaacctgaaattacgtttttctagtagttaaaactaaacattctcttagtaaaatacagaagataacaggagaagaaaaagctgactatggaaaatttttctaactgtatgtcatctaagtttaacggtaaacttctagtagtctctcgggtcctaaaatgcttcaaatgaattcataatctgaatgggcttttaaacaacattgggattaggagtctggccctaccttctctggagcaaacatattgttgagaatggtttgcaccagaaggatcttctatcaccagtattactgttgttgttactgatatcaattatcatcatcatcatcatcatcatcttcttttggggggagggtagggtgtggatggagttttgctcttgtcgcccaggctggagtgcaatggcgcagtctcggctcactgcaacctccacctcccaggttcaagcaattttcctgcctcagcctcctgagtagctgggattacaggcatgcactaccatatttggtgaatttttatacttttagtagagacggggtttcaccatgttggtcaggctggtctcaaactcctgacctcaggtgatccacctgccttggcctcccaaagtgctgggattacaggcgtgagccactgcgtctggccatcctttttgcatataatcatttataaagtacataccccacaaattatcatgtttagacacatggacaaccattctatactattcatgcatgttatttattcctatttagcaagtgagaaaaccaatgttcagaaggattatgagatttactccattttatatccaaaatatagtaaaccaggctttgaacaaccctaattctagaacttcttttatctgtacctcaatgtggtaagcattatgtgatgtaggcacaagggttttctattttcataccaggtgtgcagtaatcaggcattctaaatttagcccaagaaacacacttaggtaatgccctgaaacagtcattgctattccttatctgggaattctgttatcattttgcatttgcaaaaatagtcattctataatatagaagtattctttcacattggcctcccacattgctggaaacatttctttatatttactcttcccccaaaaaagaatgagtgggaaacatagttaatatttattttgaaagaaaatagggcttaataaagggaacaattacatatttagtcaaggtagattaatagctgaggtttaccacttagcacactgcaaacaaaatctaacacgatactattgcactaatactagagcaatcattacaccagtaggtgtgccaaatgtggaactcaataacaaagcctacttaaaatgatcaagtattataagttagtacatgatcagtgattattctataaagtggggtttgggaagctaaacaaaccctaaattttttccttattcttcataatcaaaacacattacagatagacaaaagttaaatataaaaaaagagagcccccaaaaaatggtaaagtaaaaaaagatttaagaagcttaaaatggagtcacatttctaaacatgacataaaagcacacagaggaatgactgttaaaccttgatctattcaaaacattttagaaacaaaagattaaataactccaccaaaaaatgagtacataacttgaacagacatttcttcaaagatgatatacagatggccaacaagtacatgaaaagctgctcaacattactaatagagagatacaaatcaaaacctcaataagatataatttcatgcccattaggatagctactgtaaacacacacacacacgtaagtgttgacaagaatatggagaaattgaaccctcgtgcactgttgataggattgtaaaatggtgcaaccactatggaaaacagtatgaaaaaatatattaaaaatagaactatcttaagacacacttagatatatatcccaaaagaattaaaagcaggctcttaaagagacatttgtgcaagtttcttctctcaaaagcagactcatattgtacaagcccatatgactgctgaacagagtccaaatattctttatttcctttcattgagcactacaatcatcactcaaatcattacacttcaatcagcctgacacagaactgtgttctttaggactcagtagagagtactatgtaacaatgaagatcagaaaatgtctttggaagcatggaaccagacaaaacaaaagatgacagacagatcgatagatagatacagatcgataatagatccatagatagaatgcagttaataaggtgatttatataatctaaatgcttaatgtcagcttgttaaccaatagttcctcactctcataaacagtgtttgaatacatactgccaattgtttatgcctgctcaaattcttaccagtcctaccatctgattgacctgtcaactcaatctctttaaaacattgcatcttagttctgatgcattaagtgtagattttgtatgttaattcataatggaggaatcttatttctctgattttgacatctcttctttcccactgtactgtatgcaagcagtatagaacactttggagttaattgtgactgtaatattaattctagacaaactacaacagaagacacatcatggcagaatatactttaatattcctatattgtaacccacaacttttgatcactttacaaggtcaaactttgttattgctgagcatcacagtaatccaatgactataacaaaaagctgatgaccttaactttccaggtggccctagtataaagcctgactttgatgtatctaaacaagcacaaatatagaactcatcatgaggtctattagaatcataaaatcttctgagaggaagctatctagagccaccctgcttaagagatttaaaagcagacagatcaaagcatgtgtcattgagaatcctgctggttgtcatgagagaaggggtaaaattacaaacccattcagttgtatccattactgtaatgacctgaaatagactagaatgatgaaaatgaagggtgagtagcattgggtcataataatagtaatcacatatcatgtgacagtagtattgaatttttcttttgtacagcaaagacagtgttgtatttttttcctggatagctatggtaacaagctttatttctgaatgcctgatttcctgtctatagacccacacatctgagtaatatgcctatcccaaacattcattgtgatatcaaggatgagtcaaaaaacaagatggacatatgccaaacaattttatgtgaagggtaaaatctgtatttccattgattaccaaactgaattttgcacaggtaaaaagcaatggtgtcacataatcctgcatcttatcagctttcacatctcatgctttcttcaatgaatatggtgttcagattatatggttagggaaagaagaggctaaaaatgcctacatatctagcatgctgaaagaaaaagtctagaacagaaaggttctcttttcaggataagccagtctctagaagttagagcttaggacaatctccaggggaaaaattctcgggtgatgctagttataattctatgctccatggagccttcaattgactgtgtatttcttagagttctccctttaaaatatatttctcttcaaattgacgctatgcctcttttaaatgggccaccctgtatattctgaatgagctttttccagtaaagaactgtgttgatgtaaatctacgttggcaagagcgtcatcagagtcagctgggagtgacaggcatgttctagccaattctggacagtgtgttgaaatatgcttcccaggctgcaagagcaaatgcacaaaagcaagcccacgtcttgacaggggtgacgtgctgatcagcaaagccctggctctgtgagaacataaaatacgcaccaggagcatttcttgaggagaagccaaccaatcaatcacagcaagagccacataatccttacaggttaaaaggtgccagagcttacccttttccttagggcaaaaaaaaagaaagaaagaaaaaaatgtttgcacatgttgcttgcagggcgcactcctaagacacagaagatcgtatttcctaataactgccagccagtacaactaatataaatatgcaagcaggcagtaagaaccaacaattcaaactccaaagagaaagctatacatttcatatttgttttattaacaattatgataatgaaaatattcctgtataaatgttaaaacctggcatcatcttgtaaaagtatttcatgccaacacataaaacctatttatttaagaaaagcaatatcattgtgataattatgtgtataaactgttgtgacaaatgcaatatatatattttttcaaaaatatttttcagttcttcaatatctaggctgaacatcatattcaagaacaggattttgtgtccaaatcatggaaaaaatggcaatttcatattagaaaatctgtgccagggctatacatctgcaaactagcaatttcccaattgtttttctgtatcttctgtcatctgtctcattcttggagcatacacacacggccaagatgtgagaataatatgactttaccagacaggaatgttgaagtgaagatgactgggcagacctggccagtctggtacccaccacctctcccctcaatttctataaatgcagtgaggatgaattactgtttctggaactaattaaatagaccaaagaaaccggccatcccagcagaggagtttgtgcttgtctgactacatggtcttaaaaccaaggtccttgtcttgaatacacaaccgtcaccacacaaagtccaagactgccaggtcattgctcatcaccagatggctctgtaaatcccctactttgaaatccccagccttccccaattcctgcaaactcgccagcgtgactcctagcgttcagtctgtcatcagcaaaatctccttatgctcctgtatcttcagcatgttctctgactttcctgcaccatcttgctctgacactactggctgcccaccgagaatacggatttacttcagccctctgatgcagtggctatttttccttccacatgtttgtacctctgcccctagtgaagtaggagtctttctcattcttctctgctgcttccagaccatgatctcttccttgccctaaaatgtctttgtaactcacatcattaatctgctcccctcctaatccagttttctactgacctaaaggtctctcctctcagtctttaaacattttagccctgtctctctccagcgcaaactcttacataactcataattatcttttcctcccacggtctcccagtttctggatctcccttcagataatcttacctgaaacctcctttccttaccataagcaaggccttgccatgacagataacggtgccccataaccactgttaagcgtctctccctaccttctctctttctagctcatcccctccagtattctgactccaaaaatcttccaaacccaatgagtcctccagtgcattgaccttagaagttgttctgaccctcaccaaacttatgtccccttttccttagtgagcttagagtaaatatggcagcataatcacttctttgcatatccttttaaaactcagacttcactgaaatatctcatctctgttaaaccaacctttttcaaaccgtgcttgttgtggcctaagcagtcaatgatagttgaggaaaaacacaaccatgatgactttgaatttgtaactactggcctgaggtggctccttagtgccgtctgggaatttcacatttctctagacaaagcactctctcctcccagagatgatggatcatttctcaccttctctctcctcaaacctccaacatctgttctctgtctttacattgatgagcttattattttatcacaaaatagaaggaattaagagacacttttcatacactctgaaaccagatctatcaagatactgacctcctatactctcagactgtcctactcttctttctcatttattgtgaggactgaacaatcagcactcccattaagggcaactccttggcttgtgcactatctgaacttctccttacccctattcccccaaagcctcctcaagaatattgctcctgcaattgtccccagtttctcatgatcaaatgtcccctttctgctgcttctttctcaaaaccacacaaacataatacaattgacaacacaccctttgcccatatctcatttttcttcctatcccctccaactgactttacaacaaaactccaagagttaacaattgccaccacttcttttcccatcatctcttgaatccacttgacttagtccttttataaggaggccttcacctccagatactcacaactttgagtagtcctctctcacactgtaccagggttggcacatgtgagcagaagaatatggcagagtaatagtgtgttgctgccaagtctgggtcataaaagtcgttgtggcttctactttgcactctcttgaatcactgactcctgtgcctgaggtaggaacacccagccatcccattactgggtacatacccaaaggattataaatcatgctgctataaagacacatgcacatgtatgtttattgcagcactattcacaatagcaaagacttggaaccaacccaaatgtccaacaatgatagactggattaagaaaatgtggcacatatacaccatgaaatactatgcagccataaaaaaggatgagttcacgtgctttgtagggacatggatgaagctggaaaccatcattctcagcaaactatcgcaaggacaaaaaaccaaatatcacatgttctcacttgtaggtgggaattgaacaatgagaacacttggacacaggaagggggacatcacacaccggggcctattgtggggtggggggaggggagagggatagcattaggagatatacctaatgtaaatgacgagttaataatgggtgcagcacaccaacatggcacatgtatacatatgtaacaaacctgcacgctgtgcacatgttccctagaacttaaagtattaaaacaacaacaaaaaaaagaacacccagccctttggagaagcacaaacagtgaggaactgaagtcttctgccaacagccagtgtaaagcaaggctgcctgcggacagcaccatcttagaaaactgatcttccagtcccagatacagcttcagatgactatagccttcactgacaacttgagtgcaatttcttctaggaactttagtcagaaccagccagctaagctgctccctgatttctcagaaactgtatgcaataataaatgcttgttggtttaagcattggggaaatttgttatattccactctagtcagtcctgtatcatcactactctactgatcgacttgtgttgtatgccaccaattggctgcatgttgccaatgcaatgatcaattctcagttcttattttagttgacctatgagcagcatctgccacagtttatcacttttctgttgttgttgtttctttgtttttgagacagagtcttgctctgtcacccaggctggagtgcagtggcatgatctcagttcattgcaacctctgcctcctgggttcaagtgatgattctcctgcctcagactccccagtagctgggatcacaggtgcctgccaccacgcctggctgatttttgtaattttatttgagatgaggttttgccatgttggccaggctggtctcaaactcctgacctcaggggatccgcccaaagtgctgggattacagccgtgagccaccatgcccagccacttatttctcctgaaacagtttgttcatttggcctccagatatcactctcaatttttcttcaacctcactggcctctctgctgagttttcctcattttcctgatttctagattttaaagtgccccaactgtctcaggtcttttctctatatatacttgctccctgggtgattcattcagacttatcacttttaataccacctacattttaataactctcaagtgttcatctcaagtgctaatctgtgctccaaacttcagactcatacattcagttatctaagtgaaacctccatgcagaaatctaagaggcatccccaaaataaattttttaaaactaaactcctgatccacctcccctaaaaatgctccttccacaatcttcctcagcttgacaaatgacaactacattctacctgttgctaagtccacaaacttaagagttattcttgattcttctttctcactcttcacatccaatgcatccacaaattctgttggctgtgtcttcaaatggtagacagaattatgaccttttttttttttttttttttaactacttttacctctatttctctagtccacactgccaatacatgttacctgggttacttcaatagtttaactggtctctgcttccattttccccacatctttactttctacacaggagccgggatgattcttccaaaacttatgatagactgtgtcccttcctaacacagacattcctactactaacactttttgcttcaatacatcacagtcatcaccaaggaatgacccaagtctttactacaggctcaaagcactatgtgatctgatgcctttctgtggctcctacctcattttctataacttcccccctccctcaaatacgccaaccacatttggcgtacttgaaatcacaatgaaatgtacttctgctggataatcatatagctcgttcagtcatctctttcagatctctgctgaaatgtcttacatacaactctgtaactccttaccctgacttattcttctatactgtacttgtctttctctgacccactggaatatttatttgtgtgttgtcttctcctttattagaatatgtgctctttagcctgatgcagtggctcatgcctataatcccagcactttggaaggccgaggctggagaatggcttgagcccagaagtttgagaccagcctgggcaacatagtgagacccccatccctacaaaaaataaaaagttatctaggcctggtagcatgtgcctgtagtcccagctacctgagaggttgaggtgggaggcctcttgaacccagagcccaagaggtcaaggcttaggtgagcagtgatcatgccactttactctaggcggcctggacaaaagagtaagaccctgtctcaaaaaaaaaaaaaaaaaaaaaaagtatgccccaatgtatggaagactgtctatttcattcagttctctatctccagaagaacaataggtacacaggaaacactcaaactattttttgaatggatgaaaagaaaataggatatttcactcctgactctcaccttggtgagctagtgataaaatagagaaaattaccttcagagtaagatggttttctgtgtccagcccctcagaactgctagatgtgttctaagaattgtatacttttgcaattcagtaagaaggaaggcacagtcctcacgtaaataatgcctctgttctatgcatcagaacacaagtgccactagtagaattaacacatctgatttgaatgaaaacagcattgtgtatctatttcagaaggattatcttgggaaaagtagaagagcagtagctagctgaaagatggtatagattggtctaattgaactgagtctcaaagtccaactattgaaagtgttcagtgcacatacttgtggcttagcaagcttagcatggggtaagaactcaaaatgtcacttcctgttatgtggagtgaagctgttaggaaagataacatcatcatgtttcttttatacatataaatccctggtgtgtgtgtgtgtgtgtgtgtgtgtgtgtgtgtgtgatgtgagagcgagcgagcgagcaagcgagagcaagagagagagagatgttagcaatccttcaaaatctgattccaacctaccttccctagaggcactcaaactcacctaaaccccatgtaatccccatatttgttcacactattcccttggtgagaaaacacctcctgtcacttcccctccttccacacttcactgcagttctctccctgctgaaatctcccatgcttcacattcatatcaaattccttcctaggcccctctctctttgtgaaatgtgataataaaacctaaacctaatcaagttgcagtgaatattcaatgagatcatctaagacaatgctcagtagggtgcctgggacttctctgtgactatttcatctcactcatgaggtcttaagtgattcctagtaccagatacaatgtctccctcccataaattccaaccactctttatgcttagttatggcaactattgttttatggttgagtaatcatattctaacacctgttaggtcataatccttgagaacaaagacaatgccccaataacatcccatatagtaatttgtacagtgtagacagagtatgtgagtcaaattaagcttctagatttcaataggctcagatcaccttcagtgttctatcaattgtatgtttaccttttatttgaaagtactactgtctttcaagaggtctttttgttaaatatatcatttgaacttctaaataattttatgaaacatgtatgaattagtaatagttccacttacagatgaacttaattgtgatttgtggaatttaaataaccctaggatcccacagtgagtagcagagttggactatgcaatagattcctgaacctctttgtatatcacaagactgtgctaggtgctagggatacacctgtgaatgaggtagaactggttctccccttcacaaaatttactccctagggcagtagttcttaactgaaaacaatccctcgtcccctacaagggaaaactggcagtgcttggagacattttgaattttcacctcatggtggaaattaatgtcatctagtgggcagtggccagggatgttcttaacctcctacaatgcacaggagagcccccaccacaaagcatcattctggcccagtcatcagttctgctgaggttgagcaaccctgctctagattcggcttcaaaacgaaggatgtgaagtatccataggacacaataacacatagggttgcagagataggtgcagaactgatgacagatgcttagatgccatgttaaaggtgtgaactttatcctacagggcagggatcggcaaattacggccagtgggcgaaattcagcctatttgtttttgcaaatacagttttattggaacatgctaatgtccatttgtatatctgggcttcttttgcactaccgtggtagggttgaatagttgccccagagaccatagggtccgcaaagcctaaaatatttattttctggtccttttgttcacctctgctatagatagtggacaatcaaagcagaactgtagggtaattaatgagacagtataagtaggacatccttagtgggaaggagctagtggcacaaagacaagttagaatgttattgaaatagatcaaacacaaatctaagtattaaaatacctggtggtattgggagggaacagaacagcaagagataataggtgaaataatccataggcctaggcagaaggagggcaaggcagaagtcaaatatgattttttctggttttttgggaagataatggccagataaacagaagtagaaaaatcaaaaaggggggcacagtaagcttggttttgtgcgtgttaaatataaattaagagtggatcttccacgtggaaatgtccagaggaggcatatggaacttgagcctgggaaatgaggtttaagagtagggtttattaaaagagctgacagttggaattgaacagaggagagacacttgtggtgcagggaacatactgaataaggtcaaaggaataattatgtaaccgggggtactttcaattaaggtgctggaaacagagacaatgaaaagaaaagggagatctcatatgaataaagttaatccagtaaatgagacagtatcaacaaagagggatgagcatcaatttcaaatgctaataatattttgccatgactaatactgtgcatatcagtaagtgactttaaatgcaaaggcaatgctgctttaagtttgtttgtgtatgtacgtgttcatttgcaaagaaaactctcaagatgaatgtaagataatgtttctctttaatttatagctggtccaactctgacttttcttggaacttctgtttttttacttcaacgcatatcattgtcttctgaagtttctatcaacagtgtaaaatgaggagcttatgaataaagatgttcttttaaggccaggtacagtggctcatgcctgtaatcccagtactttgggaggctgagacaggcagatctcttgaggtcaggagttcgagaccagcctggcaaacatggtgaaaccccctctctaccaaaaatataaaaattaggcgggtatggtgttgcatgcctgtaatcctagctactcaggaggctgaggcaggagaattgcttgaacccaggaggcagaggttgcagtgagctgagatcgtgccactgcactccagcctgggcaacagagtgagactgtctaaaaagatgtccctttaagacagtttctcaacgtatggcttccacatcacctgtagggcttacaaagtcgactttctgggcatcacatcagacctattgtgggtgcagggctggcttcacaggtgtgacctatgaagttatacaggatcctactctcagaagggccttgtgctggattgaatgcagtgctgttgccatcatgaaatttgtaatatttatttgcgtaacgggccctgtattttcactttacctgggccctacaaattacgtagccagtgctgtgtgagcattctagcatggaaagtaattagtttacagagtaaaaaagattacagggtagaaaaatgtggttccttacttagctctcatttatttgcattgagacatactttttaaaacacccatgtttacactctttggaagtaaaacttggaatctaccattggcaggtacagaattttccacagaacattttttttttttttttttttttttttttgcatctgtgcagctaccaggtaagaacttaataattacagtgtgggaaaacagagtaccaacatactttctgcttagggattagcatcacccaatccaagttcagtgtgtttacctgcaactaagggattgagaacagaagaacttctgcaagaacaaatgtccctcttcctatggtggaagtatcagtggttcaggttggtatattagatggtttgaggttgtacaaagatggtgtttggcatagctgatgtggcttattgaattttaaaatgttgaattaaataaggagaagcttatttcctttccaaatccctttcagtaattcttattaccttaagaagaaagacttaattgtggtctttcatatgtctatattatttgctaaatgccattttaaacagagaacagacctcaggctcagagtctttggaaggtcatggttatctagctaaacttgaatctattttgccttgtttattgtatattttttcaattatcttctatgcataataaatgacgctagttccaaattacagtaatatacaaagctttatttttaaacatatggccttttaaataaaaatgtaagtctactagaaatattaaatgtaaacagtataaatggcccacagttgcacctaaaattgtgaaggtgattcaagaatgatcaatgtgttagtgaaactgctattcttattagtaagaaggctttattaaaggaagcctggttctattcagaggagaactgtagaaatcagccttgtgcattatcagcctgcaattcatatatattttagttattagtatccataaatcatacgctgttctatttggcaatcactcaatagaaggtcataaaaaaaatcacactgcacaaaataaagcaaagtaaaacaaatactattaacctaaagaaggcaaacaagcaggaatgataatccaagtaatcttaagtcagaaagttgcttgcttcaaaaggtcaacaatacacacttcaccatttataaatgtgaaattagccatgtatgaaaaaaaaaaaccaaaaaactggtaccctactaataacatgaagaggaagccactttattttaataatagctaatttaatcagagggttatctcaaaagggtaatggggaaaaattggtctcaaattactgcaatttaaaaatgatatatataatatttaactgtataaaaatatttatattaaaataatatttctatgctaaaccccttcaaaaaggttttctattattttagttcttctgaagatctactttggaaaaatggtacttaatttctgccagttaaaatttctccaaattaaaacactgaaaatgaaactatgaagggtttttttttgcaaatttctcaaaatcttgacatttcttttgtaagcttaggtcttgatatataatttaactgttatgaattctaaaagataaggattagtcatcagaatttaacaagctagttattcagtaatttcccaagaatcatagatacatttacacagatttttttcagaaatataacaggcataaataattttcaaagtataagctaaatattaaaatgcatgtatttgacaaattattgtgacagaataataagatacagaatcattcatatacaccaaagccaactataccaatctatgtgcatgtaaacccaaaacatacacacacacacacacacacacacacagagacacacactgagtcatggtgacaaagtccacacaaatggttaatcattgagttcaaagtttttttccactatggcaatcaaaaccaacatcaccaggacttctagtctggaagggtatggatccccctgggtgttcagcataaaagacacagcaacagaaggtatgtttctcaatcgatcaaaaaacaactatttattgaatgtatattatacaggtggcacttgtaccttcacagtggatacaatgattgatgaatgtggaggttcttacttttttttttttttttttgaaatggtatctcctctgttgtgcaatggtgcaatctcggctcaaagcaacctccgcctcctaggttccagcgattctcctgcctcagcctcccgagtagctcggattacaggcatgcaccaccatgcccagctaatttttatatttttagtagagacgaggtttcaccatgttgaacaggctggtctaaaactcctgacctcaagtgatccacgtgcctcagcctcccaaagtgctgggattacaggcatgaactaccgcacccggccggttcttactttttaggaacttacagtccagctacatacttgaaatacaaacatgaactagaagacagcataacatagaaaatgacaaataaatgtcaacacattcagtctgagagcccaaggaaagaaagattgcacccaatgaaggtaggtagttttggccctgtatacatttgcttacgaaaaccaaaagtcagaccaccaactcaaatgtttccactttgtttgctcttattaaagcttacactttttaaataatatattgaatcacagaaaacaatctctgaaacactatttctgagaagaaagacaacaatattagcttctagtcccagagatatttccattctaaaaggaaatatctcaagtcaaagagactattctataatgtggaatttggcatgaaggctggcaaagtggaaatggaaggatattgttttgaggtaagatgggtcttggtcctcctctatctggccacctaggtcactcaaagagagcctgtgagtcaggccagatcttgttaccaagcagtttgctgttctgttgcttagtgacttgaactagccggccatcattcccagctggctcttccagagtcaaaccttaacagatttctgacttgatctttctccttagagctcaagacttttttctttccctgaatgattgactataaaattattctctggctggctttgtttttacacctcttatgtaaaaacaaccctgaatcaaatgttctccattgaccccttttcaccaaggacatatatttctcctacacacacatatttttataagaatattttataaggatgtcaacttctatacaagccacatgtgtaaactaataaactgagattccacaccaaaaaagggctctgtctctacctttctgttaactactattttgtaaaatctttgaatattcattgttataacttcaatacacatgcagggtagggtaacaaatgtgaatgtgattcttagcccaaaggaaggtaatgctgaaagaaagaacacacgatggagagttaggaagacttgggttcaagttttaatgctattggtttcatagctgtttagctgaaagatcttggttatgtaagaactttttctgggcctcagcagctgcatatgtaaagtacggttaacaatacttacatccaaccttggttgttttaaggggttaatgtacacaaagtacctgacacatggcaggagctaaatcattgacgtctatgttataattaatctaaggttataaagctatattattatgaacctaagtgtttttattccaaaatgaaatcatgtaatttcttctcagatcaacttttcaagatctccttttgagaataagtgcctcatctgaaatacttggagagtatttatgtccttaaaactgcacataaaatgatttttctgttttgcttatttacagtagaagagactgatgtgttaagatggtataaaattgaagtctagtaaaagagaattttaaattagaatctttacagtgatctatacatttccctatctgttacctaaaattatgcctttcagatggtggcctaacgtgaataccaccaataccttcattctgaaggccctgaatcctatttatgagtcacagaattattaaataattctgtttcctgtttttacccatgtagcatctaccttactttcttacagcagcaagttggaacttgtttctaattgctaatcttaaatagactgtagtttgttatcactttgtaaatttaattagtcattactttttacttgtaaatgccaaatgcctttataaccatatgacttattaatagagtctccaagtcaaaaaggttgaataactaaggtcaagtatcaaatgaccagaagacctggaaatatgtgatttcaatatactgaatgaatcgcagctttaaaaacatgattttttaaaaagcaaaaccattaaaaaaaagacattattttgctacattagagatagtaaagcttcttcctgaaagtgctacttgaagaacaaatttggtagctttctatctaagaaaaaaaaagtgctgaaactcctttagttatctgaatacataggagcttttcaattataaagaaatttacacaaagaatattttttaaaaaatcaaagccatgattttcattattttaatgaactttaagattcaagtttttattttcttcttatcaacatttctgccaagtttgcaagaaagaccatgtcttcttaagaagagattttaccatcagtagcaacggcttcagctcgtacgaacaggcttcacatcttttctctttaagataaatgtcaatggtcatgggaagcacacgtgaataataagctgcaaggttatccaaggttttcttcacttttttctcaatgccaattgtcataatgtaatccctgtaattccttaaacatgacaagccaatcggcatgttctttaaaaggaaaatcttcctcaggtcttttgatttcgtggaaagccaactatgcctttcaaatggtacagacaccctcaacttgcagcgcctccacctcccatgatttccacagagggcaacagccagttatgccacagacatggctgaaggttagggctgactggtcttccccaaacattccagcagcacttcctggtgtgcttctcagatgatttcccccagaaacttgctccccaccttctggtattacactttgcctacagccctcctctgggttcctagttcccaggagactggcagcaatgctcttctccgggtattattaccataagagacagagaaaagataaccttaaagctaagcagggcagaagtaagagagatggaacgagggagaaagagacctcaaagagaaatcactaaataatggctttgaaaatctactcagttgtttgtgtgtgtatatgtgtatttttactctacaaactctaagtggctgtatttctcttttataggtgacaaatggtttctttccccttctatgacttgcaaatttatatttctcttaacaaccataaaaacaactacagttgctgaagaaataatgactcagaaagcaaatgtttacttttaaatatgagcaactttacatctaatgccaatgcctgataaagagaaatttatagtaaacaaaaaatatggccaaaatcacttatttagcttcctaaacacatttaagatttattaaaagtctcctaaaaggccttttgaaagtccacctaaagaaattattttgttgttaagattgttactaagtacttcttctactgttggatatgttttaattaaaaatacatatgtgtatacaagaattataaaaattatacagttgagtattacctagtcaccatgattcctaaagatatcctactacctaatttcgcttatatacacgctggaacattttcctccattcagtgcatcgagcacagtataaattgacaatgttttcatctagtccttaatcaggaatataatccccatgaaattacttatattagaaaactgtatttggttttaattatatttggaattaaaaatgtttttgagagatatatcataaataacaaacctgatgcatcttagtgaatgctacccatgaatattagtttttaatggttaatgttttcaaagtagcttgaaaatatttcactatgtagcctaaattgactgttaaattcaggaaattacatcttcatttccgttatagtaaaatgactcaatgtttttcattgtgacattcacttagattggagtgtgatactgacagctatagtaacaatattttaagagtataaacagctgggtttttagaggcaaattgacacagagttgtgcattgcttattctaagttctgagaaatgtgtcattaggcaatttcatcattgtgcagacatgttagagtgtacttacacaaacctagatggtatagcctattgctcctagcctacaaacctgtacagcatgttattctactgactattgtgggcaatcataacacaatggttaagtatttgtatatctaaacatagaaaaggtacagttaaaaatacagtataaaagataaaaaatgatatacctgtatggggcactgaccacgaatgcagcttacaggactgaaagttgctctgggtgactcagtgagtgagtggtgagtcaatgtgaaggcctgggacatttccacacactactatagactttataaacactgtacacttaggctacacttaatttataaatatttttatttctttgatataagttaattttggttactgtaactttttactttatacaactcttaattttcttttaattttttggctcttttgtaataacacttaacttgaaacactaacattatacagctgcacaaaaatattttctctatatctttattctataagcttttatttttaatttttttttactttctaaatatttttgttagaaactaagacacaaacacacattagcctaggcttacacaaggacaggatcatcagtatcattatcttcctcctccatatcttgtcccactggaagctcttctggggcaataacatgcatggagctgtcatctcctatgagaacaatgccctcttctagatacctcctgagggacctacctgaggctgttttatagttaacttttgtatataagtaggaggagtactctttaaaacaatggtaaaatacataaatacataaaccagcaacatagttattattaagtataatatataactatatatgctatatgtttatgggactgacagcatggtaggtttgtttacaccagcatgcccacaaacacaagagtaattaatgcattgtgctatgacttcactaggtgattggaatttttctggtccgttataatattatgggaccaccatcaaatatgcagtccaccattgactgaaatgctgttacatgtgtgtactgttgagcattttaaaaaatgatccaggtatatatatatgtgtgtatatatatgtaggtatatagatatatatatgtgtgtgtgtgtatatataggtacacaggtatatatatgtatatgggtacacatatgcgtatatgtgtatatgggtacacatatgcgtatatgtgtatatgggtacacatatgcgtatatgtgtatatgggtacacatatgcgtatatgggtacacatatgcgtatatgggtacacatatgcgtatatgggtacacatatgcatatatgtgtatatgggtacacatgtgtatatgtgtatatgggtacacatgtgtatatgtgtatatgggtacacatgtgtatatgtgtatatgggtacacatatgtgtatatgtgtatatgggtacacatatgtgtatatgtgtatatgggtacacatatgtgtatatgtgtatatgggtacacatgtgtatatgtgtatatgggtacacatatgtgtatatgtgtatatgggtacacatatgtgtatatgtgtatataggtacatatgtgtatatgtgtatatgggtacacatatgtgtatatgtgtatataggtacgtatgtgtatatgtgtatataggttcatatatgtgtatatatgtatataggttcatataggtatatataatatatgtatataggtacatatatgcatatatatgtatatatacacacacatattttatatatatattcacaactctattcctatactacgtactaaaaaagagcaaactgcttaaggatatatatatatatatatatatatatatatatatatatagcttgctctttctcattttatagtatggcatattatggagatatatatacatgtaccatctctatatataaaatggtaaacacacaaacaggacacatacatatgaagttaaaagacaatgacattcaaggaagaacacactgatttcaggatcctctgcgaaggaagaagaataggatgggtgacagctttagacattatctgtaacattttattcttaaaaaaataaaagaactgatgcaaacaatgacaaaattttggcattttaaaaatctgagtctggggtcaggggagcgggtagggatagctttaggagatatacctaatgctaaatgacgagttaatgggtgcagcacaccagcatggcacatgtatacatatgtaactaacctgcacattgtgcacatgtaccctaaaacttaaagtataataataataaaataaaaaataaaaaaaaatctgagtcgtggatatatagatgtgtattataaaaatatgaaaaaattataacttaagtgattataatgctaaattactttttaaaagaatatgtgaagataacaggttttatgacttaaatatgactaaacagcaacttttaagttcccaaagactgaaaaccagcatttctaccttgttcttctaaaacttatttaggccttacaccccaaaactgtgcttaaaattcaatgacgagaaaagcctgaagaatgtgaagaacttcctgatttcaattttcctgaaataaactagtactggaagttaagttttcttcaccagagattccattgactttgtagttcctgctgatgatagagggaatcccctaccagatgaaatctgaatcatgtctataatcactagaactacaaggcattgcatgtttagtaaaagcagtcaaacagattagtgaaaagcagagacacaagagaattctaatcctaacagatggtgccagaccaaaaccagtgctcaacacatactagctagtgataaaactattactaataagcattgagagtatcagagacaagaggcgcaatagaaatctgttccttgaaggaaggaacggattacttccagttgggagaactggaggaaccttttaggaaaaccaggaatttgaaagatgtatttttgcagtgggcagagaagagacaccaaaccccacagttctgcctcagtagtatctctcatttctgccttctcctttcctacagtaataaaactgacatacactcgtttctttcaactcttgtctcttcactctaattcatccacaaatgactgacagagtaatcatctagaaatttaaacatgatcctaaaggttcatgcagaccaaggctggaataatgggcacagagtacataataaaaaaaatactagcttataatgacacccactaagggtccagccctgtgaaaccacttaatttatacataattgtacttaattaaaccacaacccccaatagatactattcccagaaaactgactaacggggaaactgaagcacacgttaagtaacttgaccaaagtcacacaattactaaatgcaaagtaagaatttaagtttagtctcttttctaactgctttggtgctgagtgacatagcacctagagtatgctgtcaattcagtagctattctttaaatggatcatgaaaacccaagagaagtctagataaaaactacctggtaaatatagcatatagaaatgaaataacaggatgtttacttaagaaaagagaagtccctttttttttttttttttttttggtgacagagtcttgctctgtcacccaggctggagtgcagtggcacaatcatggctcactgcaacctccgcctcctgagttcaagtgattctcgtgcctcagcctcctgtggagctgggattacaggcacacatcaccatgcctggctaattttttgtatttttagtagagacggtgtttcgccatgttgcccaggctggtctcaaactcctgagctcagggactccgccctcctcagcctcccaaagtgctaggattataggcatgagccaccatgcttagcccaagagaagtcttttttaagagcatgagaacactaaaatattgattaatgaatttgtttagcagacatttattaagcttccaccattgaccagccatcatgccaagcatgggtataccaaaatgaatgaatagggccctggttctctggtgggttactccaagccacttgccttagggcttcataatggaagggagcaaaaattcaagttgtaggattcccaaagcagatcttggatccatggatgatagttgcagggaaggagacttctactgtttagaagcaaggtctttccaatcaacagccctatcaaacaacagaagtgcttctgtataatcttcatcaaggaggtttgacgagaggttcaaggacttgttattacagatgttattctaagaattcaacaatggcatatgttattacagatgttattctaagaattcaaccatggcatagagggtaaatcagatagcccttaacatactatataaccaagatagattagccaccagcactttaccttatgccttggaacagagctatgtttcccagcctcctttgcagttagatgtggccatagaactgagttccagccagaagaaaacgagtataagtgacatgtgcacttcccggcctgtctcataaaagttcacacataccatcctctttcatggtctttctcctgattcatctgagcctggcaaccttgggaatcacatgttgcaaataatggaaccacaggatggtagaattccaggtccctgaggcacccagtggctagggcaggctgcctccccacaaaaagcagaagcaagaaataaaaattcactgtgtcaatccaatgagatttggagactattttgtagaacagcaagattatcttagctaaaacagatgtcttccaatattattgatttattctaccatggtataaattattggaaaccaacaaatggttcttgctcaactttgtaataattaggtacagaataaacatgttagactcagtaggtattaagtgtatgcatagcgaatggaggggaataccaggagcaggaaactgtgaggcagaacactgtactagcaacaaattagatacaaatatatttatatttatgtcagaacaatttgaaacatattttcaaaattctccatagtgcttagcacaaactgtgaaagcacaaatgagatttttgtcaaaagatgcctgtggatattatgaacgtcttggggctcattcaaccaatatggaaaacttgagatactctttccaactcccttgcctgatagttttagtccataggggaaactgcttccttctgagttactgaaaatcgataccatgatttttatttctggtttccattgctctctttatgcttttcttactgggctgtgacctgatacactaaaatgaaatattgatagaaattgtgctcatgaagtttttccaaacagcaccagaaaaggaagtgccagaaatgtcagaagaaagcctattttcatgggatttcctgccttccttacatcccgacatgtctaaatagttcagataacctccagctgaactctaggttgctccactcagactgaaatcaaacagctgagttgagggccactcattcagcaatgggtgcaatttaggaactgcagtgataaagcagcgcaaccaaaagggacactggacacggaaattctggtcctggctccgtaggaactcatgccagctctcctgctctggcacccgatgcctggccttgagccaaccttctccttcagtgcatctcccagtgtttattcatgcctttcttttattcactgtttgttgctcacaattttttccaaaaagaaaatcttcctcaaagagaagccatcatttcccaataactgctttaagacagaaaaagtcaatgtttgtctcactcctcttatggccattacatctaccaaactcagaaatgccatctaggtgttaaaatcctggggacaataacactttcccagtcagagatctagctacttaaaaccaaatttttgaggttggtcatgtctttgggtgtgacatggcttttatttcctttgtcattgactttcatctataacatcaatgcattcctgagcacggtcttgtcactggtttaggttttaattccttttactttttgctgctttcctcctaaaagccttgtttctgctttttttttccctcccattgctaacgtacatactgtttagttagttatggcaaaactgtaaaaaattatttagtcatacagtttctcaactaacacactcattcttttttgttatgttttctttatcataatttatactcatcttatcaaaatgtagatgtaatgtatagaacctactactacctgaaattatctaagtgtgtaacatagaccctagtacttggactcactgatcagagtttggaatggcctctactcaggcagaaactccaaatactccaaataagctcacatgatggtctgttttaatatttgggtttttcttcttttttttttttccaagagcaggaaaagatgaggaatcctccagaaaaatacatggaagcatatgcatgaaacaaattcacccattataaagaagataaaaatattcacaaagaaaataaaaagattggcaaaatgttctaacaatccaaattcaaagaacacaacaatactaccaagtaccagcctgcaactttctgcgtagaattcctaatccctttcttctttcctttggaaaggcatgtttaagattatgaatactgtatatcaaagtcaggagtgaggaagggctttatgaagacacaccaccattacacacacactgtatgtgtctctgtccaagtggggatcatgcagaaaacagagcaaactatgattttcctcccctcatttctggtcctttctttcctcagctgttggggaagctggcagggaaattggtttaaggaatcaaagaaacgccactacgtacgtatgggaataaaactgcattcttatttgacatctggcatccaattttcttgtaggaacttgcaataggaattgaactttgagaaccacccacctcaaccactcctagtaccagtctccaggattcttgccctgacttggacatttgtgggatttatggttaagggagatcacttggccataaatccccggtgaggaatgatgatggtcctccctccctacccccaaaattaaaggcgcgagagcaggactccctgaagggaaacggccaccatttctgcgaggtctgcgcaaaccttaccatgtatgtgccaccgtgaaacgccgctgtttggggatgttgctgctgagaagcattctgcgcagaagcctgggggaatttctcggagagatcactggagagagcttgggagaaaccgatttcctcgctgtcttggacttctcatgctgcaacaggttttctcgcaaggatttcacaaggtcttcgttcagccacgggtttggacaatgcggattatccacttcaggtactgttaaagtgtccgggcttgtctgctgagccattttcctggtcaactttgtacagctggcaagaatccagggcaacgtggttccctcgctcacggtcccggaaatgtccagggaagcaggtctgagcctgctgctgttagtgcattcagtcgcctgcctcagtctctctgtagagcctggggctgggtgcagaggaggcgagcgcactcctccgcggaagcgtattaaacgtcacccctcctctcccaagcccctgccaaagatcactgacaagctcgcatagcaaatgaacaaggagggaaagcaccgcgctcgcacggctttgtccgtgctacaaagcagcctgttaaactattggaactaatgcgccgcagctgcgcgagtgacttctgctgcttatgtacataaaaagtcctggggggagggcttaaccatcagatgcctgctgctgggttgtttggctagtctttccatttgcttattcctgaatccaaaggaaagaaaaactttgaacttgaccttcctctcccgcagggctatttatctccctacagtccacgttcataaaagaaaaatgccaatcctttgtttttttctctcttttttttttaataagggaagaataaacaagcactagctacacaaggagaaatacttccctgcttactaaactcaatctgatgaaccacataagacaaatcccatgagaatgaaattgactttttctccctctgtctctagttagaacccaaacaaacaaaaggtttcaaaatactacacatggaacgctttacaggttgcagttgtgttctacaaccttattaattagggccctttcaaagaactaacaacactatttagactcacaaatgatatgttttctctttgcatttaaactaatgcccctccagaaggacagatagttttcataagagtagtttcaattactatttgtgatatatacaattttatgtattcaactataagagggtggaatacatctagcttttcgtgatttcctttattgccttttaatgtaagatttttatgtgtgatgaatagagcttcaacaaacttattcagagagcttaaaagaaataattttgcaattggaaaaaaagtaaaaatgttgtaacaagaaagtatgaagtaaagcctgttaaatctcatttatgtggacactagaagtgcagacattaaacagcattggaaagaaactcaaacctttgcatagggaagttcccagtagcttagtgatgctacagaccatgtgggattgaaatcaaatcacatctctaacgatctaggaatattttatgtttcttaaaaacccaataacttagggagctacaaaatgcatccagaaaaaaaaaaatggagactggaatgattctttttgtttcctatgattactattaggtcaattttaaaagtttattctgtttccctgcccccctggttgctccattttaagttccaattccttgtcttttaaatgtttacagaaaagtgtactctgaggttctattcacagaaggacagggtcaaccacttggtccatctttcctgttagcatgcccacaacaattcaatgacacataagtgctatgacttcatcaaaaaatgttagacaaatatttgaatttgaagaatcaggatatgattattcttattctcataatttttaccaatataaaagtttttgtcactttacatcattaagtggcaaggtatgtgtgtgcatgtgtgtgtgtattgtctatatatatactatatttctatacagtgggctgagggactgaacggccttagaagttgtgcaaaacaggtgtgcaatgcttgccctcaaggagcttgtaacttaatggaaaggattggacaatacttagaaaaacataccagaacaactggaaaatgaaatagtcagatgcagaaaagtacaatgaaaatgaaatgcgtatatgatgagaaaactctgggtaaagtttaagaagggaaggttcagaaattaatggaaagaaagaaaagaaagaagtgcactttacgagtaaaaactagaatgaacaaatgcaattaaaaatgtatttgtacatgtttttagttttgtgcaaaacaaaacaaaacaaacgacaacaaaattaaaggctcagcagtctgtagacacaaagcctgttcaggttcaaagaaataaaaaattcagatgataggataagtgagaaaaactaatatgtattaaactgaaatggcaaaaaaaaatattttagaaaaaatctctagtttctgaagactcagttccattcaacaaacatttatgggcatttattttttgccagacactataatgggtgctctaggatatttaaagattagcttggccaggtgtggtggctcacacctgtaatctcatcactttgggaggccaatgcaggaagatcacttgagctcaggaattcaagactagcctgggtaacatagcaagaccccgtctctataaaacattaaaaaatagctgagtgtggtggcatgcgtctgcagtcccaggctactcaggaggctgagatgggaggattgcttgagcctgggaggttgaggcagcattgagccatgatcatgccactgcactccagactgcatgacagagcgagacccagcctcaaaataaataaataaataaataaataaataaataaaaaggttagcttgatactatgtctctatatctgcccttggggagcttatagcctaataggatagatgacaagtgcaaaatgattgacatgaaaaagtgcagcccaagtacccagacgagatcttggaggctggagatatttaaatgtctggctctaagtagagaaaagtgattcttagtgaccaagtaaaggaagagattatactaaaaatgatatgggcgacagagcgagactccatctcaaaaagaaggaaagaaagaaaaagaaaaagaaagaaagaaagaaagaaagaaagaaagaaagaaagaaagaaagaaagagagagagagagagaagaaagaaagaaagaaagaaagaaagaaagaaagaaagaaagaaagaaagaaaagaaagaatgatatgggcaataatagggaaattcattgaatgcaagggactctgggttctagttcttgcttttagccaccttgtagaagagcttacaaagagtaaactatttacatgctgatcttctcacaaatagtatgccatgtagaatgttcagagagtctgggcactttgttaatgatcacaattaagctaaatagtagatataacaatattctattcaaaatgcattgatcattatggttaaacatggacaaaagcattctgcagatctcccattgctttggtgtatgttaaaggatttcagtgtatttggttggtgcaaaagtaattacagtttttgccattaaaagtaatgaagcaggattgagagtttctttacaggtccccatatcccattattattattgattcaatttcctaatgcttactgttaacctcctaaatctgccaaatgatacatgatatgcatactgctttttaaaaatacaaaattaattttgttttgagaattcttggccagtccttgaaataacttgaaaaagcctgcagtgtttcaaagtcatgcttgaaaattgctgccttaggaaacacaaattgtaagattctgaagataaccaaaggtgggtgaggtttggacagactggcaattttttcttatgttaaggcagagggtcagagggtgctcttccaacaggagcactccacagcttgtgtttttcacaaaatctctttaaaattagctgccaggaacttgtctgaaaaacactgtacagtaagtgacagccaaataaggcctcaggttttaacaagtggaaatttgaaagtgggcgaaatgttttgataaagtcacccacgcctagaacagcagataacatctcttaacttcatgaaagttttcctagatacctctttgtggattttcaaaatttgtgggattttttagattatttggaatccttgaaaatgttttgtctcattaatcatttataggtggtaacaaggaagatgagattttcacaggttctgacacaaaaagtgtgcttttgtctaggtacaaacaagcaaggctagatttcccacaatggaaagagagcaatgatgtggctaattcaaaaggatggaagaaatgatttatactcagctatggaaaacattgtatgtttctccaaactatgttctaattagataaacaagggttaaaaggaaatcgctttcaaattgtccacaggatataggccatggaaatgacctgatagtgggagaggttatgttgtctactggataagaaggtatgggttaattttagaaatgaaaagtttattttgaaccccagaagtactagttactagttgtgttactttacttttcagtggctcagttccagatctgtgaaataggacgataataatgaggatgatgatgatagtagctattgcaaaagaatgctacaaggattaaatgtgttaatccccatgatataagtgtttaggagagtgcctggtacagaataaccacccagtaaataaaaatctaccattatgtgatatgaggaacttagagaaattcacacttagtagatatcaattatgtaccaggaactttgcattttatttcccttaatccttgcaatcatacttagggtgttgctttcgtactacaattttagagatgagggcataaggaggttaaataacttgccagaggtcatatagtttaccaatggcataaatgggatttaaatctgtgtctatgaggtgccagagcctctattttgactctacattatacaaacccaaaaggaaagcagatctagtatttaaaattgtttatggttatttctatggaaaacagtagacacctgggtcccctgagttcttgatctagttaacactaaattttgcccttggctattctcagcatatacactgagtcaacctgtaaacctgccaagtcatgaagttctttctgaggcatggtattgaagtaagggcagctgaaggtggaattcctgagatgttttttgtttttatgtttttttctcctctatatacctgtcttctttcaatatgaagaaattttaattaaactccatgatagttttccacttagccaaataatatattctaaaattattttatcttaaattttcatcatgattatttttcattataaagtttgatgataaagttatatcatccccttatctaaaagcacatctgaacactgtagaacatggtttttcaaatcatcatcatcattgaccttttattaggtactgggctagtaggcagagatttccaaaaaagtaaaatatctactttagaagggaatataaataaaactcccaacaaagaaaataaatactaagaatcaaattaataatagaaatgattggtgccttctgggttaaaaggagtgaccaataatttatctagacagagaataactcaaaaacaaggcagggcttgaattaagtcttgaaagaaggtacatatggaggaataatgagaggtttggagagataggtagtttaggggaggtaagatgcattggatttttagactttttactatggaaaaatcagtaacatttacgtggtaggtgggtaaacaatatataaagagatttaaataagtttaacctggttttaatatgttctataatttgcaagaggaggattctaaagatcttatttcaatatttcctattcaatatgaatttgtgtagaaatggaaagagagtacaagacttagaaaagtttgttcattggctgtatataagcttggaagtcaatagagaagtcaaaaattcatcagatatttcttatacattccacccaattaaacatcaaaagccagtaaacagtttttttaagagtttctagatttcattgaacaaaacaaatatatgtcttgatttacatgacagctatattttgagcatatgatgtgctcttctaagatcaattcattttaataaaaagaccaaatctagttatatggggtttttttcctagattaaaactaaatgttagagtgatctctgctgaaatagtaagtcattatttcacttgaaagaaacgttaacattttatagggcacaacttacaatggcattttttttttcttttttcttttttttttttttctgagacacagtccggctttgttgtccaggctggagtgcagtggtgccatctcagctcactgcaacctccaccttctgggttcaagtgattctcctgcctcagcctcctgagtagtgagtagctgggattacaggcaccaaccaccatgccgggctaattttcgtgtttttagtagagacagggtttcaccacattggtcagacttgtctcaaactcctgacctcaagtgatcctcccacctcggcctaccaaagtgctgggattacaggtatgagccactgtgcctggcctataccagcaattttaacacagcatgtttattttatttcagagaaaagttgcaatacaatttaggtaagaaccttccctttcctcctaatatagtcattctaaaaattctaagggaaattacttctaattattttgctaaaaggaaaccccagaatgccctctctaaatattactctgacttcaaagaagaaaataagttttgatagccactaaatgtttaacatattataataccctatatttctgggttttatttcagtgagaggaataaccaaacattttgtctgcaacttgtcaacaacaacaacaacaaaaatcccatatctcaatctgtactagatcatcccttagcctattgaattactgagaaaaaaataactagatgtaagtgcaaaacactagtgcactaagcataagcactttgcattattacatgttttgatcattacaatcattctaacaaggtggttactattacccacattttaaatctgagaaaactgacatacaaaaaaaaaattaaataacttcctcgaagtcatccacaccaaatgatctctaatcctcaaggtcataatcaaaagattttcaaactccccaaaattgttcattgtattacaaacaccagacatttagtgcacgaaagatcttgggtggaccttcagaatccttgtgcataatgaaattgacaagaagaaacaaacgtttgttgtctttgtccacataacagacatgataaggaacaaaatccaacaggtatcctaaattcagaggaatataacacaatagtgatctattcaaaactcaacaccaaggaacacatttccttatctttctctttcatttgctatacccacccctgaccggcccccaagaaaggatttttttggaatctttctcaaattagtataatataactggataacttccctctaatccccatacataacatctgttccagtcattctgttttttgaatatggtttctatgagacagtgtatttcactgaacatgtctataattcatagattttaattatagttggaaattttttctaaagttaaacatatctaaacaatggtttctcataaggaaatcatattttcagaaataacattttttcatacctaactataaggaatcttctgaaacctagatttttatctgggatgctttacaaaaggcattagggaaaccagagttgtattccccattttgtaataagttagcaaagtcaccttcaacaagttcattaaacttctctggaactcactttcccagtatgaagtcatataacttaactaaggtttaataacttaaaaaaaatcttatcctagtgttgaattgggagtttcatttgtcatttaaggaaaacaaatatcaagtgcatcctgagccaatatagtctcttccactttcatgcggtgttattatataccacaaatgcttttagaagaaaaatgaaaaacaagatattcaatgtttaggaaattgaagatggaaaacaagagagtgctacaataaataggtgctttactgatgcttttatggctctgaaacttgggaaacttttttccctaactaggtaaaaaatttgttctgatatctgagtcacagcttgggagatggagtgggagagcaatgcctaagttaatttaatatttgaaatcaaagcattgttttacttctaaaatagtgaaactacacagataggtatattcactgttacataataagtcaaattttctaaaacatcagggcttaagttaccttttagacaatttcagaggaacctctccactcacatttcacaaagcatgtctcaccgaagatgagttttgcctaattttaatgaatgtttcacgaaaaaaaaaaaagcattttgtgatttaaaaaatatatggagctgggttgaatacaactaaatggggctcctcagagtaagagctctccgtcttttaatatgttaatgtgatttgtgaatgtagactcgcctggctctaaatccacctgcatcctccagcatgtccagagattaatgtttccaggaacccttaactcgactttccacaaacatctccttgaacatagctgatagataatgcaaaccttcctgattttctggagtgcgttcttttttctttttgttgaactgcagccaaacggaatgcttccagcagaatgatgacttagttcgggtactggctgccctggtaacagcctccattagaatcaggttattgttatggtcctgctctcaggctaatttcaccctcctctgcaattggtgtatctccaaatgtaaaagacataaccttagcaaagactatgagagggatggggccatgcctctaaataacagctttgtggacagaagcctgttgggagactatggacaaactaacaggacagaaaaatattggactagatggtactgttggtaagaagatgtataaaggcaactgaaggccagacaggtgctcttcaaacattgatggacctacaaatcacctggagaccatgctaacataaagattctgattcagtacatctggggtgaggctcgagctcctgaatttccaaagctcccatgggatgctattgcctgtccatagattgctccatatgtatcttggccttagattatgtaggtattgatggctaatgaatacagcaaaagaaggcaattaacttggacacaggtgatcctatttctttatattcaggcatttgtgtaatgtttaaattcactgctgatattataataaatcatgcaatttctaaaataacttatataacagtattacataacaaaatcataaaccatttttttcaaaagcgcatatacactctaaaagattccattctagaagcaaactttgctatattaaatccacactttttagatgagacaaaaaaaagaagttgaaataaactcttttgcaggtgttgtgaatatctatgtctgttaataaattataaattaaaagtaataattacataattgaaaggtaaactttaagacttatagactgttttctgaatgtaatttatttaattattctacaagcatttaataagacacaccatgtgctaggttctgtgggtccagtgaagacatggtctttgtgtatctggggatacaagattcattctttgctacactcacagtctcctgggactttcagtctagtctactgtgcagtatgaaacatgcgaaggacacttaccatcaagattcactaccacactattgacctattatctaaagaattaagaaagtatgcatccgccaactcaatacctagccttatagtcaatctatggataactgtaaaagcaggtatatgcttttctttctggggcttcccaagaagttattctgacctggaagagctcaaatggttgctaaattatgaaaatcaatttgaatttctttctgaaattattattttaagctgtagtaaaatacatatgaatattacaccaatattataaaggcatatattctagttaggctaataaccaccatttatatcctgtaattatataaacattgcataagccaactagtaattatttaatcaatcagttataagggaaatcaacctatgacaaagaaatcctcttgatacacccctggtgaaaacacttcagtctaaacagcagttgcctcatgattcttgtactttaaatgctgggaatatagtaagtgttcaatagacactagacacaggtagaaaaggaaggaggaaatgattttgccgtttgttttactattttttatgcttttagatagttaacaggctaaaaaggtagggtgttcaaatcaatttatactgatctatctactaaaattctacattgttttagaaatccttttgctaggccagtgcagtggctcacacttgtaatcccagcactttgggaggccaagttgggccaatcacctgaggtcaggaatttgagaccaaactggccaacacaatgaaaaccgtttctattaaaatacaaaaattagctgggcatggtggcacatgctgtaatcccagctatttgggaggctgaggcatgagaatctcttggacctaggaggcggaggttgcagtgagccgagattgcaccgctgcactccagcctgggcaacagagcaagactctgtctcggaaaaaaaaaaaagaaagaaatcctttggctaggcatgcttttcattttaacaatgtatttgttttaaattagctagataatatatgatgtattctcattgtaaaaatgttaaaagttctgcagaactctaaagtttctgtagccctccatccccaaactcaaccttcccccaggtaactctgttaccagttgtgtttgttcttctagatctgcactctccattacactggccaccattcaaatgttgctattaggacgtgaaatgaggctcgtagaaatgagacatgaaatttttatttttatttaattttattaatttaaacttaaatagcatcatgtggctagtggctaccatagaggacaataaattctatagacctccgtgtgatatcataaataattttatgcctataggatcatatattactgttttctgaggcttcttaaaaacatagtgttatatttaatgatcaatcagcaatttattttttcactcaacaaagatctcttgctatttttagctgatgcatagtattcaatagtatggttatttcatatttcatttagccatttccctactggagggcattcagatttccaccttttgacaattacaaagaacattcttgcaaaacgcattgggaatacatgccaagtattttttttaataatagatacttagaagtaggattaactgataagatatcagcatttttaaattttaatagaaactgccaaattgttctccaaagtagattattcaatttacactcccaccaacagtctttgagatcccacgttttttcctcaaacagccttatgttgtcatcaatttccctgtactagttgtcaatgccttttttccctcgagaataccttctatttcttaggcagaagaaattaagaagagcgtcagtgagccgggcgcggtggctcacgcctgtaatcccagcactttgggaggccaaggcaggtcgattacctgaggtcaggagttcaagaccagcctggccaacatggcgaaaccccgtctctactaaaaatattaaaaaattagctgggcatggtggcaggcacctgtaatcctagctactcaggaggctgaggcaggagaattgcttgaacccaggaggcagaagttgcagtgagctgagatctcaccactgcactccatcctggaaatgggaagatgtatttcacattgcttctgagtcaatgttcaattttagctctttaacaattttagttgaccaagcatttcccaggagtctctctaatatgacaatgcctacacattatagaagggttttgagaaggaaaaagcattaactttctttttcggtaattttctggcactactcagtaaaatatgttttaaattgcttttcctataataaagatagattgtgctaagcatgtattctttgtgcctagtccctcttttacacatcagtgtagaatttgtaatgcctggtcaggactctattgctagtttgtgtaactttttccttgagcaaaatcaatggtctatagataaggcctcagctgtaaacttactgaattctggcctgacagcagtgttgctgcagcatccttagataagtagttttatgtgaatgaaagaacaggagtatagttttgattaagtcatatttgtcctggagcctgaggcgagccaaccactctctagggctcagtttccttatctaaaagcgatggtgagctgagcgcagtggctcatgcctgtaatcccagcactttgggaggctgaggagggtggatcacctgaggtcaggagttcgagaccagcctgactaacgtggtgaaaccctgtctctactaaaaatgcaaaattagccacatgtgctggcaggtgcctgtaatcccagctactcaggatgctgaggcaggagaatcgcttgaacctgggaggcagaggttatggtgagcggaggtcacaccactgcactccagcctgggtgacaagagttaaactccttctcaaaaaaaaaaaaaaaaaaaaagacggtgatagaacagaagaccacaaaggtaatcaaaccaaagttgtaattgaaaaaggagtgtaattcctacatgattggtttatgtaggaactatgtcttacttagtggttaagtaagacaaaagtgaaacaataaaaatgtatgttggaacaaggcaatttctttgctgcatctggaaagtctagaagactgtttcccccagattttttgtgctacttacaatttaatggttgcagacatgatgtacaactttaataacattttcttaatcagtttgtagacagtcaacaccattaaacaaaaaatcaattcctgggccgagcgcagtggctcatgcttgtaatcccagcactttgggaggccaaggcaggtggattacgaggtcaggaattcaaaaccagcctggccaagatgatgaaacctcatctctactaaaaatgcaaatattagccaggcatggtggcgggcaactgtaatcccagctactcaggaggccgaggcagagaatcgcttgaatccaggaggcggaggttgcagtgagccgagatcgcaccactgcactccagcctgggcgacagagcgacactccatctcaaaaaaaaaaaaaaaaaaaaaaaaaaaaaaatcaactcctgatttgtggcgtatgctgatttccatttccattgtataaatacctggactaaagctgattttaagctaccaacgttatatcagcctatgtggagttgggaataacatgtcattttatacagtgtttccatcatacagatgcaataaacaaatgacctcacaaacagaaataacagaatgtagtaaaacacttaggaagggatgagagttttgagtatgtgttatgtttttcagataacttgaagtttacataattaaactttagataattgatgcattaacaatttgcttagcaaatttctggacatttaaaaataggttcctgtgagtcagttcagaccaactctaaaatactgctgctttttcaccatatagacatcctcgagtctgaaaaacctgttcctttgtgattttctaagaactatgttgttttgattgatttttagaagttctttatagtttctagatgtgaggccttttcagatacaagtattgctaatatcttaggcttagtacccactttttaaacgggaacttgacaaatctgggattttagtgtagcacgtaagtgttcaatacatgtttggttaaataattccccgtaaaagatactgacatggagagattacatgagcccctggatacttaagccatatattacttttatatggaaccatttcagagaaggaagtctctcattttgtcttaatagcatgtttcactatctcacaggcccataaatagcctactccagtgattaccaccttttctggagttgcaagaccaggaagatcagaatcacagacttttgagattataaaggaatttaaagtcctaatggtcctgtccaccttactagtatacattacatatgatacccagcagcatcctttctgccaaagtaatacagtttatgcattcatttaagaaatagtaaatgataagcaattttgctataacaactcatgagaattttatgactgtatttggagacttgtgggaataaagaccagcaatgaaagacaaggaaatgtaaatccaatttatgtaatagaatatgatgacccaacatctcctttttgctctgtgggtttatattggccccccttcacccatgctttggactttaccatttccttctcttcctcctccaacttccctttgcatcctggccccttccaaactatgtgagtatggatgtgttaatgtattactccatccaaaggactataactcatattacccaggagattctagaaacaatgtctgaacacatcacagaaactaaaatgaggagaagctcaggcactagcagaaggcctggttttggtattcttccatctacagctgtacagctgcattcttaaccttggctgcatattagaatcacccggagaattttataaatttcagtgcctgggccacaccaccccagaccagataaataagaatctctcagggtgtgacccaggcatcagtttttttgtaaaactcctcaagttattcccatgtgtagtcaagatttggagccatcccaggttgaggtgtattgatataaaccagcatccacatctataaattaaggccatttattttacacagtcttgaataaaaaatgagcatctgtcttccactactgtgaggaagcacagtcccttaaagtaatggtaggtaataattctttccttctctgggctacataatcttggctcttctctcatgctttcactctcttaaacttccttcctcaggctcctgtaccaatcttcaattcacttgggatgtcctagtctaaaacatttatttcatttgaaaggaaaaatatcaatttctatctaaattggagtaagattccattcagatgtgtttatttacaaaacataagttgttatttatctgtgtttaattgatcctggaacattccatgtaaagaacattccatgtaaagaaccaggcaacttggccaggcatggtggctcacacctgtaaccccagcactttgggaggccaaggcaggtgaattggttgagaccaggagttcaagaccagcctgggcaatatggcgaaaccctatctctacaaaaaattagtgggtatggtggtgtgcacctgtggtcttagctatttgggaggctgaggtgggaagatggtttcagcctggaaggtcaaggctgcagtgagttggtaattgggccactgcactccatcctgagtgacagagtgagacaatctcaaaaataaaaaaataaaaataaaaccagccaacttgtctgagctcacaaaggttttaggactcatctgtgtaagagagaagtcactgcatatcaggaaacaggatgaggagttccctcccataacccacagctctccaagagaacaaagaggtacatgtctctgattcccaaaagtaacttcctttttttttttttaaaaaaaaaaaggggattgtgcttttcaaatttatggatgtaaataaaagacctcaggaattcatggattaggagcaaaagattaaagtcagtacaaatgatattctaaataggcagaatgggttcaaattcctctcaattctttctgattgaatgaaaagtaaagaataaaatctctggcagaagaatataatgaagggcatggtgtggaacaggttgaaacctgcatttctcaaatccgtattgtataaaccaggcattaccttttgtatttgttaagctaatttgttttaatattagtattgaaaacatgtttgggttgctattaacataggaattaggcagtattttggagagcctcttttgagggaacaaatgtacaatcagtcattaaaaatgtaaaagaaaatacaaattatagttttctagcaataaattgatatcaagcctgttttaaaatgggtgatgtggtttggctgtgtccccacccaaatctcatcttgaactgtagctctcatgattcccatgtgttgtgggagggacctggtgggagataattgaatcatgggggcaattttccccatactgttctcatggtagtgaataagtctcacaagatctgatggctttataaggggaaacccctttttcatggtttttctctcattttctctcatgtctgccaccatgtaagacatgccttttgccttccaccatgattgtgaggcctccccagtcacgtggaactgtaagtcccttaaacctgtttttctttataaattacccagtcttgagtatgtctttatcagcaatgtgagaatgaactaatacaatgggcaaatatttaggaaaattttactcaatacaaagaaatcctggcctcaaaactgacatgatttttacatatacaatatcatgtacaaatagtttataacttaatccacattctcttctttcataagcatataagaagaatacaagcatacctgtggtatgggaaatggaaagactacttactattcccaattttgagtaaacctagctttcatttgtgattataagaaatgtttttcctagtaaaattctgaccataatatttctaaaaattaacacttcattcattgattcactaactcattcatacagctaacgtttattgagcacctactaggttctaagaatgtattagtggaaaaagcacaaagatatatagatctggatcactgacctctcctactactcagaaaggaatctgacccattatgtaacagccaagaatggtgagctactgaaacactctttcacctcttggtatttcagaggatgaatatgaggaagaggatgctatgtacatgattagtggacagacaggtggctgttttaagaaccacctctagacaaaataatttgcaatagctctgataagaaagatgtcaacacaattagcttttgcatgcattttaaaaattttggtatggactttccagtgaaggttttgtaaactgatatctcatccataccgaaggatggtaccatgtttttgccggtggtactctaatgttcaaatttgtgaagtaaagtatgtggtttacttgtgatgcaactcctgcatttgttgccaatggcaatggttgttttcttcattaggtttcatatggttggtcaggttatgtcatgagaattgtattgagaaaaattatgagtttgttgagtgccagctctctgcagtgagaatggttggggggtgagggtggggggaactggcagtgtttcttctggtaggtgaacagaaatgcagactcgtgggcactctacacaagcctttccacatcaactggcctcccctctccccatccccggcatctattttctagcctttagaaaattgcatacatgtgtctggaaagttccatcgatcagctctttctgcagcactccacatttctgtggcttcagaaaaccttgaattgtaatctccctcttctctcaggatgcatcactgagaaaaacttaaatcaactataattttcaacagattctaaacagggatttagaaagataaggtggttactgaattgaattaaaataaattcaggctgtagtccaattgcttccagctcttcccctccctctgtgggctaacaagtgtttccaaagccatagggcattaagaatcctgaaacagctaattaacagggctgctctacatcacatgaagcatgtgggttccaggcagctgtaaaacctcagcttcctgaggctatccgagtgatgatgaagcacttggaattggatcttgacattctgctacctgcctgtggcagaaaataacctttttaacagggactttaggcgaggatagtactttgggcacaaaaaagtctcattgccatgactatgaaaaagtacatgaacatttcctcatgttcagactgtgactcatgactggcctgttaacggacagaggaagcctcaggcgttctcttgacacatcgtccaaccaagtgaaatacgggattggtgagatgctttttcatagctttgaatcaagtatcttccaaaaggcagataaaaccaagataaaagaggtcattgatgccctttttcaacatttttttttccacctatctaaagatttcgccaggagaaatagagggctagcctactatatttcacagggaaataaacaaaagcgataataaaaacttagcattttttcaaaaacattggacatgttgacatgaattggtctcatctcacatagatctgagtataaattatgtgctttattaataaaatattctgtcacactgacaatgtcttatctcttgcctccagcctataatccatttcccataacgttataacaaaagtctttctaaaacgtgtcattcctctacttgaataaccttgatttcttcctctatttcatggtagataatctgcacatttcttatgcgccttataccaaggctttcactaccggattcacagctctgtaacttcgtctcaggggactggggagaatattctggagctacagaaatttagttgccgacatgccatgtccatttaaacctattaccacatcttcccattcactttctttctgctgagttcttcgttttatcttaaggtgctgattcaatgtcacttgctttgggaatactttcttcacctctcaaacagaaggaatcacaccctttgtcacttgtattcactactctatcacccatacacatgggtaggtctgtgacttacctttttgtcccagatgtctttattatcatctgtaatatacagaaggaaggtgataaatgacttgctgaaggatagatggacagataaatggatggaattagatcattgaactatacctaaaagctcttataattctatatttttatgatttatttttaatgaggagcttttgaagtgattactagaaaatataccaattagcgaccacaattaatattcagtgacatttaaaatttcaagtgagattttaattcactccttgaatttgtatgtcttttatataggcatctcactacaacgaccttagaggtggcataaactgaaatataaaagctgggtctatcaagcaactaaaatctgatttgatggttaaaaggtaagagacacatcttaaaaatgcatatgtaaagccaaaagctgggaatgatgctaatatattgagtgacatataagcatagaaaatcatccacagatgctaacagtaggctgaattaaaagtataataggaacaaggtaaagcacaacatttacttaaaataacaagctatgtataaaacccaacattctcagcaatagaaaaatgaaaaaaatgcattctagtatggtgtatctctataagatagacatcatggaagactttaaaatgatggctttgatgaagtttaacatgtttaatgatttcataaaaatgttcatggtacagtgtcatttcaaagaaaaaaaagagacaaggtttgaaaaggtctagttaaagactatttgcaggggatttagtgacctctttggagagagctccttgtactgaagaaggagctgggcacatagagctgagcccaataacaaaaccttggctgtctgaaggaaggaggcattctaaatggaatatggcagctgcacttgaatgcttttccagggatgaatctctggatcctgggagaagcagagagcttttaagtaaagagatgttgcatataattccgtacagtatcaggaacaaagtgagaaattttaacatccattggagcagctacaaagccaaagcatggccttgtgatagctgcttgactccctgggtaacaatgagacctaataagccttggggagtccagagagctgctggttctggtggaagagcagtggttccaagaagggggatgtgttcctgtgggacacatttagaactcccagaaataatgaaatagattgtgtagaagaattgcttcagcaaatgtgggaaaaaactaatgaaatttaaattattatagttaatgtaacctcccttgttgcattaggctagaaagtcctggcaaaatttaaagattcccttacatagctatagaataggaaaaattagaaagttcacttatcaaaagcttgttataggtagtgatatgggctttacaaaaagaaaataaagtaaaaaatactcaataatgcaaaatccaaaataaacacaatgtaatcatagacctctttaacttcaacagtacaatactgtttcacagcaaacaatcacttcactgttacctgagcttggttaggatttgcctgaagtagacagccacgcgttttataggaacagagatactgatgaattcagaaatattttatgagagaagcgtctcccaaactgggaagcctcacctaagaaatatgctcagatgggcatgacagttgtttcaagtggtgaagaccatttccaggaagaaaattcacaaaaactttttgttcagaattaagaacaaaaaatgtgcaatacagagaagcaggctcacagctcagtataaaggctggtttctaaaaggccagagctgtctcatgacagatcaagctgcctggaaaggcaatatgcgttatgtcatctatgttcccaggaagaagctaccagacatgtgctcaaggcaagtcaagttctgtgccagagaagtgatgagcctgcgtgatgtctacattccttccagtgctaagattcaagatcctcagatttgtgtctggggaaaaacagtattacttggaatgattgtaattttcttggctatattgaagtcatacagtatatttaattagtcattatattcccagctttatacaggtatgaatctattcctcatgggagtgaaaactatgccctgaatgcatataaatggcattttaatctaagataaaatagaaatccttgatttagttccattagttctaggtctctgaaggtcttcatatttaatggctggcatctttacttgctccttcagggttctgcaaaacaggagtttggggtcagcgttcttctaggagtagagtcaggtcctgattcgatttcatccagaaccaaagttatgttgctctgattttagagtacacagagctatagcactgaagataattttgagccttataagctaatgtgatatttctttcagtgtgatcaatggaagttgaaaagcaggaagagttctttctgtacgtttctgcacttggtgggagtgtcattggagagagtttggggagggaggaactgacaccattcctgtctactttatgccaaacctgtgacagagacacacagagcctggagagctactggagtacctctatctgtagacgaggaaacaggagcttacaggggacagtagtttagtgacatgtagagcccaggttaaaacacagctctgtcaaatcaaaccttgtctactttcaaacaactgaacacagcaaaataattacatgagtgtttttaaatgttgtatttcagttattgaaaaaagaagccactcactcttattttggaattattaaagtagcccagaatcaagatttaagtggaaatatttaagaccaaaggcacatttttttcttaccttcaaaatatttcgggcttcatgtgaaactaaagcctttaataagttgacctcaaagattgaaaagaaaagcagataagcaatttcccggtaaagaaagattgctacaaaatcgctgtagactgtatggaaatttcaaagggtagtgaaaatgtgctctgatgcccaaagtgaataacaggatgtgtgactaaagctgttgacctacgaccagctaactcacctcagaacctacggagctgctgacgttacttctcattttctttctctttccccttcctctctttgtccttatttttgattccaccctctgcctccattctgcttcctcctcttcaatgctttctgtcatcccgtcttccttctttattgtttctctaattgagcctaatatgcaattcattgtgaaattaacatgaccctaatatgaaaatgtgttatagatcacgaaaaacttcctgtctactactatgtgtcctgttaaacccaggttgctgcaatctgtttctttctctgataataattttgctttcattgtgctcagcgtgggttcttctgagctcactccaccctcgccctgggatgtgtgcccatgtggtgagcacagggaggtgggagtgcactgttaattctcttcctaagaaagagaatgcgccttgtccctgtctgaggaagacttccgagtacacagactcagagtcctgacagtacgtccagcatcacagaaaaatctgccatggcattttatattcctaattgttcctaatgtcaacagaataacatccaagagaattcacataaatctcctgttgagaaatttactgttacaggagcttaatacttcgtaatgcatgtacagcctaaatatgttgtccttggatggagaacacattacttattaaaagccaggagaacaaacactctacttgatcttagccaaaggctaaaaagctatgaatataatggtgggagttcacggcgctgagagcaacacaaaaccactttagagaacctgcactgtgaattctggttcttctcagctgatggcattgcatgctttctttaacctcatgattctgtgttttagaatgaagacattgtgctgctaaccctcataaaagcagggtaaatgatggagaggccaagcacaccctcaactcgtattgacagaattatccctcaaactcccagagttatttgacattattaacatggtctgtagtattcattttatttattctttcaaaaatatttgtagagtaccttctcaattacagtcagtcacaagaccgggccctgtaagggttaaaaataaatactgaaatataagcaatatgaaataaattcctgcttctaaagttacaggtctaggagggagcagacagccccgggcttagaatcctaagacttgattcaagtgctgcttctgccactcactctctgagtgaccttaggcaactcacttacacctctgtctctcactttctctcctcataaatcacagattatatccagctcctgggatgttatgagacaaaacgagagaatgtgtgagaaactgccctgggtactctgactacacaaaaataatgcactgcaactaaagtattttcaaagtctagtataggatacaatgtgtggctccgaaacacaataagtgaaaatagaagagggaccttaaacaagcaaatggtgactttactaaagcagtgacaacagaactcagttctatgggctcagagaagagataaatccatgagtagtaagggtataaagggcttccctggggaggaaacgtggcacagaaacggaactaagattaattaaggatgggcaataggatggtaggcattattcccattgtactcatgtggaagctaaggcttggaaatatttcataacaagtctgaggccacagtagaaccaatacgtggcaacgcctacatttaaaaccagtttacttttattttttttcatttcaaattccgggcacttaaaatactagcaaccaactttgaggctccaagaagctgtgtgtgtgtgtgtgtgtgtgtgtgtgtgtgtgtgttttgaggaagtgggcatggagtgaaggaggaaagtaagaacaccacatggaaaaagcactaacaagggtggccaatgcaacaatgcatgtgatgtatttgggggattatggatggaaaatccagctggcatagaggtttgtgccgtgaaggagaagaacgcaaggtggtaaaagcatgctgagaataagtgaatatgcaaaggagtttggacattttccactacaaaataaggcctctttggaaatcttcaaacagaggagtgatctaatccaggtggttttaagaagatgggtttggcatcatgtaaactaattgactggggaagaaacagaacaaaaaggcccttgatctgcagagatatggctctggcttagggtagaagagacagaaggacaggaactggtatgaagggagatttgagaaaagagtgactgattggaattggaattggagctgaaggtggctgtgttaaaaaatgactgtaggcttcaagcttaggtggcagaaagaatgatcatgacattcacagaagtggggaagtcaggaggatgctgatatgcagggaagaagagtcagcttacacccattgagttcagtggcaagacagtcaaatggaatgtccgataggtaggaaatcagagcaagactagcaatctgactgcagactcaggagtccccgaggagcctgagtgagttccgtggaggtgcatgatttccatgggagcaacacactcagaggcagaatgactcaggaaccacgtcctgggagatgtccagcgtccagctgtgaataccacaaacttttgtctatagtgatgatgaaatattgactctggaattttggattttgtgccttaagggaagcttgcaaacggtggccaagcacctagagagagaactagtcatatgatttgtttatttcatgcctgctgaataattgtttagttaataaatgtccttatgtaaatcagaatttaatctaagatgcttttattctaattaggtggtgacattataaggaagtagttaactcctctcacctccaacttcactggcagttaccaatgtccaaccaaaacaaccaaaatgtgttcataataatattggtttaggtcagttgccaaaacagttgaacatgaacatctagccttttaaaggatgaagattcattcataatggttcaaccaaaaagaaaagaatggttttagaaatgttttccaggcacatttaatgcaaaggaaagctctagtaaaacaattatctgcttgacttgttcatttcacgtggatggggattagaccttctgatcaacacctgcctattcaacatttatctatatatgaaatggcttttttaatgtaagaattttttccccttaggggctcatagattaagccgtggtgacagagagcaattgcatttttaagtgttactacttaggtataaatggtgatcatctgatttaatccctatcccagtgggccatcatgaaaatacagctcatatatacagctcctgtggcgtgcaggacgttaccatgtggtatttgccaatatgggacattgcactcatgtgtatacacacacatgcacagacacacatgcacaggcacatgcacacacacagatgcacatacagacatggacacagacatacacacagacatggacagatacacagacacacacacagaggcgcacacacacacacacacacacacacacacacacacacacacacagacaactctagctatctctgaggtaattcaacaagccctgcagttggcttcatctttatattcagaacttgtttttttatctttcctttgaagagtaatcctatctgagacagaaagaagatgagtcacactgaggcaaaactttgtaggtagaaatgtgcataaatgcgcttctctaagatgctcatgaagaaaagacaaaagaacagccatgtcgctgagatgccatctgtgaggctggcacagtgaggcacgacatccctggtgcttcccggcagcctgcgagggctgcctccctccttccctccctccctcctgcttgcaggtccgctttcagagccttccctcagggcttatgttccactgacctataaatgtttactgtaattataccaattgtcacctcctgcattgtccaccattcttcttgcccttctctatttttaaaaattttgtcttcaaaatagcatgcttcacagtaaaaatctcaagtgaaaatataataaaacaaacaaaacatagttcatcaaggcattcaaaacaactctttgtgacaacagtttaaaaaacagtgaattaatgatgaattgtgcaaaaaaaagtttaagatgccatctctgatccttcatataacactttttttcagctggaaaaatccaagaatgaatgaaagagcttgtagataggcccagacagtgggcagcatggctcttctccagcctgggacacagctcatcactcagggtggatcctggagagaagctgcctgagttcagcctttgcctatcccagtactcactgtgtgcacccagaggagcttctgtgtatctgtgagaccctgtttcctcatctgcaataccaggactcatatcctagcggggctctgaaaactagatcagctaatgtaaggcttggccatgtattttctcaagaatcgttgctgtgaaagagccagtgaagtcacagagggtaaagtcaatggtcaaccttcctgattaatgaatattgattgagcattcaccatttaatagttagctccttctaagtctaatcgtttttagtttctcctgacacctgtcatgtaagaggctctatatgtgaggatagacttagggggcagttggttcctctttttggacacagaacaggaagaataaagagatctcagaaggaaaaggaaagtgggaggaggctgggtctgtgggttccccggtggatcacgctgaaagaatacctggcagacacttaatctctgcggcaaatgcatgaaagtagaaggatgaagccaactttccaaaaacttttatgaaattacttcagtgagaaaacctattaaataaattacagccattctataaaaatagaattctatgttacttctatatatatacttctactatatatacttgtactatattacagtagaaatcagtcaatccaatcccctattgggcagaagggaaacttgcctcggaccacactgtcggctggggtccttagcacggtactaggtctccacctccatgcactaccctggttcagagctggtgctatgggttgaattgtgtccctgcaaaaataggctgaagttccaaccccagtacctcagaaagggactttgcttggaaatagggtctttagagaggtaatcgagttaaaataaggtcattagagtgggccttatctgatgtgaggggaattcttataaaatggggaaatgcagacacacacatatgcaggaggaaggcactatgaagaaacaaagagagaagacggctatccaaggagagaggcctggaacaaatccttgcctcacggttctcagaaggaaacaaccttgacaacacattacttttggatttctggcctccagaactgtgagacaatgcattttggctgttgtaagccacctaggttgtgatacttccttacagcagccctaggaaatgaatacagctggggaccaggcttttagtcaaaagatcagggaggaagtctggtgtcttgggagaaatttctagattataggagtcactgaatatcgtaactttgaaaaatccattttgaatctcaccagaaacacaaaagcctgtagaaatccaattatacaaatttacagtctagaaaaggaaaaaaaatgaaattactcttcatgcacatttaagcagagtttaggactggaaaataaacaaggctttggtaactggggagtgcagtgctaacaacacagttgcaggtatgtggctgtgtgggtttgagcttggctctgccttttaccaactccgtgaccttcagtcactgcccccactgtcttcagctttctccaaaaagagtgttgtgtgtcctcttggaggccataccctggggtgctcagcacagggtttcacacacagtgactattaactggattttagctcctattataattactaatagcagataattgccttattaaaaaaattaaaggcaagcccccaaaagttaagaacatatgtacttgtttgctttttcatcttcttagatgacacttattttaagttttctttgtatgtaattcattctagctctcttattcagcagtatttctttcatttgaaaacagcataatatttagatgccaaatgtgatcatcaaatgcaagaatatggatatcccactaagctatctagttatgctcaaacccaaacaagtagaaagcccttatgtacaaagtgattcttttcatgaacttggaaatttttcaaaatcaggttgctgagttctgatttggagcagcctgtcgcaataccaaatcacctttgaataaacttatcctctcagcttttattgttcagaattgatttcgaggatagaaattccatttccttgtcatatatacctgagccgttgcatcaaattgtcagatcaaacctaaaatgcagcacttcgcagatggaggagagacattctctctaaaaaaaaaaaaaaaaaagtcaaccaagtcagaagttgtgaagctgctgaaaaaagcaaaaataaacactcttaagcaggaaaatagaagacctgttgcttgtgggaaatagattttctagaagttagatcagctggaaatattgtcatggacatgccaaaaggcaagtgaaggaaatgtactgaatgttgttggctttgcactaagaggatctcaggaagcagttcacaagagtgccaccacatgcatggaaggaccagctcgttagatgctttgggcaaataaaaattttctgtagagttattttgttctgctggagccattaagtgctccttgctacatgaaatggtatatagcccttcaaatgggggcatttagcaatataaaatatatttaccctgtccgttcttgaggatcactctttaactgtagagaatatgtcttctaaggcaccagagacatccagagatagagggctgctgatattaataacacataaactttgggtgaaggcataggggaagccagccctcactagaactccactatgcaggcaccccgatctcacactgccagcctccacaaccgtgagaaaataagcatctgttgtttaagcataccctctcttcatagggattattggagcctagaagagtgcatggacacttttcattattattattattatttactagattatcaccccaacagaataggaactgaattcctttttgcaagtaggtgttcaataattatttgttgaatgaatgaatgctatggctactatatggaatttctaggtcaaataggagcagaaggctgggggtatgggggcttgcacttgtaatcccagcactttgggagtccgagtctggaggatcacttacacctaggagttactagcctgggcaacatagggagattccgcatctacaaaaaataataaaaaatagccaggtgtggtggcccgcacctgtaatcccagctacatgggaggctgaagcaggaggatcacttgcacctgggaggttgaggctgcagtgagctgtgattgcaccactacactccagctgggatgacagaacaagtctccatctctctctctctatatataaatgcctgtgtgtgtgtgtgtgtgtgtgtgtgtgtgtgtgtgtgtgtgtttgtgtgtatgagacgaagagcaaaattcaatttagtcatcgtacccacatgtaatcaccaaaaaattttttttaaaagctatttataaccaaaaatatcttctatcaagttgtggtaatattacatgaaagcccattttgttctgctgagcacttgcgtagttctgggagttaaaaggtggatggagcaggagagacgtaaagcactaaatgccattaagtaagaaaaatctggagttcctataagcaatttttgaagtaggagaggtacggaagggtaggaatgaaagaaaaaacccaagcaaacctagcaaaaggctaacaccttccatatagaaatcactgggtaactgactttttaagaatatgaaagtctaaacacagtcacttctcacattatggtgaacattgcttccatttcttcaaaccatcagtaaagtgtggtacaatgcagaaatcccatgtgtgaacaagttttgttttgttggggcagagggaaggctggtggttgggaaaactaaggaaggggctcagttctaccttgagcctctgtggtatggaaaaaagagatgatgacagctactgtgagagaactcctaaacgcaaccaatttggctgaagcagagatgtggggcctggtgtgatcaaggattcataaaagctttggagagaaagcagaacttttcacaatctgtacgatggggattgcagccaattttatttagccctcaggaaatagggtgaccccagttgacccccaggggaaaaaattccctatctcataaacaataaaaatcttaactaaagtttaatatgatagcaaccagaaacaaggcttcctgttgtcctcagacaaccgaaagttcatattcacacacccaagtaaccacacccccagcccctgcactgtgcaagtgaacagtttcattgacaactttggggtctgttttgatcttggagatcttggagttaactgcagagaatgactggagtggattttatgaagaggtattttataaatgcttatgtgtaatgatgagggaaattgaagaaagtgaaacaaacagtaaaaccacatgggaagaattcccgcagaacatgagaaacagaacttgacttaatgaataaaataacagatggcatctcattttttattgggtgtgtaaagaatgagaacctgaaatgcaggtttggttattcaagtgaattagtaaaggagatttatggttttggaagaatcagcagtcatgggggggcaggaaatggttataagtgacttttagattctgtgcttgggtgactaatgacaaacatagcatagtaaaccatcggaccatatcatgcaaacaggctgtgtgaattaattttgttttgctttgtcttgctggggaaattagaaggcttaaacaaagcagagagaagacatctattggattgtccaaaatactgtaaaattttggcaatgtggtatctataccaggcaactacaacttctgtcttatttggtttagatacccaaggaagtacaggggtactctgaaatttacttcgagatacaaatcttcaattattcacaagctggcagcacaggtctttaagtctattgtccttgtacttccctagaacacatcatcttggcaccagatctgctttacctctcagaagtttagagcaaaattctacgaaaggcaggacttttaacactccctcactgtggggtgtttaaaaagactattatggggagaaaaatgaattgctgaataagtagtatgtggaagaaaggtctgtgttgaatgaagggaggtctagtcattaaaaaagaaaaagaaggctcaagccacagagtttttatcgtgtgcctcagccactggggaaacagtttcagtgcagtattatatatgaaatgtttcctattagaatcaaagttcccacaatggaacatgtgcgacaatactaactaaacactaccatctagtggccagttttgagaactacaaaagctcgcaaagtgcattaaaaacaccgtgaaagaaatgcaacaaccaatgaaaagatgtttaattttcccttagtatcagggaaaataattgatcacactatatagtaaatgaagatatgtgtatcaagtgctgctattctcaattacccttaaaacttagatgggcttgcagggagtctcaagtgcatgttttgctgtttatagcaccagtgtagagatatttccaccaatgacaaataggctgtaaaacataaaatcctttagaaaagtgataaaaatacaatcagtatgaggactttgcttcctcttcccctccccacccctacccccctactatccctcacacctaacacctctcacaagttgctattgtatagctggcatagctggaggagtagaaagagtgagctcacagtcagcaaagctgtgtggtgcctttgttccacacacttctggctgtttgagcctaggttagtcacttaacctttctaagactcactttctaaaaatacgcaaatatgtaaattgttgctcttccagtctccctgggtttaggggaaaatagaatgtgtacaaaaatgcattgtaaatgcaaatgtgccatacaaaattgctattagttttaaaatctctaagtgaggatgatgaggatgtgaatctgatatttgaaggtgctaaacatttttttaattttttttcaaaaagccatttttcttaatattgttgatttcctgagacaaatatctttgatctgggttgaataattgtgggaattctcaagtttatcctgcccctatacacgcagcaaaagaaagctaattaacttgtccaaatttttacattgaatcaaagacgagactgagaacaactgtcatagcttgagtgttgaagtttatcaatctaggaatcctattgtgttgttaatgtttccccagtagtttcagtaagtaatgtaaacccatgaatctaaattataaaatggctacaggtaaaccatgacaccaaatttcacttcatatttcattattctaagatacaagggcagaacctaaagaaagggtaaaataaaatggacttacattagacttactgacaccatcattatttgagaaagagctatttcctaggtatattttaggaacttatctggtgatatctatctatctactaactttaggagtggggtggaattaattctttttacaagattagtgaagttagaaacaactagtttctaattgattaaatgtaacctattttcaagtatcttcatatgactgaaatcaatctgttttattttccaaaccagtggaatagacacagagtcattacaaccagaatgacatggcattgttacaaatcttagtattaaagcaatacttctgtttttatgtataattattttataatggaaaatgtccctcaaaatcagacgatttgttccacaatgaatcatctactccaaacaactctgttccaataattaatgacaagaacaacaaacacttacccaccagatccttatggtaaagctaacttcagacaggaaatgcagaactcagcagagttcattatttttcatttctagatcagaacaagtttatctaagactccaaataaagttcatgctttgtgcaacgtgcaaatgacagttcattatattttcttgtttcacagagaaaaactcagaaggaaaacatctacaggagatacaaataaagaagggctaggtgtttctgaaaataatcttccagaaaaaaaaagtggccctcttgaaactcatcaggaaaaaaagtacttaagaaactctaaaacatttttatgtgttagaatcaccggggtaattttggcaatctctatgcccagatcacagcccacatcaattagaagagaacctctgggacatgaagatcagttttttgttttgttttgtttttgttttcattttttttttaaagttctctaggtgatgccaacacgcagccatatcccacaaacactttagttaagaaatacatactttgaagcaggaaagtaatgccctttttggggaaaacagtcattatatgatcacagattatttttataacttccatattcttttttttttttttttttttgagacagagtctcactctgttgcccaggctgaagtgcagtggcgtgatctcagctcactgcaacctctacctcccaggttcaagcgattctcctgcctcagcctcccaaatagctgggattacaggtgcaaaccaccacgctcagctaatttttgtatttttagtagagagggggtttcaccatgttagccaggatggtctcgatctcctgacctcatgatctgcctgcctcggcctcccaaagtgttgggatcacaggtgtgagccactgtgcccagcctccatattcttacatgagcaagaagcaagaattcattttatcagtatgtaaattgtgaaaaaaacacatgcaggtgagaagcaggggctataaggatgaaatcaatgggccagcagagaatacagtgcatgaattcaatagtccctgcagtgctccctgctaggcagtgcagggatatagacaaatagtggcctgatgtctttaataagctgataaatagttggggccaccaatatgtaaacaaagcaagaacatagaaaacacgctccaaatgggttacaagcagagttgtggtgtagggcagaggaagataatagatgctaatgatttaggatggtaaatacgacaacaagagtacaatctctacctggttgattccaaggagtttaaaaacgtaaatgcatgaatgaccagaggaatcctcaccaggggagtacggcacaggaatataaacgtgacttgatgtgcaggctctaaggcagtggttctcagaatgtggagccaggtctgcagcgtcactatcacctgggagctcattagacggtacataattggatcccaccgcagacctacaaaatcaaaaattctggggatggggcctagaaactccttttttttttttttttcaatttgtctctgccacccaggctggagtgcagtggcgccatcttggctcactgcaacctccgccccccgggttcaagcgattctcctgcctcagcctcccaagtggctgggattacaggtgcccgccatcacgcacagctaatctttgtatttttagtagagaaggggtttcaccatggtggccaggctggtctcgaattcctgacctcaagtgatccgcctgccttggcctccgaaagtgctgggattacaggtgtgagccaccgcacctggccccagcaatgagttcttacaaccacttcaggggattctggcactccaggtaattctgatgcatcctaaagtttgagaacgagtgctctaaggttttcttgaaaataaacaaatacatgaaattggccattttatcatcaacattcactaaagtagatggtagtatgtattcactcatgcttcaacacagacaaggtcacgtgggctaggaaccattccacaggacagcaatcttaggtaaggtcttaaaataggaaatagaaaattagttgttttaaaaagtgagggagtaaacagtaatattaatgcaaacttgctgattgcaggtactcaaaaaatagttacaaacttgtattttatatatagcttataatattttagacttctggaatgaccatgtcccactttctttttaatccctaacttttatttattcattttctatttctatagtttttggggtacagtgggttttgtttacttggacacattcattagtggtgatttctgatattttggtgcatccatcaccggagcagtgtacactgtacccaatatgtagtcttttatttctcaacttctcccaatctctcccccatccccaaagtccattattcattcttatgcctttgtatcctcagcgcttagctcccacttgtaagtgaaaacatgatatttggttttccattcctgagttacgtctcttagaataaatggcctccacttccagccaagttgctgccagagacattatttggtttctttttatgactgagtagtaatccatagggcatatataccacattttctttatccactcgttggtcgatgggcaacaagtttggttgcctatttttgcaactgtgaattggacaggcctgtgcatgtggtctttctcgtagaatgacttctttccctttgggtgaatacccagtagtgggttaaaccctaacttttaatgtttaccttaattttaaaaatacaatcacccaaaaccaaaaatgaataaattataactccattccacacttggataaatctcacaaacctactcaaagaagctaaactcggaagagtatacagaatattacttcatttcataaaacttaaaaacgaggaaatcccccttgtttttggtatcagaagtccaatagtgattattctgggtgtgccaatagcgttgtttctttttctattttttgttttttcttttgagacaaaatctcgctctgtcacccaggctggagtgcaatgacatgatctcagctcactgcaacctctgcctcccaggttcaagcgattctcccacctcagcttcccaagtagctgggactacaggcgcacaccaccatgcctggctaattttttgtatttttagtagagacggggtttcaccatgttggccaggctgatctcaaattcctgacctcaagtgatccacccgcctcggtctcccaaagtgctgagattacaggcatgagccaccgtgccctgccacattctgtttcttaatctacaatacatttgaaacagaagactttcaaaatgtatgtaatgaccctgtgtgtattccactggtttggaaaataaaacagattgatttcagtcacatgaagctacttgaaagtaggttacatttaatgaattaaaagctagttgtttctagcttcactaatcttgtaaaaagaatcaattccaccccacccctaaagttagtagatagatatcaccagataaaaggtcctaaaatatacctaggaaacagttctttcttaaataatgatggtgtcaggaagtgtaatctacaaagtccccttctagttcaccctttctttagcttctggtgagccaagtgtgttcacttagtgaaaattcattgacttttacacttacaatttgtgcacctgcatttatgtatgttttgatgcaaagttcaaaaaatataagaataggatgaatgctatgttagagtttaagaagtcaggacattttcacttccctttggcatttaaagatgtgttggatgttggggtactgctctcagtgaatgctggagacaggcaatggcacatcatccaatacagtgaacaaaggcaagtggatagggatatttagtccttgggattctaaaaatctcaaagaagaccacaggaatgaatggtcagtttctgacgatgcaaggcaatttattctggctctaataagacctgagttaggacaaggcaaaactgtgaagtagatgagattgtgaacagtccccgaaataactgttgggtggcctgtgcctgcaagcacttttgccacctccccgtctgtcagggtcactctcctattgagtctctgccactgtttccagccattctccaaatcttgatttaatgcttctttgcccctctcccactattcctccctactacccctcttatcctccttatctccttccttttcatcaaaacctacctgttttctgtttcgttatctcagaatctttgttattagccagttcaataaaccactgggctccccagccatgctaacaggcaggtcagagctgagaagctctaagctggttatgaaactgagggagcttcactcagacagcgttcctctccaaagccatatctggattttactggggcctgaggaccttaatgaaagggggaaccaactcaccttggagcagaggttctctggctagcgcagaggtggcacagtattgacttgctctacctcactgttgtcactgatgtccctagacataccctgagcctttttctggagacctggaaacagttaataccagagcaagtccccacttatcaaaaggagcagcctgccaaaaacaatgttgtttttagacaagtatgttttaaggcataaactgaagggctaatggaacagccattgttctaatggatttttaatgaggtgtaaagttctcagctgattgacagtcaacaaggtgtgaaattttacagaaatattgcattactgtgaaattaatctcttttattcaagtttattatttcttgaatctaaaagtcaagaaaagcatgagaaagatgactattaaaatttctacttccctataattaataggaaatagttacaggactacagttaataactatattttttcaaatatttttgaaaattgttaagagagtggattttaagtgttttcaccacaaaaatgataagcatgtgaggttatacatttaattagctcaatttagccattacacaacgtgtacatatttcaaaacaatatatagacaatgaaaacatgcaatttctttaaaaataaaatttctattttcctttaaatacgatttgaaatcaagagaaaaattatttttcttggttttattttatggagaaagttatggaagtggaagggacatcataaaggcaggacttttctgagctcagtttcattgactgcccaggtgccctgggagtgataatgacctagtagcaaccaacgagcccctttctggccagcactgtgagatcaatgctccagggcattgggttctaagcccagggattcagcatctaagccacttgggttcaatacccctcttagaccagacaaaaagaggtcctgccctgggagccttagaaggcccactctttcccttctccagtcctgcctcttcctttgcaggatccttggaatatggtcacgcagagccccaaaccaatgtacttttagaccgtgacctgggagctcatggcccgtatcagctaacagggcctgtggggtcccatttcccccatgcttcttctagagggcagacatgtcaccagtgtgcacaaccctatgcctgggggtggctacatatgtagtatgagggtaggaggtactgggccaaaacgcaggcacctgggctggcttgtccccacacacacacagaggtgcttcgtggttccagacagagccagatgggaagagaagagcagagcgggtggccctttccctcaacactgagggattggaattgctgaattggaatccggccttccagacaattatgaaagcatatttgtcaaggaaaaaggacagacctttaacactgagggagcagatagaaccgaaacattcaggttctgcatttgaacttgatcttccaggtctctgtataggcttaagttgtcaaggaagtaggccagagcttccttcacagttcattaggctgatttacaacttttaaatatttagacaagtggtatgcaggctcccacctgtattcttacctcacaacctcaaaatttcagaagcagcctgctctgagccctacccaagacctacggagacagacgtctgtggtggggttgggaaatctgaattttaagaagctcttcagatgatggatgcccatcattcatttgcctatcactaccttagacccttatctccactgtcattttttaaatgctgagtccatgtgtcaacaaagtagcgttgaataactcatttgtaaaaagtggaagcagaaaaatgacagatttcactggaacactaggcatgtgccaaacccagctctgttctgctcaggaaacaggcttcctgagcccccatgggcttgtggcttccagtctgattttcctcagcccagtgacatcctgtgggacagctgtcattgtcctccatagtcattccaacttcagataatgctccctcttcaacagaactttctcttttaagattggccattcttacttcctggttcctgaggccaatttttgacccaatatctattttcttctcctaattcctctactctgcaatgcccaccattttggttttaacatacaagtgtttaacccagagctctttgatttctcctggtaggtgagaaagagtatttgtttgggcaaagcctgctaataaaccagcagtacattgagatcacctggggagtcacaaaattcccaagcctaggccccattccaacctgttacatcttgatctatgacgtttgtgtgtgtgtgtgtgtgtttgtgtgtgtgttaaaagcatggggaacagataagtttccattattctgctcacacatcaaaagtttcaaagaacccttttccccagataccgagagattttggccattcctttagtatttttacagcattaaacaaagactgattatgaatataaccccagcttattgaactgtgtgcattctcttaatgcctgcaaatgctgcttgcaagagtggcctcacaccaaaatgtaccccaagttcttctgtaaagacaacttgcagccaaggacagctagcaccaacactactgtcttccagaattttaagtggaggctgaaaggctgaattagttaaaactcccaggccttcttggttaggacagtgttcttgcattcttttttttggcaggggggccgggggcactattcaaaacattccagtgacatatcgagtcactaccccgtaatttaaaaatataatgtaatatatgtactttatggaagtcgaagagttgtgctttaaatttaagtaccgtgccttagttggcgcctctaacatagggagttggacattgctaatgatttgccctcattaagcaaagatctttgagatgcttctatccattaaatactgtcaatgtgattcctattctagctagttggtatagagcaccaccattttcaaaattattaaggaaaaatcacatctaaattaagccaaagggactagacccatcgaaagtgagatataaagggctttgggcaataaaatcaaaatcatttgttagttgtgagaaaacttaaatcttaccctctagtttaatttttaaagtgtcgaaggaactacaaaatacaaatttcccaataaagaagaaaatcaagaaaaagaagacagtactagaataaatcataccatttggtacatttatgtaccaaatttaccctgggtaattcctattttctcaatttcagcaaagaggagtaattttaggatatagtattgcctgcctggattataacgatgtgctaagaggctgagcatgtgtctcttatgtacatctccagactgtgcaggcggagctcaagttggatttggcatcaaggtccaagtttagtcattaatctattgatgaaaactgtactttattttcccccattgaagaagggacaaaattcaattccatcaagcagtcttctttgtacagctctattctactcctgacttagattcagagtcagaggaccagagttagtgctcactccaaactattaacctttcatctagggcccggggtccatctctgcctagagagcatgtgggaacccctcgattgctttattgcatcgtttattattacaaagaataatacacatattgaataaaaaatgtatactgcttgaaaggcaattaagcgacttctcataagtcacgtgaatcctgaaatgtctattatgttttagaaacccaaagataattgtaattccattgcctggttaagtcatgctcaagaaacacggtgctccttatggctgctcgtcaatcctctcagcggccagcagatggcgcacacttctcagaaacatcaaaacgtggcgtgggaaaacccgattccgtggggaaggcgggccgcctaacacaaagctgtctttccgtaaaaatcagtcggccttcacagggttacagaaaattattcattatgtacaagagcaatgacgttcagcaatgtatacagttgctgacagtcctaaagtgggatatggaacaggatggttcatgcccatttttacgtatttgaatttatttcttctctgggtactgtaagtaaatgaatgttattgatttttccttatgtgttaagtgctgcaccgatattttaaatgatgactcgtttctactgggaacttataatgaaaagatggagcagtagaaatagaaaacctctgggccatctccttggtcaaggttagcaggttagtcctttggtctagctctgccattcagaaccttggaccatgcatttgctcccacccctgggatccaccatctctccctggctccttccaggtccaccagcctcagggtcactgcagtctcagaccacctgaaacgcagaagccccgcctattttgctagctccctcgttcctacgtattcccatttttccggcttatttaaagaataaaacaatacaaactttaatggctatttgtactttttaaaaatcagtgcattttcatttgtgtactcttgtggatttgggcaacagctgaaaaatcaaaataatttgtatctttattgatcttgaacaaatgctctaagatgcatacatttagcagatggactcacttatcatgtgggcttcttttcccaaatgcagatgggatggaagttgacatgaggaggcagtataataagttaggaagaatctggacaaaggtataaaggagctaaacggaggctgcagaatgtggagtgaagagctgggacaggtaactcaaggagaaagcagagagaaggaaagtgatagcacagaggcaaagggaattgactgacatccagggaaatgtgtgaatttgtccagaatgtcctgaaaactttgtgccgtgggacagacctaagacctggactatattcataaaaagaaacatgattttccctggggaattttagaccaatcagaaagactcctaagctctgtcttttcaactttccactctacctcattatccaccaagctacttttcccacctctgttcaattgatttcggaaagagatgcacataccaaaaatatgcaagtctgccacagatttattctttctcactttagctgtgtcctcagtcgccattttaatcactctcaaagaatgctctcccatattagctacaatggatatttcaaaactctcttttcaaactccctgacctggctggtcttcactctcattaaatgatttcatgtcctactttcctgactctcagcctctctccatgagctcaggtttccagaaagcagtcatgtccccagcctctctgccttcgagaatgatcctcctcttgtctcaggctaacctcctgtccagctgcatgaagcctcagaacagagaagaaactgtgtgagtttcagactctggagttttaggtttgaatcttggagctgccactatctaggcacatgctcctaggcaaggtacataacttttctaagactctattttctcatatgtaaaaacgtggtgataatacaacctcctttgtatgatatgggaatttcctgtatgttatttgtgaaaacactttccctactacttagcaataaattccctcatatctctaccagttgactgtgaagaattttaagcccagaagtacattactttccccatcgtgagggttgagcctagcgcgaggaaagtgactgagtcctggtcccacaaacctgtgaacctaccctctcttatgtcccaaccactgccatcttttctgatagtaccattttgttctcatttttaggctctactatgttctcctgagccttacaatggcctttcctccctctgcatgtctgttcttggatgatcctgtgcactgtgataactctagtcttggaggtgaatctgaggtccacgtctgaaacctgaaaggcatctccttttatctactaccgctttcaaggagatgctcttcaggtgccactgattctggcatgccaaaaagttgcatctgcaggatggttgtagccctgtttataaattcacaggctcaatttcaagaccttatgagaccctcaaatgtatcaagtggggccaggcgtcatggcacctgtaatctgaaatcccagcactttgggaggccgaggcagacggatcacctgaggtcaggagtttgagaccagcctggccaacatggtgaaaccctgtctctactaaaaatacagaaattagccaggcgtggtggcgcatgcctgtaatcccagctacttgggaggctgaggcaggagaatggcttgaacctgggaggcggacgttgcagtgagccaagatcgtgtcactgtactccagcccaggtgacaaagtgagactccatctcaaaaaaaaaaaagtaaataaataaaaaagtaacaagtgagacaagtgagataaaactaaatccagtttataagaaagccattcctacagccaatgcaatgttatctcttatcttcaacctgaagcacaagctgatattattttgcaatcttattagcagctcaaacagctgtctctgccagtaatatacacaattgaagggatgccagagggcaagcaccgaacctggctgcaaagaaggggaaccgttccccaaattttgccaagtcaggctgctgtatttcatttaaagtgggagacataataatattcctaaattctgataccaatagggttgtttatcccttctatacctggaagacttgctgtaatattttttctcatttgtttctaagtacttaatatcctatgcagggggctattttctgggcatttgcttatggtccaaggacaatctgtttggatgcttacttgctgttctggttaagcaaacctaatggttcacaactcccttacaacaatcagggagttttggcaaagattactaaccaagtcaagtttacattggctcaagcctctcctacatgaatgccaccaataattgttgctgtctctttattacacgtctttgaggcactgactgcctccataaaactggagaaggcatatgtgtatatatactatatataatgattacccaccagtaccagctttaatgttttcctctccacctaatttctttttgctgttcaattttcacaagcatacacttgtacacacacacacacacacacacacacacacacacacatatgcctgtcattggttacctttcccccggggaattaaaatccgtatgattcaataaggtagatttatttgccattagcagacaaacatgaaaataattcctaagccaataaaattattttcaagtttttcagttttccttttttcttataatggcaagaacatttgactaagagtctagcaggggaaaatactgtattcacaaaagcaatgggaaaaaaactcaggcctgttaaggaaactctcctataaaatcaaattgcaaatttttcaaagttgccaatgcttggcacatcactgtctgggcaggataatctgttcttaccagtctcaactcagaaataacctatttatgattgcaaccatcatcttggcctcagggaggcactataggtcccttaatgtatctaaggcacagctgaaatacttaaaaattacctctgaaagtctgaaacatgacagaatggaaaaagaactcacagaagataacataaaactctatattctgtccctaagttaatgtaagagattcatacgccttaggaagacgagataatttagcgattgcgcttagaaaaataagtaaataaatatgagttagagatatggttggtgacactttttttcctctgggtctcttccttattttccccttgttccttcctggcactagggggcggcaaacgatgggctcctttatttataaaaaaagacagtttttataaataaagctttattgggacacaaccattcccatttgtttacttattgtctgtggctgcttgcatgctgcatcagtcaagtagttgcgacagagactgtctgtcccacaaaacttaaaatatttatgcttgagccttttacagaacaatttggctgacccctgcatgctatctatagtatttaacaatggatatgaaagtgacaatggtagatctaaggaacttcgatatgtgtccagccagccaggataggggccagcttcctaagacacatgtctagaatatgatgaaatcaccacctgccagtgagtcacatgcaggcaaatgacaccaacagaagaaacctaggaagcatatccagaaactataaagtattggtcatgaaccttgcaggggaggacataactggtgttcgcatctctgcttccagttgacagttcaccaaagataaaaacaacaaataaaatccagacctctcgccacaaaagggggtttggcttcaggcaggggcttagggctctctgctggggaccagctgcacttcacaatgctgcaaagcctgcatttgttcagaaatgtaattcctgatctgattataagagttcaaagctgaaaatgtggtaaggaggaggaaaaaaaaatgggttatgatggaagattttgtggtggtggtaagggggcatgataataataatattgaagaagtgccctagtaatttacatgagaagggaccaagaaggtggctaagaacagcacagagtctcagatatacacacgtttttgcacagagtctggctaataacacaaatgagagattttagcataataatgctgtattatcaaggaaatagacatcccatctgtggggaaactgtcaacatgagagataattgtggtagagaagagatctagaaatgaaggataacaaaagaaatgaaataataggcgcaagtccctggccctcctatgtgccacagtccaggggaacaggagagctgatgggagacctcggttgggaaaatcttatccattccaaaaggaggaaaggtcaatctctgaaactatttcatagttgattttagtattggtccctgaaaacatttcagaactcacttaatcagcagatagttttagaacgcaagagggtgaagttatgctcagggcagcaggcctggttggtgaggatggaccacaggtacggtgtggagggtaggtgggtaggctccagagctagtctgctgggttccgagttggctgtcttacttcctagctctgagacctctgcaagttacttaacttcgctcttcctcagtgtttttagttctcaagtgggcatagtaatgaaatggggtggttgtagggattgagttaatacatataaaagagttagaacaaatccagctgagactagtgccatgcaattgttagctagtgttcctggtacaactatcagaccaggggccaggagaatgctacagacctggctgaaactgaatttcaacaaagcatttcacaaatgcatacaaaatacagccaaggacctgctggaaaagtggtctgaggaacacaaatacatagattcatatttggttttacaactagaaattcatttcagcctaaggagacttctttaatttcaagccttgtgattatcctcagccctgtcctgatcgacatttttcatcaagaagacctgaaattattttattgtaaaaattgtgaatattgtgaagtattccaagcatacaaaaataactttcgggatttagaactgacaacaatgtggaaaagccatacatatctaaagcacgagtgaattctttcttactgaacctattcaaataaagactgaaagacctggcagtgaagggttggaagtgtcacatgaggcatatattgagatgaactttgaaaattctattcacacatgaagatgtttatgaagtattttatatatgttaggcattgtcttaggtacttggaatgtatgtaaacaaaataaacacctgtcttgttggacttacattcaggtggactccttaataacctgtaagttataggaattactagattttggtttaattctgaagtttgtcactcactatatataaacctgataagctccctcgtttttttctcatctggaaaatggcgataaaatgccatcctttcatatttaggatcattcattcgctcaacaagtacttcctactttgtgctatgctcttgggaaaaaaaatgaatgagagaaggatcctgccctcatggtacttgtatcttatattatccagaagataaaataaggcacttaccaaaaatactaacatttacatatcaatgaaaggctatgcctattatatctaatgatagcagcatggcctgtgagtctttggtcgtctttttggggatatacaatgtatattttggctgttacctaagccattctccaatattacacccctcactaccgctatgtacacagatagtctgctccacactcagaaaggtagggacaacaccctaggatttccataaagcttagaaggatttccttcctaagaaatacccagttttgctgccaaacactcctcccctcctacatgaaggcctgagtcaagagatatcgtgggtgggagaagttaccctgcatgtcaccagaacctcagcatgcacactttaaaatgaatttccaaatgcaaatttgttcctagatccacagcatggcaagtgagatgcagaagcctggttcctggaggaggagccagcattgattcgtggagggcagtgtcctctcacaggggtaagtgagcaggggtaaatcatcgttcccatgaactcctctccatctgctctccccactctgggaacactagtgtgctgctccacctccttctgccccctcctgggatgggctccagaggatgataggcagggcacctaaattcccagctgacggaaacgtgaatgtgctcagtagctaaaggtggctcaggaagtttggaagattagatgagatggttctccctctccctcatttagatcacacacattttccaacatgtaggggagaagagggagctctgtattttttatttatccaacaaatatgtattgaacatctaccatgtgtgggacagtgtcttaggtattaggaatacaacaaagaagaacctcaaatccttactggtatttagattactaataccgggaggagtgggaaagacacatagtaaacacattaatgacctattaaatatatgctgggtcaccactatggactgtattgcgtccctcaccccaattcatatgttgaagtgttgatatgttcccatcaattcatatattcctatcagctcatatgttcatatgttgaactctcaatgtcactatatctgaagatagggcttttagtcagtaaataagtttaaatgtggtcataagggtagggtcctaatctgaccttataagaagaggcaaagagctttctctttctccctacacaggcatgcaggcacgcgcgcgcgcgcacacacccacacccccccccacacacacacagaaaggccatgtgaggacatagtgaaaaggtgtctgtgtctgcaggccaagaagagacccataaccagcactgaaccaagctggcacactgatctcaagcttccagcctccagaactgtgagaaaataaatgattgttatttaagccaccccatctggtgttttgctttgtagccttgctaacactgtcaggtagccctaagtgtgctgaagaaaacccaagtggaataaaggggtggagagagatcaagagaggtggttagggagacactctgaggagggacattgagcagagagcccagtgaagctcacatgtatccaaaggcaagccctggcctggagtttaagaatggcaacactcaggcatggcagggtttgtccttagaagcaaatgggattgctgttttatcagcatgtttttgaaaaatagactgttctcttgcagagaggaaatgtataattggtgatcgcctagctgtgtgagcttgggcacgttccttaaatctcatgtcccagtttgctcagttgtgaaatgggataataatcatctttaccttgttaggttgttgggaggtttaaatgagttaatatatgtaaagtgcatggacccatgcctgaaacacagtcagtgctcaataaatagtagctattattattgctatcaatacaactactatctctattattacaacaactgctactactattactattggaaagccacaggcagaacattataaaagaaatttcagcaatggcatctttcaattaaatcttttctgagcatcttgggcctcactacctctgggaaaataactttgcttctttgtctccctcagctcctcagaagagccaaaccaatgattaagctcacgtgttgtgaactgcaaagtcatttgaacaatttcaaagccatcagtgacaaaggctttctcctgatggatctttctgcccattgaactagaacactcatggaaacatgttcaggctccctcactccatgtaggtcagactacaggtaaaatatcctttctggtgccaaaaactcttatcaggatgaagaattttcctctagtttccctggggaagagcaaaaaaaaaaagtagataaaaaaaaaaacacaagaaatagagtagcaggagtgaaggagaaaaattgaaaagaaagagataaatagggggggaattttaaggaccattagtaatttactgtggtccccaatgttgacacaagcaatcaaaatggacctggagaaggggattatatgggctgacattgtctactttgatctatacgtgccttatattggtagatctttaaagaagttacttggtataaagtttatttgagtgcattaaaatgagtaaataatattgaaaaatgttttcatccaggctatgcttttatggaggcaattttacaattacttaaagtgaagtgaaattgttttgaatctgccagactgtaagtttcctaagggtggaatctatgcaggttttattttgagtattctcgccttctcaacgcctggtaaaactgagttcataaatggtcaatagctgcttatctagcagttatctggcagcttcttgcatgttttcttcaaaaggactccaaatctactactttccatagactttcactttttttctcccattcttccagacttttttttcaacatgttgtcatcagaattttacacaccacagcattgcccatcaaacagacctattactcataaatgctgatgttatttctacgtgataacgtagagttgtcctccttgattttggtacaattttatggaaagcaggtggtctgcccatcattttattttgctttttggaggaaaacttgatatttggcactaggtatgactgtacaaaatcttcctcactaatgtgattacaccgtgagtcaaatgaagacttgaagggggaaaaagaattttgaaaatgaggtcctttagcaagactatttggacagtagctatctttcccctctgtagctatgaaattaagtgggagaggaggtggtaaaaaagaaccagaaattagaaagttttcaggcaagcgtgtgcaaattagaactgcagtagaatgtgttgatttctaatttgaggcaatttccctagagacaacagaggcgttttgaaaagaccataggatttatcatcagaagccatgcattcattttctgctactgctgcatactagtggttttgccttcaacagtcatttgaccttgaacagccccttggcctgtcagaaacacaatgtccgtgtgtgtaagatgaaaacaacaatatttgcatcccacagggatgatgaagatgctatgggtgggggctttatgaacaatcaaccaagatttaaataccttttccaggattcatctctatgtttctttttcttgcctctcccattttctaaaatcttcaagacaatgttattatttcttcacacacatcctccatttcgaacttctgcccactcctgttgtttatcttttcattcgtttttattcaagtggctgctaagggctactctgcaaggtgcgtgaacacactctcctcaggctatccccaaatcaggacaagtcagctcagatgaggctcacttttgctgaacttcagatgcttttatcattttccttacaattctctcctattttttgaagtttagaggaagaaaactgcctggatgctaagtgttgaaggaatcagacagagcttattacaaacaatctgggtttctaagtaaaaagcaacatgaaatccttttacccacattcagataggtctcttgtgtttcttgaagagcagtcgtgggactagctaacaacctggggtatcagtggaaaatactttccttcatctgacacgaacatgcaggaaaagtcttaatgggacattgcagttgttttgcaaaaaaatgaaagaaaaatcattctatgggcttgctcctcttgacatggtagcgctcaactcccaatatatatctatgtatcttattcaggataataaatgaacattaaaatattgtttgtgtttaaggtctcagtaagcgataactactcacaacctggttggggtttataggagttcataaaatatgccaagaacgtctaagctttcattcccttgtattgaatctatagtaagggaagtataataaatgaaaattagggccaggcacattggctcacacctgtaatcccagcactttgggaggccgaggtgggcagatcacttgagatcaggagtttgagacaatcctggccaacatggtgaaaccccatctccactaaaaataacaaaaactagctgggagtggtggcgggcacctgtagtcccagctacttgggaggctgaggcaggagaatcacttgaacccaggaggcggagattgcagtgagcattgatcgtgccactgcactccagcctcagtgacagagcaagattctgtctcaacagcaacaacaacaacaacaacaacaacaacaacaacaacaaaagaaaaagaaatagaaaattaggatttcacaaaaacaaattttaagaggaagattacaagattactcgctaagttagtgatgccaaaaaaggtaactccattttgaatcaattatggcttatttaaaatatctcatttttaaggtggagacatccatttacacacttacattgaatgaataaagactgtctatttcatttactaagtttatggattacatctaatttatttatattgttacttaatagtttttggatgtgtacaattctgaagaaataaactaaaatatgccagtataatcatgtgttttaaataaagtttccttacatttctaatagtttttgtcttatagttttagttgctatattgttgagcacatgtgcatttcaaataattttaacttcatcatttctatcccatggtgttctagtaaatggttagcaattggctctagaggaggggaggaagaaagccctgatttgtatcatttccaatttctacggtgtaaataatcacactgtggccaatttcaatatgatgttattgaacatggagttaggaagatatgttaaccataggctcttacaagctggtaccagctaacgccctaacaccactgattttacctttttttggtgtttaaacttgacatttccccttgtctaatcttaatattgttactgctgaattgttttggtttggatttgccctatgtctttgcatatttctttattcccaatcgttataaataaattttaaatgtttcccacaaattgtatataatgatttgtgtgtgcatgtgttttggaatgacaggctactgtttatttaatctgatactgacgaaaaattggtctatttatatatgatataatatggattttactttctttttgttatttatatgttattagaaagggcatatataattaaactttatactcaaagaattagagatagggaaacccagttttatgaacatccaagtaaatgcagacaattctcttcattgaaacaaacatgcttttatgatcttggatgagtagaactattgtaatttttaaattttgttttctatatacttttcacagtgaaggtagatagattaatctcactttgtattggaggtaatgatttttaaggagaatttttattatactagaatttgttatatttcattttatttatattttatgtaacttccccttttttaaaccaatgtaatatcttagcttttagaaaaagtgagtagagagggaaagagtagaccatgaatgaaatgctgaactttggcatatttaatacttgttcaaatgtgatgtttaaaatgttgctactaaatagatctttaccactctaatttgaagactcttctcccaagtaaggcattttacaaggactgctgaaaccacagctgcccagctgtgagtagaagccactctgcatacctgtccaatccagctttatacgtggcctaaaacaatgcagcccctgataactcattgtcaattgactgcttggcagcttcaaatatgacagtcaagttccagcaactgtctcaaactaaggctgtctcatacagtcatcatggtcccccaaaatggccggtaagcagtagggatggaaaacgctttcctcagctagactgactgctgaaatcctggctcatctaattgccatttttcctaatggtcttgtcacgtaaaagagttataccctggtttacagaatggacagccatccttacaaatcagtgtttttaacaaagcaggcttgattttctctagctatagagctgcagtgtcttctactcttttcaagattatctgaagcttcagcagatttgtactgctttgtgctgtgtctcttctcaactcaggtcctaggggttcttggagctttaaaaagagtttcatctctcacctaaggctaataaaatcaaactcatgtccctttcgccccctgtttaatgccttcctgtataatgctccaatttgtagactccagccaagggccaataaagcaatttcccccacatttcatgatttcctgcttataatgcattctttttttttccattctttgaaaaacaacattaacagtgatgcttttagtttatctccaactgcctgcagaatgcaagaatggagggaaggacagagcttgcccagcaaagctttagccaagagaggagtcgaccagcttggcagcctctcctttcccccagaggctccatttgaaagccttaagcagcctctggaacccttgtctgcgattcaacactagaacagtctttacacatttttctgctcctacctcatgaaacagatagagaggtctttctaaaaatgtaaatcagttttgtcattctgctaggaactcttctgtagtttctggctgcacttcaaaaacatcccatcttacctccaagtctgcaagttccttgagccctgcctacttttctgatttcctctcatacaactctccttcagacttattactacttaacccttccattttttttttaagataacaagccattctttgggacctttgctatttttctatctagaatgctgctcttcccacagaaattcatctggctggctcctgcctatcatcctcatgtcagcaaaattgcatttcagaaaagcctcctttggctggttgatttaacgtagtctctgtcgctctccattgcatcacccagttttactgtcttcatagcagttctcactgtgggaaaacatcttgttcatttatttgtcaagtagttcattttttgactcttctttcaagagcagcactgtccagcagaaaggcaagccacctatgtaatttttctagtagccacaagtaaaagaaacaaaacacattttagttgtgtattttattttacctaatacaatcaacaactatcactttgatgtgtaatcaatattaaaaattttattaatgagatattttacattcttctcttttatacaaagtccttgaaatccaatgtgaacgtcgctcttctagtacatgtccactggaactggccacgtttcaagtgctccatcacgacacatgctggtggttactgtaccactgtactgctagtgaagctctagaatgtaacccttctgtgagcagggacctttccggtcttgttcactgcagcatcccttatgtttatagaaagactagtgcctgacacacagtggccattcaataaatatttgttgagtaagagaatagttcaaagaattttgagatcacaatggaattcttaagtaaagattgagtatctatctttatatacaatttcaaaggctttcaaaaatctaaataaatcaattaattaacttggatgacgacaagtacttatttaataatgtaagtatgaatttggcgggaaagtcccagtcttttgtatgcttcacaatctcctggatattgcccagctcccctctggcatccactgagcccttacatgcaatgccctctctctgctcacctcactagagccttatcatcccagctcaaattctcactacaatgagaagcagatctcctccaggcacacttggacacaccttcacttgggatcccactgcactgtggatagtgatatattacagcattatacctgttttcttaaaatagaggtgtcctctttctttgtctcaatttctgaaaggagacttctgataccactcttggattggtaatagcactagagcatcactttagacctcttcacgggaagacataattaatttacctcattagtaagatgaaaaaagtctgatgtctactggtctctgcgtgtcaattgggtgcaatcaatgtatctcaactgtccttaccccagagagaaaggagtgtaactgactccacagagcctttcacatgtgatacattggagataaaatgttaagcatacaaaagcatccaataaaaataaaaaatatctttattgttgaaaaatctggattggacattgtaagtaaagggttagcatcaggtctgagctaacccaggcctacgctgaagaaccatctcagagttgccttctcatagcactcatagtttagaagctacagagttaagaagaatacagcatgccatgtctgccttgttggtggtggcactgcacatgggtggggagctgcagggtagcatagagacctgggcatctaaaccagaacagttttgaaagactagttggaaactgaggacagagtctctgtggtaaagtgacccccaggtgtttagttcttgtccatggtggccgcacacactctgtgaggaagcaatggaagctgtgtacctgggtgggttctgtctcatctgatgacattaagatgcttcacctgctgtgtccgttgccctgtatccatccataaagctatagaactgtagtattaggctaaagcttattgtgccttctgagttgaacaacttgagctgtacttaactggtactttaacaaccactgcatcagggcagagacctgcagccaggatcaggctttctaattattcccctcatcttggtcctgagaatcagcagctgggaggaaactgctcatggaggacacttactcaattgttctgcaattaattgagccttccttctcacccatccagtctactggggaaagctggtgatgggaataagaaatgagagaacaagatcccctgtgctcatggcttctaagcacacctttaccccactggaaggcttgaaccaagggatgtcaaattcttgccacttgccagttaaatcaatcaattcctcatggataggagtgactcagggtggaaagaatttgtgtttttctgttacaaattcagagactaaggaacatgggcctgctaatattttgtaagcatgattctctctccagtgcaatactcactccttcaagtttgggccttgttcacctctatatccctagccaagaactcgagtaataatttcaataaatacatgaatttaaagtgaatgaccattcagtcatcagcccttaatttctacattatacaaattttattgtttcacttcaccaaaatttacagtagaagctacggaaagattatatgtatgagattcgcgttgcttctttcttctgaagatctccaagttgtgcacatgaaaaacatttatgcaaaattaatcttattcatgttcttgctaatctgcaaagtcggaactatcatcagtgttggaaaatcgagaactttttttttttattatactttaagttctagggtacctgtgcacaacatgcaatgcagccaaaagacacatgagaacattttgaataagtaccaagtaccaaagaggctatttcaatttttgcaatttcacacaaaagccaagtgttttgggaatcataaagatcagtttctgtaaacctgtatagctcttaacacagcagtcaattccaagcaagggagtagaggctgggaaaatagaaaatagtcagaaaagactgcttttttaatagataaagggaaactatccacacaaggaaatgctactatcaaattggtgccaaataggaatatacaataaagaaattatttgaataatctgactaatagtatctctaagagctcttcctgacacactgtgaagagttaccattgaacaggaatcgtctataggaatgttacaggtgtcacaggagaggattgatagaattgaatctaaggaaatacacaaaaacatctagactgttactcaagccaaaactttggggatatgattaattttcaatccagatttaaggtaaattatctgacttgaactttgaacttatgatcagataaaaaattttgattgcctctatagtcattttttgctaagacaggcccaatgaacacgagatagaaaagcaaggtgagcaatagtagttaagactggttaaatattagcctgacttaattaattaaagctagatagtgatcctgtgaaaaggataaggcatgagtcaacaagcagaagtagtctatgagccagaatctcttaatgcactcaactaagtttgtggaaagcaagaatgatttcaggaccctaaagaagtattctgttgcagtagcctgcaagtgttaaacattgttgcatcattgaaatgtgtctttatctgatcacagatactaaaattaatcttcaatcatcttcaggattattatgcacatgctttactttcaagttcaactgcacatcttgctgattaattaaaccattcaatgtctgtttacacgtttcacaattttgtctaatactcactcaattttactgcccagaaggaggatgctaatttagaaacagaaaatactcatcaagaaaatataatttagaaagagaagaccagggacagaagaatcagttcaggtcagggctagttcaggtctaattctgagagatgatgctgggtgctcgggaggagcattagagaaaggatgggcagctgggtgtccaaacagctcaaccagaatttgatctccacaaaatgccctccattgttttctttgaaatagtgtggctgaaaaataatatcataaaagctcccattaaaatgtacatatgaaaaacacattaaaataaaaaattggctcttggaattatctctgccatttccacttgtattaagacagttaattgaggtcatattgtatttgttaacttattattttcacataattgtttatagagattaggagaaactatatacttaatagaaaatataaatgcttgcctgatagcagagggtcggtggagagaaaagtaacaaaacaaatggaaaaaagaaaaaagatggctcaaataaaatacttagtaaaaatgatttgaggccaagttaaaaaaaaatctggtgaatggctttttaaagatctaaagcaatttcaaaacctaagagaaaagagagagaaaaaatgatctagaaatagagcaaaatggaactagaaaaatactggcttgaaaatgtgaaactataaatctaaaattaaaacttccagatatatgttatagaaaatatttttttcctttttgtaaggagctaaggatttgggagtgagggggtaatcagactgtaagcaaaactaaagatgactaaaaagaaatgtgagggtataaaatacatgtattttttctttttggtaatgctttattaaatgttccaaagtaatgacctatagaaggcagacccttattttcaggaggtatctatgcctcaagagtctggggatgctctttcagatttgtcctacgagtctgctgcagggcattgttctatgcatggttctttaatttggggctgactcagtactcctatcactgcttatgaagctgggggagctgcagatcagcaggtactggcaaacctcagcaagagtccttttaagagccaaaaaatattggcctgaccccattgtgcgtcctgttatatacaactgagggaataaaacacacccagggattctggaaacaaaacagtatgaacactgcatctcatgagccctagtagataaagcactgagtaacactgtgaggtaaaagtaagttatgtccattagaggaccggcaggtaggcctccttccaagggccagttctgattcattcatggcggctgtctggagcacttctttgggaatgatgcctaggctaagtctcaaatcaaagggaaaaaaatactggaaaaaataaacttataatgcaggggtaatagaagtcattcttaacacatatttgtcactcctgagataaatagtatctagagagatttacttgtgttgctgatggaataacccaaaagtaattgtagtgagattaagcatatagtcccagaaagacatcatatacttatctacacacacacacacacacaaacacatgcacacacacttgtaacaagggatgcaggatacagtcacaggaaaacactttttttgtgaaaaatagcacacattagaatagatactttttttggtttatttaaaaattggttccttaataatcaactgcttgtagattagatttttctgtatttaaaaaaatagcttagggaagaaatccatttgtatatatacccaattatgtaaattacttaacatttacacaattatgtgaattacttccttactctcttcacaattaattatctctgcagccagctgtgtggggggctggcagctcctgttataacacagctgtttttcccacatttcagcagcactctcttccggtttgtcagggatcccagaaagaaaagttactctcattacaagaaatcttgagattttggttaaccacaaagaactaatggcctcattctaatgcacattccattgaaaaaacataaaaattcattagtaagacctacaaacattttgtcagtgcctatgttaaggcattttaaaaccctttgcaaaatcactattctaatctaattatacaatgatcccttattgctcaattttttactagtctatttaagtaggtttttatttgttatttgcatttcccatattacttaaaaagcagtagggcgagagaggccatggataaacctggcgtcacacataccggatgtatgtgcaattggaattcaccttctttctttaaaataccctggaaaggtagtttttgtttttaattttaaaaaaaatctcctttagcattgtttcttcttaaaattctgaggtaagaagacatataactgaaatgctcagtgtcacactgttactgcatgcttgtccctatttagttaccagacaagtacactgtttacaagtacagcaagccttagtagaaacatcaatatgggatgtgctcacattggcaagtgcataagagaactgacaggcctttgtgtatttgagttaatgacaagctgacagatagcatcttttcacctgtaattggacaacaaaaggaccagaagagagacaggctcccttgctagtgttccagcacctcatttgttagctgcctcgctctttaccattagggatataaggattaataccgcttgagtttttttctaatgtctacattatttttaagcctaaactatagaaacataaaactcaaaaggctgaaaaagaaggtttaattttcaaaattagtaatttctaaaaaaatctatgaatcaaccatggaaaaataaatttattcattccaaactaatctttcagtcatcatccaagaaagcaacgtctgccattgtagtcggagacattaagggaagattaacaggtaaagattactttcaatcagatatctttgttattgtcatcatcatcttcatgtagcctttaccaaatacctttctgtacatttcattaatagccaactgctgctttgggtattaattaacaaatcagaatattccacactgacagagagataaagaacgtgtagagaattgaaaaacatcaaatatatgggtcaaaaaggtaaagtgcacattcttattttatgaataggaaagtattgcaaaacggagagccatgagaattgttattttaattgggttcaagtttcagttaaacagtttttcttttctaactatagaaattttaaaaatagcttagtaatccttcaaaataaaattgtgttcacctatcattttaatggttaagaaactatccctgtagcacaatttagttagggcacagatagcaagaagctgtaaatgtgctaaaagggcttttcttttgggacagtaatggtttgactacaagcctcagcatattaaaaatataagggtttgtaacctgcttaaagaaggagaaaaaatagtttctgaaatggaatgagaaagggtcagaaacaaaaacaatctattttttaagagattggtttagaagaggcatgttatttagaaattattgttgcctgacaagaaaacactagaatagaaaaacagcactttttggcttatgggaggaaagctcacagggccattaaaattgaaaagttagtacatgcagatagaatggtcaagatgaggccagacttgctgccacagaggtcataaattattctcaaaaaaaaaaaaaaaaaaaaaccgggcaaataagatgaacaatatcactgacttccaagcttggtggccaagaacaagattctttgaaagaatgggttatttttaataatgataacaacaatggtagtttgtagtaaatgtttcaaatgcatcaggctccatgccaggagttttacatgcgctgtctcctgtaatcactgcaccaatctgatgtagtggtagactcataaacattacaatccacttttaaatatgggaaaacaggcttagtgaggttgcatagcttgactttggttacattctaagtttcagagacagtagttaactcttctttgattctacagctcttggatctgttctagttactgttccacattctctgagctatctactgcctttaaatgaaagtgaaatcctaagaagcacttgcaaaatgcagtgcaggaagaaggcacaggttgcctagtagttagtctcaagagaaatatgatcccagtagagttgacgcagtacagcaaactgcaaaacatatcagataaaaagaagagctttgactatgaaagcctttgactcagcaacataagtcagcaccagaaagggctctacgagacaagccagagatgagtgagaaacagaaacatgggcatagcagaatggcagccattcatatagaaatacatatctatttgaatttcaacttaagtaaacactggggtaacccaaagagtgatggtagcctacctattctgaaattttactgctagaaaagaccattggtctggcaaggaaaagtgcgggatcgaaaaatcaaatggcattaggcagttcaagcacaaagcctgaggtccgctctggccatttgtggcttttgctcaaatagaaattcctgaacttgcatagactcaaagtagtgtggtttagtgacttggtgaggattactttcgtttgattctgccagacctctaattcactaacatcattgtcctaagttccatgtggaaactcaggtacagagtggatttcttaggaagatgttgggatcatggaggagagaaattggaaaatgagtcgtgatcaaaatgctcttttttgaaagctattttatgacaccagactgcaagaattaaaatcacattaggatgtcagtagcaacatttacacactgcctaaaccagcaatggccacttttttcataatcatgaatccccattgcttctacagaatatgtttagacaatatatgtaggatatatatgtgtaagtcagtagatttgaaacattgtaacaatgattcctaaaattagagtattacaaaatagccctgagatctcaaaagcctaaacatttatgtaaaggcaacttctaatctcatttttaaagtttggtactttctattactgtgaaagaaatatggattggctatcaagggacttccaccactaatcaatattggacaaagatcatctcacttctctgtgtgtctatgtcttcacttttaaagtgagagagacaggctgagtgtttatactagaaaaagctttaatttcaaggaaatctgactagaatcccaacatggaaaaacagatgaaaacgggttcattcgttgaagcagagatgggggccggaaggaacgtaaggatgaaatggagggatgggggaaatggagaggtcagtgaaggtctgacaagtagaagcagcagtggcagtgacatagttaaactgggaaacaaacaggatgtggcaactggaaggcaggctgtctgaactagggattttggaagcagaccggtgttgcatcttaaggacagatggcaagggccagagtgtactggcatctgtggtgcagagaagacaatttgtgtgaaggaaaccacgtggctccggtgatgaatgggttgacatatggaattaagttggaaagagtgactgacctgatgcagaagattctggaaaggcagtgagtgacagcacaaggagggaaaaatggggtcaacttagcaccagcccccagcaaggagagggaagaaaaatttggaaatgacaatggaggaaaaagcagactgtgactcagtcccccagccctgagatgagtggatttgaaagagtcaacagtaaatcactgggagatccagaggggaacaggtgatgtcagttaagtcaatttcaaataattttcaaatttcaaataagaaaactcagaaagaactttctgagaagccattgggtttactgagtttaaagaagaaattctttctggaattactgaacggtagccgtgtttctcctccaggcattatccaatatcaacaagtttgagatttatagttggctcagattccattggtcggtcagggtggtgatgtgtgtggtatgtgtggtgtgttgcaggcagtgtgaaaggggtgtgagagaggaggtcagatctggtctcctgaaaaatcgcttacaggattataaaaaccactatgctcaagcatcacatataggtattcaaaaatgcatatgataaacatagataacttgatttttctcttgtgtattcagttgatatgctaaggcaataattttgatcaagagaaacacacaacagagccctaagtgaaaggtctgaaataatgttatgtcagttattaactgacaagaaaccagcaaatgtttataattggaagaaaaaaatcaatagttttttatgacaaagttcagcatcaaaatgatctggagactgccctacagaattaaaggctcataataccaagttgcatttctctgaaataaccaaatacaaatgcagtctccctctgccacttctctctgtctaagcaaatacacccactgcaaaaggaaccaaaggaacaagaaaactacatcgtaagtaccaaaaatgatgactttattgaacacctattgtacttactttgctttattatccacagctaatgccatgctccccccactcccacctcccatcttacccatcgaaagagtgaggcactgtaggaagggaacatgctttgctacatactattagataatatcatcagctggacagtattgacatctttacatacataaaataatgatcatagttgcattagaataaccacattagcaaaagatttaaaatgagataattgtacagggaaccatttaaaatggaatgattatattttaattttacatctgattgtgcaaaactgtaaatgcaaaccagaggctgtgtggagtagagaggaacatgaattcaccaacccgtggataattatcctttgtaaactccaaattcaaaggctaaacatttactacgcttcatgctctttgatcgtactctttaggcgaagaaagtgttgactgagcattgttccccagtaaggcttgtgaaaatcaaatacatttctgaactgtaaatacaatttcataggctaatagtcactaatagcttgtaattaatgaacagcatattaggtaaataaaccacgttgaaatttcagctgaagcttcatacttgaagggttctcctttcaattattctgaaggcagtgaagtctgtgtccccagattttttgggaatttgcttgcacattttaccatctaccatctcaaaactctcttccagttgctactttctccctccccattaaaacctgctttcaggaaaggatctaaaaatataatacacaatcagatagtccttgaattttaaatggtgcaacaagctttgtaccagtgaacagagcaatgcaatttagttgaaagacatagcagtgattttggagaaaggaagtgagagccatattggcctaggtttgagtccttgatttgttatttgctggatacatattcttgagaaattactcaatctttctgatctttaatttccttatttacaaaatggagataatcattcccaagacaactctagcttctgtggaactttgtgcatattggaaaagcctttccctccaggtagactcatcttcttgggttcatagatcatcaagaggagtgcagcctggatttgagccctatcatccctcaggcaaatgcctttattcagtacacaaacagtactagaatacatgacagccctgatgacagttaccttgctgggctgttaccatcatgaaaggaaatggtatatgtgaacatgccttatcactgggctatggcccagtcattactaattttttcaaagctattttcttacagttctttcatcttgtatttcataatcatacacacctgcatacatatacatcacttaataagttggataatacgtaaataataataaatttatgttaataagtaattcataaataataataaatgtacttgaaacagagcatggagcagggtgactacctttctcagggtaggtgcccacagaggcaagttgcttatcacttacagaaaggccaagtgtgattatctggtagagtcagtttatagtcaaggttaggtaggagcttctgctcagagtagatggtcctgggctcgaaatctatgtgtgtgacttattctagaaactattccataactcgaaagcaggctgctacagagttgtattattaatataatttggtagtgcccaaaaaactggagcctgaccgtctgggtcatttcctacctccatcactttgtgttgtatgactcaggccaggttgcttatctctgtttcagatacctcatctataaaatatgctaaaataaaataaataggagggaggaagaataacatctattgaggctgttgtgaagacttcatgcattaatttagacaaaggtttagaacagtgccttacacataatcagtgggaggtatgtgttcatcattgtcatcatcatcaccatcaccatcttcaccatcagtatcattattacaaaagcatcagcatcattacaatacttagcacagtactttattatttatgtaaccatgttttaaatgatggccctgttttctgatattattattttcctaacttatctgtatctctaatttttcttcaacaaatatgtatttctttggagtaaaaacaatagaatttacaataataaaatagtggttaaaattatcttggtgctaagaaataaatacaaagagatatcaaaaataatctcttctaccaagaatgtaaatatgtcgatggggagtcagagtatattataaacaaataaataggcagagtgtaaacagggattggattgaaggctgagctcagcttcttaccttgccctgcagccattttgaggctatactcactactttttctgtcttaccacttccaagatgtatctatctatctatctatctatctatctatctatctatcatctatctacctatctatctatctacctatctatctatgtatctgtctatctatcatctgtctaatagatatctagagatagagcaaaaggagatagagatagagggagaaagaacaggagagcatgagagagagaaagagaaatgttttgctaagtgttttgtgtcgatatggggaagagaagtcacatccacactggatagctccataataaaattctcatcatacatcctggtttttctttacttctttgcaccctcagaggctctttggctctttcctctatcttccccctacattctgtctcagaggttcatctatcataacgtcgaggcatcttggaaaatattcacacttttgcttctccatgttacacttcacttccccctcacctttccccaacttcaaaacctttatcgtttacagttctccatctctcattcaaggcttccttcacccaggctcattctaaccccacttccctaaattacacacttattatgtaaatgtgtaaactgtctattcagtcagtcctggtttttcatttattcaacacatatttattgagcaactactatgtaccaggcaccaagccaggaactatctgtctaattctaccccctgtccagtgtctagccaggtctaactctctgcctcctctggaactactatgtagcacttagtgtccacagaagctatcttagcctttaactgttttaggtgttgacattttcctaactggactctccttgcaagaaagagcttgtcatatatgtctaggtgttcagtctgtcatctagaatatatgctccactagggcaggaatgtgcattgtctgttttgttcctttgtgaagccaagtgctgggaaagtgtttattatatgactgatgcccagaaacattttctaaaatgatgaatgaatctccctcagcaactagcaggatgttaagcacgtattatttgctttcaatcaacaccaagacaactgagtgtttaacataaattatgagatttttccctaaatgtctacaaaactacataatttttgagcagttccaaaaaatactgtttttgtgcccaaggacatactaacagattcgagagtttccatgcagttgtggcaagaataactaggacaccattgctccttaaagatgaaagttcaccaatattttgaaaagtacaaataattaccaaatgaactcattcttctatacattatccacagcttatcagttgtatgcatggctcactgataggttctactttcaaggatttcattaattgtattacttggtgttactaacaacactgctcagtaatgatgacaatttgttgaccattaaagatagttgtttataatttacacactttagttagaatgctagaataatgctatcatttcataatcaagcattgtttgacacttaaaaaaactaggattttataaataactcagtgtataaagacaaaaaagtggagttgttctgatgatactggaagaaggagagtaaaaagagtgcagagccccacctgcttactacacctccttcatcttcacccaaggcatccccacctccacgtggcactaagcagaaccctacagtcatgcagaacacagttcaaattacactgaaccagcaccagcttcttacctaacaaagaagaaaggaatgtcaaagaggttaagagacctgccaaatttctttcatatccccataagggatgccggatctccagtccaggggtgtttccaccatgctataactgcccctaaaccaaggtcatcactgacagttggcattcttgcctaaattattccaggcattttcacacctccaaggagggaggcctacttccatcctactaggctagttttgattcctctctctactttcccttcggttttgaatctagtttttaggaaatgtcagattaccaactcgtttaacactttttttccatgacccttaaattgttctcctgaaacttccgtcatgaaggtagttagattagcacttagaggtgttctagcataatatttagtgcctatagaatgcttttcacctcaaaggcaactgtctacagggcaattttcatggatgaaagacgtaggcaaacagtcacatatgttggtgcatttataaagcagtttcatttaaagccccaaggccttaaatggtaccttgacaaacagatgtctattctttttattattattatacatttacacagacacacatcattagttctttattgacatcctgttttatttttatctggttttaatgctagctgtgaatgtcatcataaaactgtcttctagaatacctgctgatagggaagaggaaaaggatgaatcaaaacttggtaccatattggggaggagagccctcaggatccctgctgcctgcatgactgaacagcagatgaaacacactgaacgttccactgaacgttgagtcagtggaagatggagcttgcaaggctgtcttggagagtatcagtgctcccagcttagcattaaaatgcagcctggtggtcactggagttctcagctctgatgtctgaatgccacaggcctggggaaaaccccaggcctgtggctgctggagggaatgcaattagggcctctgagagagagaagaccaatatttaattggctcatcccaagttatctaccaacagttgggcttctctccttcaactcctgcctggttgatattactcagtttttggggttttttgtttgtttgttttttgttttttgtttttcaggttttttgctgtcatttttgttgtacttcatttttttccttaccattcaattttgcttttggaggaaagctctcaagaaagacactttcaggaccatccagattatctaatttcaatgactgactgaacttcaaatatgtaatttaggctttcccaagctgctcgatgatatgatgcagtgttgctttagactgtacattatttttcatatggtggaagtgtaatgtgaatcattctaatagctcctggcatcacatccacctactctctctctttgtgcaagtaatattcatgcatgtgagcagtgtgcatcaaagagcatataggaaatcacagtggaactgtggggatagcatggcttccacaaaagtcatataactgtagcttgcatccatagaaatacagtgcccactacaaggagaggttataaactggactgctccagtcaggctatatgtgtagctaagtgttaagttttgtccagacacattttaagatgggtattgaaatactgtcatttagaatacaatctgagttcttgtcctgtcctacatgagcttgtggtggggggctccccatgtgcattatcaggccatcttccaacactttccccctctgagcatcttttttttcctggctcaggtctagctcattctacccagggcctttcacttacaaagtcctcctgcttcaaaacctcttcctcttccatgctagttaattatccccattcaggtcttagagaaacctccctgatcatctgaaggcttgtcttctagtttcacacgtgcactgccacacacacacacacacacacacacacacacatcccttgtcactctcctatctccctttgtcattttcatcttggcacgaatcactctctgaaatgatcctctgtgtgtgtgtgtgtgtgtaacgcttatcttatcatctgattcctttgctcctctgtaagcctcatgagaggaggggccttcccttccttgtttctcaccatatcaccagctcctagagcagtgctgacacatggcaggaactcagtgattatctgttcaatgaatcataagtaaatgaagagagtatgtctggtgttggctgaccagggttgtgaagggacagaaggggcttatctgaaaaactactgaagcatagggaatttgagcctggaaaaagggagatttagagaagtcatgataattgtcctaaacaatttgagagaccgccacacagaagagggtgtggtgaggtcagaggcagggaatctgggcacgtactgttcagcccttgttagggagaacattatggcaaatagagttcttgaaaaggaagggcttctttgtaatatagtgctttctggaaatgtgaaatattcaggggaaaagcttgaagtaactgtctggtgtagaaggtaattccattttggaaataagaatatatgggagttatagatgagagaaaattgattcttgaagaaagattacttattctaattcttcactcaatgaaagaatcaaagagtaagagaggtaaaatgttttgtcccaaggtgtagcaaacactgttggctgactaatcccacacctattccccaaattattgtctcttactcattttcaacatagagtgtgggaatgctaaaaactaatttccctagtttctcttgcacttggggtggccactgagataattctagcccatgagaagtaaatgaaggacagtggggacttctaagatatctttgctttcttgatgaagaaacagggtggctattgctgtctctcattctgcttcttgaactggaagtggatgtgagggaaggagttactgtagtcattttgtgaccattagagaagcactgagatgctgcctctaacattgtattgaaccaaggccagcatctgactccttttagacttccttatttgttttaaaagactgtcagtggggttttcttgcagccaaaagcattcctgactgacacacagatattacagaaagtggcaaagtttagattaattttatatttcctaatgctcaggcaggtagatttttcattacatatactaactcatttgtcaactattattaaatgcctactgtgttccagtcacagggctaggacctggggaatttgttggggtcactggcaatacaaaaatctatcatgctagaaaggaaacactagtgaagacatgattacaattcaatgagatgagggctatgacagaggaatacacgggacaccaggacaacagagaagcccaagttccaaagtgggaacagagagagcatcctcaaaaatgacatctacttagagttaagacttaaataaacagtagaagttaaccagattgggggaggtaaaggactctctaggcagaaagagattgtagtgcagagagcaaggtccactcaagaagctgcgaagagtttggcaagactgaaactccgtgtgtgtgcaggaagggggctgcagagagatgaagtgggaggtgtcaaaaggtgaatctggagggataagtaggagccaggtaagaaaagggtttcctttgcctaggtgatatgttggaatggtttctaggaataggtgctaggaagttattgaaggttcaaaagtagggaaatgactgatcagattggcatttcagagtgatcaccctggtttccaggtggaacatgcacaggaggggaggggttgttaaggtgcttcaagactgaaagtcagggaggtgagttcggaggcagagatggtgggacttgaaattttagaggacatcttcaaaatgttaagaaggcagaagtgaaatgacttggggatcattaggtagagagtctaatgcagagtcaagagtgactgaaaggatgataccacctatccaaacttagggaaatatcacacctcctcaagactttagtgtattccatgtgtagagtctgttttctattcctaaatctactgccctagaaaaagtaccaatgaaataaaacgtgaagtgatttgagcaccaagtgggaaactggggattccttaactgggatgctgattttcatatgttaatattttttccaaatgtacttcctcatattttaagtggaatatgaatttcctagaaattttacaataattttgtattatgtaaagatagttgaataaaatagtccctgttgctagtaatcataaagataaatttaatttccactggccacataataatttgtctcattatcttatagtcacagcttgtacacatataataatgtcaccaaatgtcacttaaaataatatttttctttttaaatgttaaaatgattcttttcagttagtctaacaaaagcttttttaaactcacattcacattttcaaatataaagtgagtttcagtagtacctgtgtttcattgctaaacttttgaattctgcttttttccttaatgataaaactagcatcacaatgattacttctcatctatattcataaatgtacctaatggctacactggccaaatagctaacataatttcaatttctagaaaacaacatttctagaccacatcctccccaaaatattttttaaatgatttcttatattttttgctcacatttcactaattgtataaaaaatataaaatttatttatttatttttttacctcaggaaacatatggtgtaaatgcttaaggaaatgtgagtcatgtctttgatgaggcaactactaaaaaatcagttccttctgctacaatataaatagcatgataagccctatcaaaggtcaaaatctaattttaaaatacgtatttcaagaatttttattttagccatcttgccatgaattagaaatatggtctgttcagtggccaactctgacattttctagtgcacttgcttttcagtttttggagcaagagagaggaaatacattttgttatatttcaactcaaagatctctgagatattgcagagccaaaaaaaaatcatctctatccattccctaccctactcccccccagaaaaatcctttcacctcccaaacaatttctaaaaatacatttttcttttttgttaactgctctcttgaaacttgaagatgtgtctgaaggatttggttgtcaatgttacttatttctaagttcccatctggttctcaaaaaactctttcctcctcttcctaagtgaacacctctgaaagttgtaatggatttggcagtaggcaagctgcctatgtttataactctgagcacacaggtgatgtcacctatgataaacagcacttggcacctctagccatctctgtctaactgtgagcttcaagtccactgggtgcttgggaaggagagctgattaaataccccatccaggaaggagctagattgacagacaagagttcagcctacttgcttgcatgctacttgcaattgagacctgtgacaagaatggaattttgctcccctcaatttttagatataagaaaattgaggtagagggaggttaattgctttaatgcctccataatttaaacactagatttcttgctcaatgtttagtgatgaaacatatcagagtaggtctgttatactcaccacccttggctgaagctggacttcatttccactgactgatccccttgtttgtacagatcatgcgcagctaattcctgagcttgtttttcaacctctcaaacacctggagtacaaaatttgattccttcaaagagactgctcaaattcatttgtttttgcaagtaccatgaatagttttttaattaattattattataagagaatacatatttattgtggcaaattttagaactaagaaaagggacaaagaatctctaactcatccatactttctcacccagagatatccatggctaacagatggatgtatttacttctagtcttttaagatatgcatatatatttccaaaactgatactatgttatataaacacatatcctgattttcccatttaatattttacggtatgcagttttccattttttaatatttcaaatattctttgtaaacaggtattttaataattgcataatagagtatgcataggccattaaacctagcagtgcatgatctggccaggtcagcattccagccttagcctcagacactggaaattgctatcctgtcatttaggcctccttcatatatctggttcttcctgcctggaaaatccttccttgtggtaggcacaattttaagatggcccccaagattctatcctctacatgcatgtcctatatgatctccttctcttatatgtgagcctaatcacgaacaggatgaacagtcactcccatgattaggttattatgtatggagaaggtggagggattttgctgatgtaattaaggatctcaaatcagttgatttttgagttaaccaaaaatggcaattattttgggtgggcctgactgaatcagaagaacatccataaggaggagttgggcccttcctgaagaggaacattctcttgctggtcttgaagtaagtggccacgttgtgagaggatctgccaaaggatgaggaactgcaggtggcctcaaggggctgagagctgccccaggctggtgatcagcaagaaagtgggaacttcggtcctaaaaccacagcaactaaattctgccaacaacttgaaggagcttgaaagaggaccctgagccccagacatgaatgccatctgcaaacacctgatgtcagcctcttgagactctgatacgcacctgactcctgacccagggaaaacatgagataatgaatggtgctttaagccactgagttagtggtagtttctgacccagcaatagaaaaccaatgcattccctttctcttttcctctggtaacttccactcagctttcaggtctgagctgtgagatcacttccttcaaggagccatccctggcgccacctatatattgtcccagctcatttttacttcttccatgaacagcaatcacagatagaatggcagttgcctattttctcacctgcatgtctcttgcatgataaacaagtgtggatactgagcctcagagaggtgaagttctatttgtttgatggctaaaatatattgggacatctcaggaaatagcaacacatgtgaatacaatgcaaacttaaatttagcagatttgccaacacaagacgtggctggaacaaaaatacagtaaatttaccataatgtgtaacatttaatgtattgtctgaaaccaatttcagataatactactgaagcaaatttcatcgaataattcatgtgtgcattagctgtgtggatatggaacctgattctatatacaatttacggccttgtcagtttttatgtaaaaatcacttagagtgaataaaactgcctatttatggtaatttctcatttatggattacttctgaagaaaacacacagttcttttccctgggtttcaaagcctggttagccaacaggatcccagaagcagttatgtgctggagctgagtgactcatctgggagattacagtaggtgagcatgctctacatgctaattgcgtcaagctgaaaccattcagatattaggaataaaagcaaatagaagggtgatattttaattctgcactaaagataggggttaaaataataactcagctaaaatagatacaaaagcccaatgactccctgctttttttaggatgagtaagggaaaaaactaaattaaaaatcactagattatatgcaaaactgcctgtttatttaccttaccgatggtggtactggacacacactgaaaaggttagcattaattggcttttgataaggacaaaattctgcattttcagcactgctggactgatgagttagaattacagtatttcctaaaactcatcagttccctctaattgggtctgcccaggagaagagctgtcagatcggagaagaattcaataattctcaagctttgtttcataaaaaccacccgggatgcttgtgttaatgttcctattcccaagcctttccgtagaaattctgactccttaggtttgaggtggggccttatcatatatgttttaaataagcccccaagatgattttgatacaggtagtttagctcttacattttcagaaccatcgagtagaccatttaagatatttgtcatcattgattctcagaagacttgctcctaagaccagaagatatttgcctggtgtctgctctgcctgagaaaacatcttcaatgtgcatggggtcctgtaatgcatatgaggagtagagagctcctgggcctgcagcggacaagtagggtgcaaaggctgaaacgtcacatggagaccccagtgaattagagtcacctaaagaaaagccaccatttaatgtgcagcattcttggtaggtgggaatgtgagcagggtgttgccagatttgctgttttctagagaaacagaaaacatgaatttttgtgtaaactccctcgattttttaaaaaacactgggttttaaaaataaaatctgtaattggagcaagggctgcgagttttcaacctctgccttaactcatcaggataattctccataaaatttgagaaatggcagagcctatttcgttgacagaggtggtgacatgagaacaggaatatgaactccatgggtgagagatggaagggaatacccaggcacacaaggctgctcaaggaaagacaattgagctgccttttcatacaactcggcgctgtgaggaggaagtgttttctagtgtccagaatatgaaacctgtaaaaattggatttattcttcctcctcctccttctcttctgcaaagggttttcagatattcattcccattgtatctcacacctaatcacccatgaacctgcggagtaggtcaactcaaggttggatctacaatattttaaaatgctataaagtagatttcagtccctgagttgaattcaacctcattcttcaggctggccaataactgacagggtctttggctgtgcagaatgctaagtgtgaggtgtacggggagggtaccagttcaggtaaggctacatgccagactgttagctgtgttccagggataacaggaacctttcttttttaccagtcaaattcttcacgagtcatggtaccttttagaaatattagaaaccatctaaacctctcaaatatcaaactacttttcttcctgaagtgtcagtttcttctgaacatgttctttgtttttggagaaaatcctggagagcactgataattcccaaattaggcaaacaaccaggaaaacctctataatctgagcccagtaactccatatggcaaatttgacagaagtctgctctgaaagtcctgcctgaaaccattggcctgcgccaagttatagaaaaatcatggcaatgccaattcctctgctccaaaaccactaagatcaaatactattttgagcttctcagcacagcttttttactgtgaatatcataaatacaaaaatatatctgctatgcggggcaggaaggttcaagtatttcattatgtttcttatttcataacatataattgagatcttcatgattacaatgggatatttctaaatccattggtgagcattataaagagcaattcttcaaaagaaagcaaggcttagctgaactgtgaacatgtttttgacgataaaaatctggctggttttatccctaaagctatttttttattttaaaagctttaaaaaataagagtcactggtcacctaattgcataaagaaaagaccctctagtgatagtttatgcctttgggatatctgataggtcaaattatctaatgcttgtacttatcttgtttattgtaatttcaagtgaatttagtgcttaaaaaagttaatgtaatgacagaaggtgttctgacaactcacctgtttcattgtcttcatagcactcctgttgtttgagcattatcattgctagttgcattaaatccattatttttggtgtgccaatatttagttaaaatatacacacacatatattaggacatgtctgtctttatgtaagtttttgcagccactaaaaatgatgttcacaaaaaaattttaatgacatagcaaaatacctttctaatgcgattaaatgcagattatcaaactgcatgtatctatgtatatgtagaaaataaaggaaaatatatcacagttttaacaataaataacctataataacggtattaagagtgagtaaagcacatcaaaactacaatgagacaccacttcataccccttaagagggctaatataggaagtatttttaaaagaagataatgcatccattagaatagaaatatcagctgtaaagtgttcaaaaacactgggttttaaaaataaaatccgtaaccggggtaagggctgcaagttttcaacctctgccttaactcatcaggataattctccataaaatttgagaaatggcagaacctatttcgttgactgaggtggtgacatgacaacaggaatatgaactccatgggtgagagatggaagggaatacccaggcacacaaggctgctcaaggaaagacaattgagctgccttttcatacaactcggcgctgtgaggaggaagtgttttctagtgtccagaatatgaaacctgtaaaaattgtttttttacagatatacaactgtttaaaatctaaaatgtattaaattcatgtctttttgcagtaggcaggtgggataaataagataaaagactcattaatcattcatttaaacatttggtttaaatagtcatctggaaaactaaaaaaaattatagaatgctttttcaagaaaaaaatcattatttaatagagatcatcttgagtacggaatgatgttgaaactgttttattttatatgattttgagttattgaacaatgactgatgataaaaataaaaatttaaagaaacaagagcaacaaagagacatgaagttttaatatttccagtaaaacataaataacttgtaaagaaaaggagatcatgtagaaatgtgctctgtgttcatgaaattcattgtttatatccacaggctcctagaaaatatgagtgtcccctgtgagctgcactcatctctattatttatatgttttattgacttgttttaaaaagtacaaagatgagcctcagcctgattttcctaaaggtcaaatttcttaaattaccatcagtgagttttttttttttaaatcatacatggacaaaagagagttcacagtttggtgcctgacgttttctattgtttttgtcccttatttattttgttttgtttttaagagataatttctgaagtgtctaatgcataaaaatgttttgaaactcttctgtaaaactcaatttttgttatagtttgaagttggatgacatggaatttttaaagttaggctgggtgctatgatttgttgctaaaagcaagtagtattgaaaacacaatatttaggcagtgttctcattgtctgggtactatacatatgggcagttgatatatttacttggtaatatgaagccaataagctggtcatgagactggaaagaagtttggaaaggaagaggggggcaaaatataactatatccatactagagatttgcattgattaacgtgttgattagccagcagtttgacatatccaaacttcctttgtcccaggagaaataaatcaaatgtcagattttcaacttcctccctctactctttaacacgtacatactgacacatgcacacacacacatatttaaaaaaataaaattcaactgatttggtcagacacactgaaaactggttaatagattagaataatcaaagttgttatttttaagctagttgcatagagaataacaaagagggttacgccagaacctccaaacttttcttgagtctatgtttttaatcattatgcacatcgggttaggagtgcccatttgtaaaatgagcatggtaataagatttaccacaaagggttgttataagaataaaattgaactatccaatgtgtgatttagcactgtggctgcctcgattttaggacttgcatagtcactattatctgtcgttcttatttcaggcaaagagaacaggaaaagaaaaggcatagagacgtgaaattgcttaggatgttttggggaaacattaagaggtccagcatgactgaaatacaaaaatagttgggggaggtgaaggggaatgaaagggatgacgccagagatggtacagattatgtcctcaagtgcctttacctgcagggttataaccgtgggaggagtcatggctttaaggaggctatttgaagcgttttgaaagggatgacattggaaacaaggacaggacttataaagctaccgcagaggtccaataggagatgagaacttgagtagactatggcagtgggcatgacagagaatggaaatattccagaaatctctttcctttagttttttaaatatttgttttgttgttgttaactgaggttaacaagaaagcccagatgatatttgcctcctgctattcatggtgcctcctatattgcatcaggattgcccaacagaatagggcagaagcaatgatgtgtaacttttgaagttgggtcctataacacattgctgctttcctctcatcctctttgatctctccatccaatgtaaatcagcaaccatgttatgaagacactcatgcagcctggagagcatttcatttgcggaagaaatgagacctgcctgcaacagccaataccaacttgatcatgtgagtaaatcaccttagaagcacatcctccagccccagtcaagcctttatatttctatcaccctgactgacttcttaactgcaacttcatatgagtgccaaagccataaccactgaagaaagatgcttctgaattcttgacccatagaaactgagaagttagttatgctattgttttaagccactaagttttggggtaattaattaccccataagagtaaactaacagagattgatcttatttgcacatagacctggtatgttagacagattctaagattcccatctcctcatgttcaggccttgtgtaatttccacttctgaagtgtggatagaatctgtgaatactacgagataccactcctttgattctgtttttttcagatataattaaggttactaaacagctggctttgagttaataaaaaggactattttgctggtgggccagatataatcatataaaacctttaaatctgggtttagaggtcagggtcaaatgaagtcagagaacccaagcagtaggaagattcttctgttggccttgaaggagtaaactgccatattgtgaagagggttacgcagtacagaatggcaggtggtctctaggaacaccagtctgtcagtcacaagtgactgaattctgccaacaacctggatgagcttgaaagagaaccctcagctccacataaggaccgcagccatggctaacaccttggtttcaacctcgagctaagaacccagctaccctttgcccacacttctgacctacagaggtgtgacatgtaaatgggtgttatcttaagctgctacattttttaaattatttgttagacagcaaagaaaactagtacacctggcttagatgataagatcttggacttcgagctgatgccataatagaatgagactcttgggaaccacaataaagggagtatgttttgcatgtgagatggaagtaaatcactgagggccagaaagcagtcttcttcactggtagccagcctccaagatggcacccaatatgatcctactcatctctgggaattcattcttttctgtagtcccttcctcactctcacattgcgtagggctgacctatgtgaaaaaaaggatacgttgggaatgacattgtgtgacttttgaggctctatcataaaagacattgcagcttccaccttaatctcctatggatcacgcacactttgtgaaacagcccacaaaccatgaagatccttaagctgccccatggagaagaccacccaacaaagaattgaagtctccccccaacagcaggcactaatgtgccagccatgtgagggagccatcttggaagtgaatcttccagctctagtcaagtattcagaagaatgcagtcctgatgtatatgactgtaatatcatgagagagtcagctataatcacccagctaagtttctcttaaattactacagacctaaagaaactgtgggcataataaaatttcattattgttttaagctgctaaattttgggtatatgcagcaataggtaactaattaagaggtgtataagacagtttctaaaaattgagtcccctctccaggttatagtggacaatcagtttgcaacagaaaaagagacaggaataaaaaaaaaaagagtcgttcagtagtattttaggggaggtttccagataagcacaggctaaatctgtggttcttgttcccatagttaatagattatatgtctctgattaaaaaagtgatggctaaagacaaaagactttgacaactggaccagatgaaaagattaagagttctctctctgggctcttctccttaacaccttgattatatttaacactcccttaacacctttctttatatgtcttgtacaaaaacagcagcaaaatagaagaaaaatccttttagaccaaataatgacaaagtggaaacacatgcctcttagacacaatgaaaatcgtgatatgaaggactcctctgtactgtagaacagtggctgtattctgggaggaggaatttaaatgccatacagaagtgtaacttcgactctgctaatttttcactgaatttcaagagaaatttaatgtctgtaaaattagattggaaatatagaggccatacaaattcacaatttgagattgaaaataagcaaataagtttagaagggagtcttaaatgtaatttgttctggttataaaaatcctaaagctaattataaaaattttgaaataaaaaagtgaagaatataaaatttatccataatccccatatttagagctaactactcttttcagtttcctatgcatatgttataaattgaaatatttctgccattaaaattttatattttcgtctaatttaactagcattaataaaataatttccctgtgctattaaaattatttttaagctatatctaagtgccacttttaacagtctttaaactataaatgtatgctcaatgttaaaatcaaagaggcagggcagaaacaggcaaaaatttgggaaaaacataacccagaattaacattcacttttagtgtaccagcttccaatcttaaaaatatacatgttacacatttgcatacacatttgcaaaaatgacatgctatgtatactgagtttatcttgctcttttttggtttcaattaaaaaattcaataaaaatattgtttacaacatgatttaatgggtgcctagtattctatcatatggacataatttacatatttatgaatagttcccattatggtacagtttggtggttttctttaatgaaaattttgaacatgtatcatttcagttttagattaattccttaggataacttctcaaaagtataattattgggtgaaaaatgtatgcataaattcatagtgatagatatagccaaagaatttcccataaatattgttgcaatgtatatcttaaccaagatgaaagcagatccttttctccttcactggttatgagcgctttctcatttttagagaaatctgatagactggagatggcatcttggttgttttcacttgcatgtcttttatgagtagtaaaactaattttttcatgttatcttgacattttttacatgcccacctattaatgtcttatatctattgaaaatcattacatttatccttttattgtcttgtaaaacctgtttctatgttaaatttatcaactctttgtctatgcatataatttttttcaatttgtgacttcctttttaattatcttcattccttttcaagtaaattaaattttaaaacatatatgtactcaaatatgtcagtattttccctaatgatttcttcctttgaagttgtgcttagagggtatcaccctaaacatccaatattatataagcattgaggatattttcctctgaatttatgtggatttgatttttataggtggttctttaaaactctgtatctgaaccttatcttgaaataatatgtgagattagaatctcacttttatcccagtagtattatttaaaagcaaaggtattgcacaattaatacagtcaccctatataatagagacaagtaaaaagaaaaaaaatgccaactctaatgtgagttattaacatttattcaccctctctcccactcagcctctctcaagttgtcttgcttgaaggtgtgtgttggcaggaatgggggacagccatgtatgccaggcaccgaacacagcagctttacatgtttgtatttaattctcgactagacttgtgaggtagaaattactctgtttcaaagatgagaaaggagggacttggagaaatcagaatgctggagattatagagttcagagcctggcaaatttgagtgtgtatatgagttcctggtaatgttgccaaaatgcgggctctgatccagtaagtctagaaggggcctgagattctcccttctaaccagctccctggcaatgctgatgcaaatggtctgtggaccatactttcagtagcaaagacaaagatgacaattaaataatggaacttgatgtacccctaggtctttggacttctgtttctttccacactatcacgcttcctctagctgctgtcaacacatgtgtgcttgtacttttaacaaggttccatcctaaaacaaagtcaaacttcttaagcctcacttttatttacaaagatacacgtaataacaaatatttaagaaatctgaaagtcaaaatgagtgatgaaaagaaatttagaaggaaaacctcaagagtgtatgtcacaaaaatgttccaagcatgctctccaagggaacttgtgaaaatccattactaaaattaatttttaagaccagaggattatatcccacagaaaaaccagaagggtagaaattttcatagttcatatttaataatctacccattctctaaatatgaaacattcacaattattgctcaggccaatgcctactgtgaatgtttttgaaataagagcattctagtctcataattttatatcctcaatgtattcttaggaggcaggaagaagaaattattgccattcagtatgagactaactttttttgaaggcaagcctgaaaagaaagagcatttcttcacacaaatacatatttttgattcacataattattatatctacagaagacttaatttgaactcaataaaaatgatcattttaaactatgagtcaagtattctacgatattgcccttggattgaacaaaaattacatatgatgcaggcaatctttttttctggtttgttcactaaaatatgacaactataagacatattacagcttaggactagagaatctaaagagaattaccctccaaaaatgagatgacaatccgatgtgaaaagtagactgaatgtagagctcataattctacttcaataccactatttcctagtaatagataagaatcatatcatttttagctggaaaaaaatcttagagatcattgaattcaccccttgctcttgttaatgactttgctattgcctttatttatagaagtggaagataagtggtatttctcttttggcattggaattctacacacagacatggttttgctcttccagcttactgagccattctgatgttcatacttacaatacaggcgaagagaagactattacaaaggatcattttagtggaaaagaaagtcagaattaaatatctcactaatctataaaaaattatttctgtaggtgcatgtttctctcatcaatgtgtacgacagttaaatgcataaatctcccacacatcaatggaaaaataaatctcgtagtgatgagcacatgacagatttcttttcagaatacgggaaaatacacagtcacagtggctgcaagtaattttgtaattgccttactctattaccgacacggcatctgctcaatgctctgagaccttttcctctcatcactgaattttgcatttaatttgcataatgtgtcaaagaaagaaaataatggatctggctgaactttcaactgaagtaaatcatggggaagcaatgcagaagcagacatctctctagaaatgcattaaaatacaagggaagtcaacaaggagtcttaaaatgctcatttccaagtactgaaattgcattttttcaaacttttacatgaaagctaaaatgttagtcctctttttaaaatattctttcaaaagcttatatttcaaagaaaatgagtattagtccttttttttctacaacccacccacttggtaaaaggcactagataaggccctaagcatcacagatttggaaatacaaggaatgggatgatgaactaacttcagcattgattatgtcacatacaagagtcctggttgcccaaacaatctcttcgtcatctgccagcttctaaatcttattcccgaatttagattcatgaaatgccccgcaagtgtgcaaagtcagcaatcagccgagagcctacaccaagtgcaccaccttggtcatgtgtgctaaagctacagatctacatctcccttatgcccttggtcaatctgggtttacacatcacgcatttgtccagagcaggggatacctgtaacttgcttggtatggagaataatattctattgttatcacttttgttgtactttctgataaatcacctttatctctttaactggtttatgggtgatggactagcaccttcctaactccagataagtcattttttattcctcttttcaagatgctagctcccagaatacatcaaagactcttatattttcaaaatatatgaaaaagaatacttgaattttttcacctcaaatttcatctctgaatatcacaaagggagggattataaataaattatgactaaaaccttccaggtttatttccctgatgagcaagttatttctgaatcagtattgatttttttgtgtgaactatcaaccactacctttagaactagtaacattttggaagatgaaactggaagacatttctcaatgagtttgatgcaccaataaatttatcagccagactctgtttctaagattcataaaatttactccaaggaatacaggtgaggaagagctaaaaaaatctataacatcaaatgagaactcattaactagatactcaaatgataagaattgaagaaatataagggagagagggagaaatggaggaaaggagggagagcagaaggaaggaaggtgggaaggaaggaaggaaggaaagaaggaaggggggagggaaggggggagggaggaaagcacataggcagtcaggaagtagggagaatggaaggaaggaaggagagatgaaggaaggaaggaaggaaggaagtagcgagggagggagggagtagggaggcatgcaggcaggcaggaagtcaagcaggtaggctgggttgtttccatatgggactctttctatgcaaagacaaatatttcaatgattctgagttttactttggctcatgatataaaattggtgcatttcataggtatgtgagtatctgagaggtgaatgagtgttcttagacacttgggcagcagctgaagctcacctggcattcctacttgatgctctcatagttcaagtctcaactatggtgattatttggagcaaagggactggagggcctagaatttccctgtatcctacctctctgtggtaggatgtatcatctggccccaaatccctactccttgcatctatgtattcattctgagccctcccatcaagggtgggaggacctgccccactgcttgtctttgccctcattcacgggatgtcagtaactgtcatgacagagacttgaaaatgtgcttttgtgttgggcttgttttcttccacctcttccatctccacgagaagaacacacccaggcaagctcatcagtcccagaagaaagatgagagagaatgtggaatggagatgcgccagctcacatagatgtctgattctatctgacactcacataactatccataagttcaacatagatcaaccaaacaccagttgcccctcagatttgttaaaaataataaataatttcttgttttaagccacagtgatagctaatatattttccttttgccttcatggtgggatctaacaaaattagtcaatatctttcaaattagagaaaatgggtaccagtctcaaggggatttctttggtctttgtcaaatattcactcagataaaataataacaagaatgaatgtaagtttttacaagagactctcacggaggaactactatacgctggttgatattgaatagaggctccagaacaaacactgcacaagtactgaagcaacatgggaatttatgctttgttggtaaagcaataattcttgcaaattcactagtgttattcacaaagacactaaaagcatctgtttgtttaaattgatagccattataatctttagtaagtatttgtttttccaaaacaactaagaagtgaacatctttcatttcctagggagaaacaattcaagcaaaatttcaggctaatacctgacaaacaataacctattttccagaaattgccacttagttgttttcttaaagacatgagaggtgcctctcatttcctcagctctgccttttctgcttcctaaaggacagttcgctatgtttgatgtaaaaataggcagtgtaggtgtatagagggtggtttctaatggtcatacttcaccattcatctgatttctaccatttccttctcctgacaaggagttcttaggcctccgacagaaatccatgtatagagggttcaaaggtaattccaaacagttcacatgataataaggttagtaaccctcccctaaactcatagcaacatgtgtcatttgtctttataaggtaagattattctctggttttttaaaagtatgtctaatgatgtgctttttgaagaacaggataataaccaactaaattttcaccaaatttcctaaaaattgactgaaattgactccttttgtgagtgttaaaaggatatgaatttacatttccactgctggataataaaatggtgtgatgagctgtaccatggtgagattctacacaagtgaggcactcatgaaagtggtacttggagcccaaggtaatcagggaagatgagctcctgagtgtggatataagagcttatcagtttggttctttgttcctagatttcaagattgatatgatcaagtttacaaattggtcctctaaaagtacaatggctaatgctaaggatgggtgtgcagggattgtagttggaagaggcccacagactcttaaacagaatttgggaagaaagggatatttgacagttgaattggagtttattgagttatacattgctccattttcattggcatagtaaaaaggttaaaggagaaatcaacaagatattagggatagctataaggacccgtcgagtaaggtgattttcccagtgatttggggataatgggtcacatttcctaaaaaataatggctctcatggctttttactgtgagaatggataggttgagcaaggataacaagaatcagcctggggcccatggagatggatgctgtgaagtagatggatgcataaacttgaaaatttgagacactgaaataagtcacttgttattgattatcttcatgaaaatgatgccattggatgtaattaagagcactttcttcttaattgaggaattctgtgatgagataggtagtcttcaccttgttccacatacatgcaccccactaagtgatttttttctaaatatattatacaatagggaactgttattttacttattgaagttaatagctactattgtaataatttagtgacaacatttgtgctaattgctgagcagaatatttaaatgaatcacttttaaaatatatacttgcaagatgaaaataggtttaaatcctaaaagaccacattctaataaaaacactgaaaatgaaatctgagaatcacatttaactggcttttagtcacaaagtaagcagaaataataagcataaacataattgcaaataaaatataaaccgaaggtcctccaaagaatccaaactacagtattctttctcattcaagatactaccctacttaataccacataaattatcattagtttctgataaatgctaacataaccttgttgttcgaactttttttttttaattatttttattttttatttttttagatggagtctcgctctgttgcccaggctggagtgcaatggtacgaccttggctcactgcaacctctgcctcccgggttcaagcgattctcctgactcagcctcccaagtggctgggattacaggcacccgaacaccacacctagataattttttttttttttttgtatttttactagagatggagtttcgccatgttggccaggctggtttcgaactcctgacctctggtgatccacccgcctcagcctcccaaagtgctgggattacaggcatgagccactgcgcccggcccaaacttttgaatacagataaagcaatacagaagctgtgggttatttgttttgataaagacaataacctatatttaatttagcaacatttttagcagaaatttaagaatcaataagcctaattttttttaactccagcaacaatttaatgagtcacctaatttattttcagcaaagcctaacaaagcctcagctggaggagtttccaagcgaattgttagccagttaatagagaaaaatgctaaaataggtcattgacataggtagacttctacttctacacaacattctctgaatttcccctattccccccaaactaccagttcagttcagtaattacatggagcaaccattcgaaacaatgggaaaacaatcaatttgagtgtctcttcaattatatggagaaaaagagaggagaggagtagcgctctacttttcagaaaatttgcattcctgttctatggttaatgttcattttttttcccccagctctcatctcacagtgttggacaaaaacttcaccctgtgaaaacacatattaccaaggactgtatttggacatttgcattgcagttccttggggaggatcattgttaaatatgcagattctcaaaataaaggatggaaaactttgtggatatggagccccaaatctgcgtttataaaaattctgttaaagctttgtgaaatcaggactgttttcctgcagatcagaggcttaaaagaaaacaacagctggcaaaggcctgagtagggccagccttaggcaaattgtgaagcagtccaaatttagagtttttatctctcagttcatttgagagtttacttagaacaacttgcttgtcctcctgtgccagtgctattggcctctcttctcactgcccaggggaccactcaacaccaccctccaatcagctgagcatcccaaatgcagtctccttactcctgagtgttaatgcctaactggccgctcctactcttccaggacattcccaaggctacatcctatgccatcaaaaccatttctatacctcaggggcctactccataaggctggacgtttcaccagctaacacattttaagttatcaacctgtttgctttttaaaaataatatttataatttttattccaaaataatgcttgcttaaaacaaaataattagaaaactaagaaagaaagaaggaaaaagtcatatctaatcccatttgtcatgcgtatcctcagcttaccctgacctctaagatacatatgtacaaattcatgtattgtgtgggtgtgcgaactcacacacaggcatgtgaagggcagtgtgttggtttagttcctacctctggaaccagactggctgactgtgatgctagttttgccacctttgccaggtcacttaaccactctacacctcaatctccacgtctgtaaaatggggatgctaataagacctatcacagcgtagttttgagcatgagtgtaggcatggttagccacagtatgtgctgtggttagcacatgcacactagaatcagctacctgaatttgaatcccagctcaataactagcagattttttttcctgcggaaaagtttcttaatatctctgtgcctcaatttccttatctgtaatataagaagctcaattgggtaatgacaaataaaaagtcagatgacaagcagttttacagcttctgtgttattggaattaaaagggcaacggaaaattacaaactaatgatatgagatgaatttgacatttctattcttgggctattaggacttctggactaagattaactttcatattattgttttaattataaaagaaaaagcagtatattttctagggaggaagaaggtaaactcttatcgtgttcttaagggatccatgacccaagcaacattaagaactgctagggcattagatgatcttcttgctccaacattcaataattttacattttatgctacctattttgaaaatctacttccttaattttttaacttgaatgacatcaaatgtactccaaagtagcatttctaatactaaattccatgagactctagtgtctgtctaggtactcataaatagagtgccagaatttggaaaaataatcccagagtatattttccttttatcaaaatcagataccatgatggcccattatttatatatgtgaataatactattaactttttgttttgttaatttcttactatttttttttctaatttaggactaagacaacattttagaagaaaaatgattttctatagtcctaaagagttctaaatcactacttcaaaaatcatgaaatagaaaatttcgaatgaagcaccgaatatcttttaacttcagtttgaaaagaataaacttttctctatgaaggctagtcagttcactgaaacaaccattggactgagtttttgttttaggcatgatggtacttctatctacatgttaattctccagcatttatctgaatttatgctctaagtatgcatgtttgttttggtattgatctctgtccattgacctgagctctgatggaaatgatagcaaacatgagatgtcttttagttccctaagtaccagatatttttagtttaggattttttttaacataacttatgtttgtgatggttttggcactgtgacgaggggagcccttttgccagtcctgaaaaatctccattgttttaaaaatatccctccatgccattgatgaaatccaaaagaacttcaaggatgaaagggacgatgcagcttcaaaaccctgactggctccctggaaggctgagtcactgagcagtgccctgcgtgtagtattcatgggaacagcacacagcacagcatcattcttctgagctggcagggagctgaaattaactgaaatatccacatcttggaggctcttcagaaaaggatttgctttctgttcaataacctcatggttcaagcagtgcagtcatgggcattagtgcgatgtgcgggtagacattctccttagatgtcttagatgaaacccttggagtccaggggatgctgagcagtggtcagctggtagtctgaaaccttatagaattaaaagctttaactggacctagtaggagctaatattttcaaatacccacacaagttcaaaaatatgacaatttttgcaattgaaatcgtaaatgtgttggctattatttctttctttggctgtaacctgcatgtaaaagagattttctgtgaattgactctaacaaatgcttttaaacacctgtctgattaatcaacacattaaaatagtgtcttcctaaaaataaaccagctctatttttatttcacttgccctttaccctctcaccaataattattcaatgttggctaataattaattgcaatgtaaaagggcatttcactatgcttagcaaagagctgggtatatgtatagaatgcctgacgtgtgcctatgaatagttagggaagattgccctctgagtttgaatgtgttatttttggtggtgttatttcctgtgtagctctatggaaataacaaacccaacagactggcagtacctttcacccttagatgcctgtggagcgtgcccttgggataacgattacagacatgccctgtagcacttgttcctttgtaccacaggaaagacatggggctacagagaggagttgctgctagaggctgatacatgatgtcactccaccaggttccccagtggacctactcagagcacggtaggatgctgacaggcctgctctggaggactgcagtgcccagcacagcagcagacagtctcagtgagtagcctgagatttagcaattcccacaccaggtcacctaagactctttctgggacaggctcagccaagaataataactaccttgttatcaggaaagggcagcaagccttttctgtgaaatagcctagtattctctacatttctttctgggagtgaatttgcaagatttttacagaaataaaggagaacatctgatgcccaaactaggtggctcttaaaacttaagggagcaatttggtgcaaaacaatgtttagaattcttcaatagattaaacataaaaggaagatgaatttaactggaagatgtctcacctgtttttcgaaaactgtatgagtaacgaatatattttggtaattctcccatgtagtgtaaatattcacaataacttaaagtctgtaaatgtaatttagattttcaggattaaatcccagttgagctaaaactgattaactgaaaaacagaggtgccccttaggtttcttctggtggtttactcagggacccactgccacagccttttgtagagccaagagaaatgtgtagcctaggttcttccccaaacccagcaactcaatgacaaatctagcagaaatgtcaccataatattctgactaaagcttcagaagacactattttgagacagagtgagtatattgtatctaaattgtcaggtctttgtacgctcatatttatttagtaatttcactttcctttttatatcccatttcagatagtggtcatttactatagtaataatgatgacaaactattatttattgagtgctgacttatatatttgatttcatgtacattattttaatcctcccactaaaatgtaagttctgctattaccactgatgaggaaactgagtcagagatacaaagggacatgaaagacatgtaactatagtaaagtgtgtggtgcaaacaatccaacctaagtcattctgacaggtgattgctgctagaacgctttgcctccagcactgttaaaacaactggattcctttaagccctgactatgatcttttaattctgaaatactatgaaaatgtaatttgctaataatttactgtggattaagtatatgagtaagaaagcttattaaatcaacagttctagtttcagtctctactatcttctcaatcatttgtgtcttgttttttatagaagttttcagtaagcaatgacaactgtatgttgacagaaaaccattcttaaaatttgcagcagacaggactcctatacatacttctttttttgtttattgaaaatcttattatctggattctctctcattatactttcatttctacaatattttcaccttggcacagagacataaatattaaaaccagaagatcacattctagtaaaagaaataatggtgtttccatcactgagaataagtgctttttcatatatattgcaaattccaaaaatgtctcgggaaatgagttaaggaaggaattgcttattccatcacaaagaaaatctcaaacaaaataaatttacataagaaagtacatgaagactgggtgtggtggctcactcctgtaatcctagcactccggaaggctggggcaggaggatcacttgagcccaggagtttgaggtgacagtgaactatgatgatgccactgcactccagcctgggcaacagagcaagattttgtctgtaaaaaaataaaaataaaaataaaggaaagtacatgaagatgcagcaaagctctggtatcagtaatattctgaaatagaaacagccattccttcctgtagaaagtctgtcttgagtttgaggagtctctggaggatgtatgatgggcaaagctgaagttgtcacgatctgcctaatcaagtgtctcttcaacagtgtccatggggattacacaatgtctaatgaagttttaggatgatttgttagactaagccttccatcagacagagttctttcattaattatgattccaccctagagactaactaagcaatatgtcccaatcttaataaaagtcctcctgagcacgtatgaatttataaagtagaaagtaaaagctgtttccactttttgaagataatttgcaaactggaagtcagactagatggcacaggtcacctatatctgggagcctaaagatgattataatttcagaggataagaaaggaagcttacttaattgagatgtgtagagagagaagggtatgaagccaggagaacgagatgtgacccttgatcccagagaagaagatcttcaagagtcacttctatgacctggcaatggttcaaagatactttgtatgaaatgaggacacatttttggaaactaatgagcttcaatgaaaaagagatgaacatatttttcgacttcagctaaaaaaaaaagattaacttccttaataaaaataaaattaaaactgcaattagacattgctttcacttatttaaatggtaaatattaaaattttataatgcaatctattaaaaagtatactgagaaaaagcaaaaatagtcatgtgagggtaagtttggtgtaatttttttcagaacaatctactaaaatccttttaaaaaatatgtatttccttcctttgacttgggaattccacctccaaatattaattctagagatatatttactttacatgaacaaataagtaaaagaatagtcatcactacactgtaggtagtgacaaaggatgggaaacaatccaacagactccaacaggagtctggtgaaattatgtctcatccagatcatggacgatactgcaattgctaaaagcactatggcagatttgcatgcagagttaggaatcaatctccttgctatatcattagggaagataagcaggaagcagaatatgatatattatgtcttagcatttgagtaaacacataaaagatctccattaggaaatacaagagtagcagttgcctccaggaaagggaattggataattgagaactaaagaggggtttactggtcatgagtatcttttgatactgaagatcgtgtgcttgtatcatcgagtcaacccaattaatcaattgatcttttagaaaagactggaaagaaaaggtatctaaaacggtcaggttgcaaagtcaagtaaaattgtgtcaataaaatggctcggagaagtgattctcaaatatctgggtatcagaatctctttatagtcttaaaaattattgaagactcacagatttcttgtttatgtggaatatttgccatcttaaaactgagacaattataaatatttatttactaattcattttcaaaaaatataataaatttattttcggtaaaaataactattttccaaaaaactgtgagaagagtgacaatgttttttatttgtgccacctaatggaagacatctaggttctcatgtctgcttccgtattcaatctgttatgaaataatatgcatcacattgtatagcttctggagaactctgctgagaaaatgtacagtgaaaattacaaatgacatgttggtgttattatgaaaatatgtatggtctcacagacccctaagagaatcctggggaccaccctctatgagccccttagaataaaaatagaactttgcaactgaattgccattagagaaaaaagatcactttctttagctgaagttcactttctagtattctctaactccatcagtaatgtctaactgtcctaaaacatgagttcataaagctcaaagaaggcaacggtgcctgataaaaacaatcttctaggaacgacagtttaccaagtttagttctcctgcgaaataatactagcaaaatgttctttgtgtaatgtagtttctcacactggctaaacaagattatctttcagaaaataaaattctagctctaacagattcatattttaatttaagaaataccaaactatttcccatctcctctaaaactatcatagtcatattattcaacctctgtagaatgggaaatgcagcatctaagaaagcatcttttgtaaggggctaacaaaagttgtaattaatgtagtaaataacagtagtttatcctttcagcacatttttattgaattcactttatgttcatttattgtgctctgggttgatgatagagtggtcagaaaaacaagcctgcaacctgccttcatggagctgacgatctggctaatagacattaatgaaaaaaatctcataagctgctatggatgaaataaaactacagtaagctctgagagtccctaacagggccaactggcaagatttggagaatcagagacacataatcagaaaaagggagatttgaactgagaaacaggagaagtagggggttaataggcagtgacggtagggtttggaggtattattcagtgtagaggaaacagtatgcataaaaactccaaggcaggagtgagtatggtggtttccaagtgctgaattaggtcaaaatcagccaaataatagagagtgatgtcacgaatgatacaagatgtgctgtcaatatacacatgcatcagatcatgcagattcctgaatgccatggtaaggatttccatatttataatgagagcaacagggagctgttgaaaggtattacagacacttgtttgtgtttttgttggcatgtttaccggatgcaagatgaggtggccttgcatctagcataatggttcgttttctcgtaattaccagttgaaagtgaacctcaccacctgcttgtttgaggttcaaacaatagtccttgacctcaatcagcaaagtggaatataacatttcaggtcctcaaagtgagttttaaagtgaaattttcttactatctgctatcaaaaacttcaggaaaagtgaattttcaggattattacctaagatatctaaggaatgtcagcatccctccaatcctctggttctaaaagttttatgtaagagtgagttaataaccagaactgtccatgctaggaaagtaatagtatggcatttgaatcacctgcccggagtccagcttcaacattctagccttggcttctaataaaatttgttataagaaagaatgctatgatagatacttctggatttgttgcccacataccattagggcaaggtctgttatctggaattttccataaagtctcatgtggtaaaaaacattgctggaattttgtacccaagacaacatgtttttccctaaggaacatttcttcttttgcattaatgagagcaaattatttaataaattgccacattggcccaaccttgatagagttaaaacaagttaaacagaattaactatgatggctcttatgctttctttcctttgcttcattccaacaatatattttgctcataccaaatcaacttaaattctatttcataagctctctctaattcttttacaaagtgatatgtggaaacatatataaatgtaacaaatgcacatgttcagttttaagaagtacactcgatatatcctcaaaagctgaaaaaataagttcaatgggacaatttcattcattacagactccttttcttttaacgttgctaaaagcttaaaagacatgaaagcataaatatttatttgtatcactgtaagaatgactgaccactacataaaattggaaaagaatgcatgcctaagaagggactacttaccttattgatatagttttcattacaaaaatcaggctggtggcatcaaacatgtgggccatggcctcactccaaactgctgaagctcatttgggatcacaaacgatttgctaaagcctcaccactgctgccaagacagggagattgtactgaaatgtacatttcagagccaaatttagtgctttcttggctacgaaaggtgaagccaggacagcagaaaggaaacctaacaatgggaagacaggaccctggagtaacttcaggaaaaactaatccaagtaagaaggcatgggatgtgcagttgccgcttgttttgggatacatgtaattcattttttaagttattaactacacacataaatacacactcacacatatacctgcataaacatagaacacgattgtggtgggcagaattctaagatgatctccaatagctcaggcccttacactatctcctcccagatggtcaacatctgtaattttcttttaaccagtggaatatggcaaagttaaaggattgttcaaatgtaattagcatccttaatcagttgactttaagttaatcaaaggttattcagggttggtctggtctaagcaagtgattagctctccaaaaaatggcctagaagtcagaagtcagagtttctttctcctgctgaccttgaagaaacaagcttcaaggaattttacagtggttaagaaattgattctgccaacagccacctgatatggaaaaaggagccagaacctcaaatgagaccccaatcctggccaacacctttcttaaagccttttgagaccctgaacagaaaacccagctaagtcaagtgcagtctcctgacccatggaaactgtaaagtaacaaatgtgtattgttttaagatgctaattttgttgtgatttgttatgctacaatagaaaataatataatgatgtttggtgctgtgtgaaaggtaccatgctgaaagcatacacttcggttgcttaattagtacaacttcagtatttgaatataacctaagaaaaatcaatgggtattgacaaacacacaaatacacaaatgtatacatccatacacactgaaatttgccatcaagggagaaaaagccaacttgttttcattacctacaccctcaaatttacttcatcttttgtcaaactcatcttagttaaaggcaaattttttcatttttggactagttggacaattctaggtccagctagaaacctcggggtcatcactgactacttactgcccctcatcccttctaacaaattggtcaccaaatcgtactacttccttttgattctttttcatcccactctttaactcaatctctactgccactcatgagctcttctttctaccaaacaatgcttctatctgatttatctgttcatagattccccacctcaactccaccaagcccacgacttccctttcagtcttagaggtgctccctaggtcaatgggaaggaagtgaaggaagtcaagtagaactaaacttggcgacgatgggagaagaaaggctagagatcagataacagacatgcctaggaaatgatagatgagtttactgaccttgttatggattctgagcattatcctgtaaacaatgcaaaaccactgatggattcacaacagaagagttacacacacacacacacacacacacacacacacacacacaagagcacacaggcacacacacagcatagtctttccttgcaggaaattattcctaatttggaaatgaaggttctttcacaaatcagcaagttttttgcaataaaaagctacttaccaactctgcaaacttggatatagtcaaatcattttttccaactttttattgtggtaaaaatacacataaaatttactatcttaacaatttgataatcataatttttggtaaacagaatttggaatctgagataataatcatgactgtatagaccctgcatagtaatggttcaattgaacttagttctagttctttctcctcccttttgctaacagtgaaacatcaaacaatattcatcttgcccattaatattgaagtaaaacttgctgaggcagtttggtctcagggagtgtgcacatttaaataccaaaaagttaacatctacctagaagctagagaacaaagttagaaaacaaagaaacaatagggaatatttttgcctttgggtaattcagtagtactgatcagtaggaaaaaaaactcctactgactggtaagaaatgccatagaatatgggtacgctcaatgaaaatggaaggtttttttcatatgccacctctattttcaccctcttagatacaacgaaacaattagagactgcatgtcttcatctctgaatgtgcttgtgcgcaaaatggctatgtctaaccagatactctgcatttacattgtgaaaggtacctttctggggctgaaacgctatacttttccccttccttcatttcttgtccctcctcatgtatacaaaacagtgtttggagaaaagaaatatatactacatagagtcaagtcattaagtctaattccaattctctagttcgtggtttcaaaggaaaaattctgaaaatttaagcagagatcaagagaacattcttctaattttctgtacccagatgacacagatttttaagggatgacacagtcagggggatgactgggcagatcttgaagcaatctggtagtcacatggaatcagccttttttaaggccacactcacattttggggctgtaattgtttgaacagcgtagaaaagtgtcagagctgctaactgcacagctcaccagatgcaggagtgggatttgccactccaactatgcagaagcttggattgagccaagaatctggaaggagacaatatgagaggctttccttctccaaggcttaaaagggcatgagattctattaggctgaaccatgtgaaattagcaatattttacaacttttacctatgaagttggttcgacacagtacattgcagaaatgaagagggagaatgtgctttaaaatactggtgtaataaatcatacatgtctctaaaccaaaacaataaaagtacataagcagaaaaatactctatacgatgatagaatcaacaggccatggcgttttacattcgctttcaactctgctgggtatgtttttgaaaactagtgacttatgccaatacttccattctaaccaatattcttaaaaatcaaaaagagttgttgaaattttgaaaaaccaagtaatctagtaatacaaaacagctttctattgttaataattgcatatataagaagcaagatttaagctaggcatggtggctcacacctgtaatctcagcactgtgagagactgaggtgggaggactgcttgagccaggggttcaagatcagtctgggtaacatggtgataccttgtctctacagaaaaatttttttttaaaaaaatggccgagtatgatggctccctacgcaggaggctgaggcagtaggatcctttgagccctggaattcaaagtagcagtgagccataatcatgccactgcaccccagcctgagtgacagagtgagacctcatctctgaagaaaaaagtaagatttagagttggtgagtccagtgagatgttacttttcacataatgtcccttcactctacttctcaacatctccatggtatttgcacaaacgtgaatattctcattgcattattggaaattttatcacatcaattccttttgacaccatgaataaaactgaaatatgaatactggagaattctaatgtgtgccagaagagaacttcaacttctataaaaaagtgttcttattgaggaaacaattttcacttaacaagactgtagataatagagttataactcaagagtgatgatattcattaaagaaaatagacctgtgtttctttactctctctactggttatgatttcttatccattttaaaaaaaaataaagtattgggagaatacaaagtaatattatatgtaaaaaagaaccagcaatactgtaccctttcctcacacaaagaaaatatttgcttcggaactgggttcttgccttgactatgtcaattatcacagtttttctcccttacattcaatcatcccaaggaatttccaacctgacttggtgactccctcctccctttcatatagatgggactaatggagcattaatctgactgtgaaatgattcaatttcaatttttctaacctgaggctataattatttttcttcttagaccagtaagcaatgagtcattaaagagaaattctgtggggcagaggtcccatctgaggtccaatctgataagtgcacagggtacaaaagtttgcagatatcctccttttccaggcaatgcagaaaaatcctggtatctggtaagcttctctttccatatattaattattaaggatcccacttataatatctacagattctctgctcttttagtgatatataaatcatggaataagactatccaagataaactgtcctttgttcagagttcacatttcaaatgaacacaagaaggaatctgtggctgggcatggtggctcatgcctgtaatcccagcactttgggaggccgaggcgggcggatcacgaggtcaagagattgataccatcctggccaacatggtgaaatcccatctctactagaaataacaaaaattagctggacgtgatggcactcgcctgtagtcccagctactcgggaggctgaggcaggagaatctcttgaacccaggagacagaggttgcagtgagccgagattgcgccactgcactccagcctcgtgaccaagtgagacctccgtctcaaaaaaaaaaaaaaaaaaaaaaaaaaaaaagaaggaatctgtatcctgcttgaaaaaggacagagtgagaattcctccttaggtcccatcactgactcctcttttcctccttgcactttaaatggtgcacctctggcttccatccttgagcttttccccactggcatcccttatttaggtgttctttctgatgctcatcatattttcctagtaacttccaaccaatccacactattctctcaattcttctgagttcctaaaatctgatatattgaaagaacctgaactttggagtcataaaaattctagcattagccataaaaaaagaacaagatcatgtcttatgcagggacatgaatggagctggaggccattatccttagcaaattaatacagaaacagaaaaacagataccacatgttctcacttagaggtgggagctaaatgatgagaacacatgggcacatagaggggaatggcacacactggggcctattggaggctggagggtgggaggagggagaggatcaagaaaaataactaatagatgctaggcttaatacctgggtgatgaaataatcgctacaacaagcccccatgacacatgtttgcctatgtaacaaacctgcatatcctgcacatgtacactgagcttaaaaggacaacaacaacatatatattctataacttttctaagttccattttccaggtctgcatctagagaaaagggtatattttccacggtctgttgaaaagattaagtgaactgtgatctgtgcaaagcttctaggagtaccaagcctcacaaattaataaatgatagtgctgaggaaatatgataatgatgatgatagtgatggtgatgatgatgatgacaataatctactgaacatttctatttgtgtgttcactagcaaactcttcagctttcctcccctgacctggtaagtgctaccatcactcacccagttggctgagtacataccttaagatttccatctctttattctttatccacctgcctttttctaattgattgctaagaatggacaaacctagcctaataatatcaacctatttattccactgctctaagttatgactctatctgctatactggatttttatcataatgtctcaactggactccccccaccttctgtcttgctttatttttattccccttctatgctactacaagaggaatctttctagaggacattgattatgtttctcttcaacttaaaactcttctatatgaggaacaattgggatagtgtatgtcaatgcactatgaaaaagtctttttaaataatgatctataaatggctatctcagtaatattatcttaggaagatgtagaagtttttatctcatagaaagggaaaattactgttgcatacttatcctaatactaagatgaagggaaaggaaaaggataggacaacaacaacaaaaatacatagtaattgtcctacacattaatggtattatgaaaacaaatatttagagccaaaaatgcatacatagaaccacaaaatatgaaaatatatataaaatcctggtttgagagcaagtatctttgcttataccatatttacaactctacatgaaaacacaataccttgattctaagaaaatgaaaaattaaagaattattcttgtcaggtgtgggtcttaagaatagtcatcctagagaaacaagcaaaagaaagactatgaagtgtttattgttgttgctgttttgttttgcctgcatgttcgtttggttgtttgtaagaggtatatcaaatgcaaaggcttgttaagtgtgattaacagattattatggtgtctatgcagatagaattagccagaggcaaaagcacatggcagagatttttaaaaacatacaattgataaaaaggataaaaaagcttaaacaataaacatacatgttcataagtgcagcaatccaccatggcacatgtatatctatgtaacaaacctacacattcagcacatgtatgccagaacctaaaaaaaaaaaaaaaaaaaaagaagaagaacaaaaaaaaagcttagataagtttgcagggcatggtgggtcactcctgtaatcccagcactttgggaggcggagcttgagcccaggagttcaagagcagcctgggcaacacgtgaaacctcatctccggaaacttcatctccacaaaaaaatacaaaaattagctgggcattggtggcacacaactctggtcctagctacttgggaggctgaggtgggaggatcagctaagcccgggacaaggaggttgcagtgagccaagatcgcgccactgcactccagcctgagtgacaaagcaagattctgccaaaaaaaagagaaagaaaagtttagacaagtttccaaaaggttttaaagataaagcaaaaaaaggataattttgcaataacacacagcaccactccccaaactcacccctcaacccccgacacacaaacatccacacatcagtgtttgaagaatttccagtgatagatgggtacagaaataattaagattagaaaaccaaagctggaaaggctggtgtagtagcttcctagttagagagagagggcagaacaggggaaggagggaaatgactgaaaaagaaagttcatttgtctttatgatgttaccaagtaggaagtagtttgaagtgttagttttcatctttttcagatgagttgagaaaaccaatttaactaaattaatgcaattaattagtggtgacctgaaatgcaatatatctacctatgctttcacaatcaaaaagcatttgttatgcttcacatattgacacaagtgatctatccacaacactgcaaatttcctctgcagatgagcgttttcaaatgtttgccttacccaatatttcaaactttcccccactcaaacaagctaaaaattacaaagaacaaaggaaaacaaaactgcaagattttaaatttaccttaggtgtccaaatacttatggatttttatttatttacttacttactattttttcaaatacaggtgggatgttgctatattgcccaggctagtcttgaactcctgggctcaagcaattcgcccacctcggcctcccaaagtgctgagattacaggtatgagcaaccatgcctggccatggattcattaattgtactttttggaaatacatgtaatttaaaaattattttatctaatagcattaagtcagtcagtcgacaggatctatcatttccacttttaaaaaaaacctctcttaaattcatctctttactgccatgtccatcctttactgccacagcatcagtttcagactatcaccatttatttctcatctggtttactgcaataaacacctaaatcacacctttaatttcttcccactccatggtctacatatctaccgaagtaagtttttttttttttttttttttttttttttgagacagagtctcgctctgtcgcccaggctggaatgcagtgacgcgatctcggctcactgcaagctccgcctcctgggttcacgccattctcctgcctcagcctcccaaatagctgggattacaggtgcctgccaccacgcccggctaattttgtgtgtgtttttagtagagacggggtttcaccatgttagccaggatggtctcgatctcctgacctcgtgatccgctctcctcggcctcccaaagtgctgggattacaggcgtgagccaccgcgcccggccctaccaaagtaagttttaaaaaattcaaaactatccacataatttccctgcttaaaaccaatcagtgcctctgtaacatcttatagggaagttaaggaatctttagcaaagccttatttcctcttcttgcttttccttaccagccccatcctccacagccggaactccgtatatattgaactactctcttaggctactgtcttggaaaatactaaccattagatactacagtttttaactatctacttaaacaatttctactgtttaataatcagatggcagttatattctgttaaactactagtgcacatttgaggacattatcgttgtatttccgtttggtcttctatcatttgaaatttgtaatttgtttgcatttatttttcataggcagatttgtataatagaagatccaaaatactcattaattaactacatcaaatatttaaagcaaatgcttagacacaaacggcatccaaagcaataaaaaggctgccagactgcttgagggccaacactgctatatgttattgtttttgggtttttttgttgttttttgagacgaaagtctcgctctgtcacccaggctggagtgcagtggcgcaatctctgcccactgcaacctccgctccccgggtttaagcgattctcctgcctcagtctcctgagtagctgggattacaggtgcacaccaccacgtccagctaatttttgtatttttagtagagacagggtttcaccatgttggtcaggctggtctcaaactcctaaccttgtgatccaccagctttggcctcccaaagtgctggcattgcaagcgtgagccactgctcctggcctgttattgcttttctacatactcccactatgtcctcattatctactttatgggttcaaacatttctgattttttttttctttgagacaggtctcactcttttgcccaggctggattgcgcagcacagcaggagcatagctcactgtaaccttgaacccctgggctcaagcgatcctcctaccccagcctcctgagtaggtgggaccaatcagaggtgcacgccaccacacccagctaattattgtattttttgtagagacagggttttggtctgttgtccaggctggtctggagatcctgagctcaagtaataatcccgcctcggcctcctaaagtacggcgattacaggtgtgagccactgtgcctggcctgaaatttttcatgagttacaaaaagatgtagtgacaaaaattcaaaggggtatcttgttcattattgtcaagtcaataatctaatttggtcgaatcagttaaaacaatctctggggaaatattacattgaacatgcttgacaaagttacttcagtggcccatcttgttatctcttaaacctagctaaggagatagaaatgtttaaaagaaagcatttttgatatgtgacatcacaaagcacactacctcttcaccatgttttgtataattagtaagacatataatcattatgtttgagctcattggaaatgaaatcacattctaccagggagtaaatggcaatgcacttgagtctggggtcctcatgtcatgactgccactaaaaacaaacagacataaattgttttccctaaatacatttttttctgaaatattgctatagtgagattattgagtgtgtatgtgacctgttattactggttttttattttttgtgaaatatttcatgtttataaaatattccatgtcaacagaagtaatgactatctaacagcttccacatcttactacccccaaaataaaaataatacataaagttaaaaaggagcatttatgaaattataagtgccattttgccaggatgatgatacatactcttcttcttatgaatgttaaggttagtagaccattttgaattggcaattattttctcagtcaagaaatttatttatttttacttttgggtcttaatgtcatgcagaactaccagatgccaataacaggagtagctgtgggcattttatatatgtttaaaccaagctaacagaatgaattgagccagagtatttataatttattaataaatgttaaataatgcataaacactaaaataatcataagacaaaacacaaaataacattgaaattagtatctaatgtccttattatcatttttttatttgccgtctccttaaatataactctcctgcaacatcatcatcctggcaatccatggtgccacttcttcaatgacttcctgtcctttaggtttatttccagaggtgatatttgcatttgtaaactgaagtgtcttttacataaaataaattgtatagttattttttaactctttaataaaataaagcacatggtaaaggttgtctgaatttggagttgttttctacttacttttaacagtatattcctaacttcataaaattggtaaccctggagttcaattatttattaataattctttcagttcaagcaatgtacaaatactgtgtttgaatgtgagaaaaattgacagagtcattattttcataggagtttatagtttggtgaaagaaattggccttatcaataattatacaattaaacatgtaattgaaaatataataaacaatataaaggagcactatatggtattatgacaggtttgggagatctgaaaatacttcaccaaaagaagtgatgcttgaatcaagatctgaagtatgagtaggtgttataaaacactaatgggtgtggaggaaaaggcatttcaggcagaggaaacaagacataaagaagcacataattcaacacaaagtttggcctatcccattgaagccatgaacatccttctgtttctcacaaactgtgggtctgttgatttatttggatatttcagctatttatggcagtttctgagttaatataagtatgggtttcttagaaccatattctacatgaggggcatcattatactctattacttctcaaacatctgataagaacagggtatttatccatgttggatgatctttcttcagtgtctgtagtagcagctgccgtgatgagtaaccacatgatttctggacagtagagacccctgcctactgatcattagacaagaaactggtcctcaataaaactgaaaacccaggtggtgggaatgattgagtggtagtaaaataaaaatgtgtgtatagaagagtccaaacttttactttatgttttaatgatttaaaaatgcttccaagtgagctggaagcacacctgcatactaggtaatattgttatcatgaatttggacaatctcgatagactaaaaatgtattactctaattgctttcagagagaagggctgtgagtaaattattctaaaacatcaacctcatttttggtaagtaacttctaacatttaactggcttatatttaaatgtgtcaatccatgtatttaatggggctacattttgcaactagattatcttggtgcattcaactggaagtggatatgttataaatatcgagacaatggggtgttcatgtcagaaaatcagaaagctggataccaacactgaattctcctttccttctttttttttttttttttaagaaaaaataccagaggatcactctgttgctcatgatggagttcagtggcgcgatcttggctcactgcaatctctgcctcccagggtcaagcaattctcgtgtctcagcctcttgagtagctgggattacaggcacgtgtcaccatgcctggataaattttgtattttttggtagagacagggtttcgccatgttggccaggctaatcttgaattcctggcctcaagtgatctgcccgtcttggcctcccaaagtgttgggattacaggcgtgagccaagatgcccagcctctcttattcctttggttccattctatcacaaataaggaagacccaatttgggctggtgtcccagaattctgagccacacttgagaattaggttgggcttgcttgagggctacagttacaggaacagagcaggtcaaaaaagcaatatttgagcaagaaactaaaataagaccttagtttttaatcttaaggaccagagaacacatacagcatccaaatcaaattcgggtattcaggtgagaacaagaggctgaacgtgggatacaggagagtgagtctagaagaattttccaagttgaagaatgcagcttcttttaatggtgcacacttagtgttcagtcttaaagagaatgccctgttaagaatgctaactggggctccagtgctgatagattttcaatgaatggaacttagacaacaggccatcaatgtgtagttttataagaatcagtcacagttataagaaacatttatatctatttcaaactttatgaagtatagaaaaaatgttgaaactgcacacaccatatcacatagcatcttttttataaaacaccacagagaaatatttcttttaattctcagagttaatagcaatatattttaccaagcaactcattttttaacttaccgatatatgaatcttaaagcaacagtgttcccttccttggattagttgataggaagatcagaaccagtctgtgactcgtttctagcaattactcaggaattaatgaaatgaatttttgctttcatagttcatactattttcatgccattttctcttctctttgatgtcctcatgtttatcttttactaaatttttttatgaaacgcaatcctttgctttttttgggggggtaagaaacaagtgaaatacaagtgaaatatattaaacgaaataagttgaaaatattgttttacaaaaggagaaaatacatgatttttgcttattataaaaacaacacatgctcattttaaaggaaattgagtaagagaagagaacataaaacaaaatcaaagacctctcaaaatatcctctcttcacacacctgtaacagtttggtggtttttcctgcttagacagaatatatatgtattctctctctctgtctttgtctctctctctctacatatatatgtagtactgtctctgtctctgtctctctctcactctacatatatatgtatatagatataaatacacacacacatatatatatacacacacataccacacatacacctacatacataactataggcacacatgtacatagacataatctcatatatgtaaatataagcatgcatgaaaacacactggtaaatgataccatattctgtcatctattctctaaattgctttttccacataacaacttgtagagtttaaaataacatttcaataatttcaatacatacagatctcaatacagatatatcatcatttattttacaatttctgtcctgaaagatatttgggtggtttccagatgtatactattatatgtaatattgcaatatagtatttctttgctcacttattcaattatattcttaggctaagtttctaaacatagaattaatgggacaaaagtatgcacattaaaatattgatatatattatttgatcacccaccaatgttttcctgatttatacttcctgatttcctgatatattgttcactgaaaatgtacataagaaagtggctatgtctgtataccatctcaaattcttttaaatttttcatctttttccaaaatgatagatgaaaaattgtttcagtttttatttctttgtctgtcaggtagaaaaacttttcaaatgtatatttgtcatacatttttcttcctttttgaattttctgttcatggcctttatctgtttttctcttgagtttttaatcttttttatccagtgctctttattatagtatgaatgaagtaatgatcattttttatttccataaaccattaaacaatttatcctatattaaataatttatccttttctcactgatttggactgctacctttactaaaccctaaattttcaatatatgcatgggccttattcttgaccatttatccagttggttgaataattggtttatttctaaattattatcatgctgtttgaattaatagcctatatgatatgttctgctatcttataaggaaaaacagtctttttattttttcaaaatgttctttactatccttatatttaaattaaattttaagtcaagtaatcccctaaaatcccactggggattgtcatttttaaataagcctctgaccttatctgtctgaagtgttgcatttttctaaaatcccatttcaaactgcttactttcagccaccccaacgataatcttactccattagtatactatgttctcataatttttcccttagtgaagcagtcaataacttagctttagaacacagtgccttaaattttgtggataaaagactcattgagaattggataaacattctctaagaaatgtgtgcctacctccaaatgtaatgaatcttgtagagccacataacccaaggttaagaatttactctgtagaggcacttctctaaatttacaaagggggctttatcccatcagagttattttcactcttacatgttgtttttttttcataagttagatcaaaactgttatttctcttcataatattataatttcactctgtcttcataatcttaactcaaattataggctgcttctcctcataccaacctatactcacagtatctcttgtttcattacattacaataaaaaagatcactagacctttttggctcaagtccaagttctatctttgaacatgaatatgtgtctatttttctgagattcaatattcccttccatcatctataaaatgggtaaaataatcactaactctgtgtgtttcaaagagattattaagaaaatcaaatatatcctgtctgagagagcacaaactaaaaagacaaggtttcattattatttccacatttaaaagctcaccacttattaaaaatctatataaaaccattcactgtgcaaggtcctaacatacctaatgggggaaacacataaaacaaataattaaactgcaattgataactgctagagtacaaataatatacgaaagctatgggaaagcccagaaaagaaaaatattcccactttgggagatcgaggcagatggatgacgaggtcaagcgtttcagaccagcctggccaacacagtgaaaccccgtctctactaaaaatacgaaaaattagccggacatggtggcaggcgcctgtagtcccagctactcgggaggctgaggcaggagaatcgcttgaacccggtaggcggagcttgcagtgagccgagatcgcgccattccactccagctcggacgataaataaaaataaaaaataaaaataaaaaaataaaaaaataaagaaaagaaaaatattccttctttgtgtaggaatatccgcaagagggtaacatgaactgagtttgaaaagatattcatgagttttctgaacaggtaaggaaggggtgttgcagagcatagggaaagcaatctagaaggaagaagcagcctcagcaagaaagagaggtgtgaaaaggcacagagaactcagaccacggccagaatttaagtgtgattatttcatggggtttacaaaaggggacaaaagttagactttctgcaagaaagaccgactgggccaacattctgaagagtcaaactaagaaatttagactttatcttgaaggcaaagagaaattaccttaagatttagaagatggtggtgaaactggtagcctggggtgaaaaaaaaaaaggaacaacaggaatgaggagaggttggagctagagatcacttagaggctattgcgatagtttagtgaatagaggataagtgctggaactagggaagtggcaaggaaaaaacacaagagttatttctgaggacgattcaaaagatcttggtggtctttgagatccaaagttaggggagaggaagagtctaagaatgccacagaccagagacaactggatggatgtgatgccccacgttgagacggagcaagaattataaatgctcatttagatgacaaagcaaattttatagagttctcaatctccaaagtggtatggtgaggtttggggcaatggtggtatgtgtgaatatagggtccaaccaatttagctgataagttttaaacaataaggtaaagtggcttattcttcgggaaaaatcagttttcttatttttaaacgtagataaaatgttcctcaggataaaaatagccacatcttttgaaatataatacagtgctatttggtgtaatcccttagcaacgttgctgttatgagccagtactagcagcattcaagttatagactcacatattgcatatttttaaacctgtagatggataataagctgtgagagggacataagtttgtccatgatagacttcagacatttaaataattagcaaaatcataaacagaactaagtctttttagattattattctatttgatctttaagaactcttcccaagacatgcctccaaacccacattaaagtttagagatagaaatcagtgagcaagccatcagtgtgtgtgtgtgtgtgtttgtgtgtgtgtgtgtgtgtaaatgtatccaaattgaaagtgaaagaatgtttgttttctgaagtcatctctcttgtgccaatatttgaatattccacttattcacaaatgttttttaaatgtaatttccaaacttttggttcaaggctataacctggaagttggggctactgatggttaaaagatggccacaatgtgtaaaatgtaaagtaattgtcagcagatatggaggatatagtttgtagttatagtttgggcagtaaactagttgtgttaagtaatttaacccctcatgacacatgtttcttcaaatgtaaaagatggacagtggtggactaggttagtttaagcctcagtcccttctcttctcgacattccataatcttagagaaatatgtcttgttgatgtggtcaattacctattttcatgctactgctccacatgtgggcaactgaacccagatgatccaattagaataagacaaggacttaggaacattccctgcttggggatttgttcctatcctttcccttctacctcctctgcccaccacctcccatttccatgaaacacagaaggtacatcattttagaatcaaaatgtaaaaaggtgatggattcattatgtttttctgattaatcaaaggcttagaacacactagctgataaagtattaaatgaagttaccaagacaatattctattggaggcaaatcaagaataaaaggttcaaactaattttgaaaaaattaaaaagtctaatactgtgttactgtgttgacaatatgtaggaaatgtaaaaaatatacattttccttgcattttttgctatttaaatatccttagtgtccttacatattaaaatttaaagatgtcaaccttatgtcagttttccaatatgcttttttttaaagatactgtttcctaaattcaaattcactgatgtagacaatctgaacggccaatttttcaattaattattttggtaatgtgaaatctaaattttacatcatgaacctagattaccgttacatcctttaatgaagaaaaaattacactaataacctgaaaaatcaataaaacaataaagaaatagcttttataacctagcatagaaaaatgaaaacctaatttcttttattatttaaatattacaatatgttttctttatttaatatatgatgttaacatatttaaaaaactaatgttgccaggcacggtggcttacgtctgtatcccagcactttgggaggccgaggcgggtggataacttgaggccaggagtttgagaccagcttggccaacatggtgaagctccatctctactaaaaatacaaaaaattagtcaggcgtggcggctcgtgcccgtagtcccagctacttgggaggccaaggcaggagaatcccttgaacctgggaggtggagtttgcagtgagccaagattgtgccactgcacactccagcctgggtgacagagcgagactctgtctaaaaaaaaaaaaaaaaaaaaagctaatgtcaagtaaatataatatgcgcagaatttatattttgtgtgattataggttttagctcttttccttctacctaaattgagtcaggcatggtggttcatgacagtaatcccagcactttgggagtctgaggcaggaggatcacttgagcacatgtgttcaaggctacagtgagctatgattgtgccactgtactccaacctgggtgacagagcgagacccagtctctaaaaaaacaataaatataaatagataaaaataaatgaatcaaacaaagtatctaaatcaaatgtccccttctggatatttgtatcactataatccagaatattttataatatcaaggaatcatccatgctgcttgtattttcaaccttagtgtattatattattgaaaataatattttgttgtgtaaagtcaaagaaacaataaaattatttatcagttcagttaaatagttgtcacattttgaagactattggttgaaatgattaatctgatatgtacatttttaaagagtgttttaaacatttttcatatttcattttgttctcttggtaacttagagactcatttctctggtaattttattgtttgaaatttcttgcatgttgagattaagacatgaatctaccttgtttgacagacacactttatataaaaaatttatttaacatatccaaatttcccatggacttaaaagaattgaccacaaaatatctaagggttgtctccttactgcttatatacattttttcattaaacaagattcctctttcccattgcttcacaaactgttacaaattctcaaaatttcagccaagataatatctggaaatgctacagtgcatgctagaaatagctttataaaagatatacctttcttgataatccatagggaatcattcatccatccacccatgaggctttttcagagacattaacttgatagactatttaaaccccccatttggatgatggtaagatggtggtgcgcacgtacacacacacacacacacacacacacacacacacacacacaccttttcttgtttgcttttagaaaattattgaaaaagacgttagatgttctcactagctttaatttatctgaacactctttcataagtatttatatgcattttacaaagtcaacaaatacactgatttgcctctgttgtgatcattaacaccagtttatactgcccagagtttctaaagttaaaatctctaattacttctagaagcttgtgatatatgtcattttgttaaaaatggatttaaaccatatctcatttttagttcattcaggctttatgtcctgtagtatcagtcgatataaacttcacgttggtttcatgtatttcttgatgctgtcaacaggcccaggttctgcacacatttatttaaggtgggctcaccacctttgatgaggcaggagacttgggtttcagtcttagctctagcactcacagtctatgtgatactgaacaaattgctcgcatcttctggggctcagcattcttgtctatcaaatagagataataccatctcatctcagtgttgttgtaggattcaaataagttaataaatgtaaaatttctttgataatttaaaagcattgttgctgttctctttaaaataaaaaagtattgttgctgttctctttaaagaatgaaactaatatccatgtcctccttaaagatgtatttatttgcaaaagcaactctattaaggaaaaacatgacatgcaatgtgtgagcatgtggggaatatgcaagtattgtaaagaattttaagtctaaggatccttaaatagaatgacaatgatatatcaggtgagccacagtggcagctacatataaatattatacatcttagtttgcctgtgaaccattcaactaaaaatttcaaatagaacaattaatcaatgtagaaagcatagcaaaaaataaattcaaatcaatgatgcaatacctctattccaattagcttatttttctttcttccactctctcaggcatattctattttattaaaaaatgaagtcaattaagaaactctacaaaatcaatcagcccacagatcaagctagaactcttgttcttatttaatgtttattaagggctcatcatcacacggtatttttctattaataggtcaaatatacaaagtatcaggcttgccttcattctatcattggggtcctacatagtgtcgtgctcaaccaaaggggagagagaaggacatccacctcttcaaacaaagggtcttagcagtcttggctgaaaaatgaaacttttatattaatttatggaagtctgcagtctttgatctgaattgaggttattaattacaattcttattcttcccatccaacaggtacaagaacatctccaacaaggtacctaagggtgtgagccaggcaaagggctaagagcatatatgcaagctgaaatgatgtgtacacatcagggttatgatagtttggctggattcccttgtacatagtgtatacaacagagagacatgctcacacacacacacacacacaaaactcaaacacacatttgaacaccattatgattttctgatcagtccaacctactgtcaatcagagttggacaaacaatcccagccctagattttcctgtttccacacccagacctgatttacaatttataactgcccattgttcagacttgtggcttggaggtgcagtacatcgatgcctgtccacatctaaggttagatgacgacccctctactttactattagatgtgccaaggatcagcagctcctgaaatctttttcctgtgcctgtgtgggggaggggattcacggcgtggaaggcctgggacagggaagaaaggagctgtccctgggttatcaggaaagggaccaaacgtgggccccacatccacctccacgcctgagttaagaatctggagctgactcctcagaatggctgtaattggtcctttactcatttccttggagaagcagcggtcaacttctactaaaactcccggttgataggcggcttccctgccctgtcttccggagcacttacgttaaggggaaatcactataatcaaatctctacgtcttgcctgctgctaaaacaaggcgctttcttcctgggattttgcagggacgactgatacacacacggtctccctacacacaagctcgcacacaccgacacagtgtaactcccacagcgtcctcgctccttctccctccctcacccccttgtctctctcaaggattgctgaacattttgctccaaactctccaagtcacccacgtgttctccccttttgctattcaatttacttctccacctgacgaagagaaatgcgagttgttcttaggcttttagctgcaatcctgggaccaggctttctcactcccccctcctccccagtcagagcagccccaccgaccctcttcccaatagggtgagtggacagatgctgggtgctttcgctggtcaaatcccgcaaaaccttcaccttctcttcttctccacccagagcaaactgattttgcctgtttagtctcactagccagggtggtatggaagtgggtggggagagggctggtgcgtggcacagataactgggaagcgcgcgcaccacacacacacacacacacacacacacacacacacacacacacggccccagttaacatttatgcagtacttttggggggtctcttacacacacctgaatagcatactctcaataaaggataggcacacccctgtttgtcctcccccaatttccagactagcattttaccctgggtctagaattggtggtgataagccgacttagatggagtatttgagaaaaggggaggtgaccctttgcctgaatgggggagggggcgctctccactcaccgcctgagtccctggaacgaggagggccaggacatcctggatttcttcaggccgggccggtggccggtctccaccgcgtaggaggtgcggtccatggcgcgacagtacaggtagcgctcggtgtccgagtagccgcgatgccggacgcggccggtggccccgctcgaggcgtagcggccgcgggcagccccgggcggcggcgggggcggcggcagggggggcggcggcggcggctgtagcggacactggggctggggctggggcgagggtggcggcggcgggggcaggtggtgatggggatgcaggaggcggaactggggctgccggagcgggtactggtggtgctgctcgtgcctccagagatgcttgggggctttgagcgtggccccgccggcgctgtcgctgccctctccgctgcccgcccgggccggcgcgctgctgccctctgcctccatcctggctcgcggctccgcgacctgctgcccagcccgggttcaccgcgctggcccgagcgccttcctgatgctgctgctgctgctgccgccgccgccgcttctgcagcccagcagaggctggtgcttagcttctcacttgaaggcgccagagcctcagggctaccgagagggg

SEQ ID NO: 263 - DNA, 1519060 bp, Homo sapiens
ttttatggtatcaagttaaaaactctttaatatctcaaaatatcttatcagattgaattatatccaatatcaatttgatggctatattcaacacatattaagaacctactgtgtaccaggcatagttttaagtgctagtgatatattggtaagcaaagaccttgctctcatggagctgtggtctggtgggagagacagataacaaaaacaaacacgtatataaatctgtgagaagtgttataaagaaaattgagcagggttatgagaataaagctacagaatgggggatatctcacacaggatggttagcaatggctctgcggctccaggccctgcctactctctcacttttcctcagtttctccagatgtctcaagctcatttatgcctcaagatctttgcaaatgtttcttgtctggatccccttcctcttcctgtcaactttttccctagttacctcttacaatccttcagaactcagatgcaaatcactttctcaaggcctcaaggaagccttctgtggccctccggaacagatcaagttcaggttcctgcttatttaccccactgagctccttcattgtactgatcacatatataattatatgagtattgtttaagcctttgtcccctccagactgtaagctccatgaaagcaaacactgtgtctcattaacttattgttgagtccttaaaactttgtagtttgcggagtaggtaaccaaaaataattgtcaagtatctgaataattttcaatatcccagaatattcaattaagtaagtatggaaggcccctttcaaagcttgcttagaaaacaccatgcttaatcttataggccatctaagtaattttggtaatttttaatgtagcaaaattactcaagttggctttatttggttatgaatatcagtactaacttatgatgtcactatcctttcatttcaaccacgttcagtatcctaagagacatgctgattgaactataatttaaaatgaataatcttttatttgtaaaagattgagtcataaataggcagaatcaacccatgcttttattttcattgcatataaaaatttcatatgaaggtattgatgtacagtactatccccgtgggctgtaagagaggctaagaaaccactaaaagaataatcatttgtaattctcacacacaatttaccactctgaaaatatatccaaagaaataaaaacaactcaaatcagttaaggatgtttttgtaattatagtgtcccctttgtactgtttaaaacaaaagtaatcaaattcctttgggccagggctgctaaaatctacagtttgtgtcaaaaaataaaataaaataaaataaaataggctcatttttcctagaaaaagaatctttcctttcactgaaaagccacatgattcaagggctgggcaagtactgggaggatgtttccatataatccattataaatgtttcctgctttaggggctggccattgtacaaggtgaaattttaaaattctaaagcaatgaaagttttgcagaaacaaatcttagaggatagtgaatgctttctgctatgtaaactgacatcaacccacctttgcgtttaaatagatgggtttacatatatgtaaggacatttggtttatcttagtggaagaaaaattttaggattaaaaaacagtattttctctttaatgtattctcttaacatgtcaggaagctgatgaatagataaccaacacgagtaaactctggctccaatttcaaatcaagtccattttcctatgagctctagaagccaaaaggacttaaaaaaaagaaaaagattgtttataatcactgggaaagaatatatttccccagttgtgtttccgagttaaaaaaaaaaaaaaaggaaataatcaaatgcaagtagctgaagtagttcctgatcaacagatggcaaacaaccatcacacatgcagtgctgctccctggcaagaagtacttaagagcttctgtctcaaaagggtctcagaatctttcagaggttgtctgtggttttgtaaaatccacctattggcagaattctaatcaattaaaagcctggatgtaaaatgcccagccctagctccactgttacctttcaaatgcagcaaaacagaagaaaatattggttaaagttaaggcacagccctgggaccaaagacctgcagctatgtttttttaaatttatatatctttaagtattttatagttttcttgaatcttccataaacaagctctaaggtgacaagactatattacaggagaaaagaaaaatgtacagagtatgtatacacaccattcattctctcaccaagagtttccaaatatatcaacaccatcccatcatgggatgatgttttaataagaacagataatttacaattaacattacagtatgtacattgcaataaatacatggttgtaaacagacaaacaagactgtattacaggtaaggtcatttggtgagaaaaaaaatgcatggcacaaaaaataaataatgcattcaaaaattatcataaagctttctgtaaaatccatttcattcaagttttttctttccttgtctgtaatttgttctatctacattattgtgaattttaactgatataaaacaaaattaaaacagcattattgtgttcagtaacttgcaagctgaaatgcactggttttacacaaacttggacatttttttccccatacagtacccagatattgcattttcttatggcattttaggaaatgtaaagccacttgtaaaaggatattcttttattcttttttaaagcagtatatatttctgaagcacactttggcaagagagaagggcaaggataagcagattgtacagtgcattagtccctgtctcttggatattgagccttttctgcaatttgattgtccattagtgggtatctttacaacacggtaccattaaaaaccaacaaactggaagaaaaaaaaagagcctctctttattagtgcagttataaaccctttaccctttcaggtctggatttgttaatgacatattgctgctttttattttattcattattaagattctaggcactctgtgggggaaatactaagtgtagggaggagaggaatgagaatgttttggaaagaggaataaactctagactctttacctttctttctagacttcactcagggacaaataaaattaaaagaaacaagttcccaaatattcttgtgaaactacttggtcaaacatacgtctttatttttttcttatttgaaagattaccatctgatctttacagaggaaacagagtagaaaccttgcaattaactagttgattcctcttctgctttatgtaaaagatcagagttataaagacataatttttatttcaaaggatctaagcatcagctagatctcaggggactgaaatggggactctcttcagcatgagtcatttgcctggctgatgacttactttccagtccccaggaggctccttgagaagttccacatataaatgcttttcagagttgtaattcttcttaaacgtttgattttccacttgtcagatacccactttggcttctatctatctcaattcttgaatatcaatgtgaaaaatgattatttgggctttaaagtcttcatagagaaggtaaagaagactttattaaggctgacgtggggataaagtcagaattaaatgccccatgatgccaactgctataatcaggtaaacactaggaattaatctctaaaactgtaatacagttcctggtgctgaaatcagccaagagtgatctctaattttttatttaaccagaatttttaccaatataataaatattttaggatgcatcacagtactaaccctctggtgccagtggcatcatcttctttccctccatgtgtttaaagaagtagttcccctctgcaagatatgcttatggatcgaggataagtgataaaggacttcctacacgttatgtggctgtccattaaggaagagtagttgctacacttaaaaccgtttctcagggatgttcctgatatagttcttaatcccatggtgaaatcattaaaaccaaataggattagttgtattggtgtttgttaatatattgttaatattcttaaaaactgcctagttggctgtttaacttttctctgtaaaccaagagtaaaagctagtcatgatatacaacctcgtggttgaaatgaatgttaaccctaacttaactacctgtttcttttcaccggtgacaatggtagtgatatatttgacaagacctcatctagcaaacatggataaggttcagacacacgctaaattataaagcagcacaaggggaaaaacctttttcttactataactggctgtaaaaacaataaaaatgagcatgaaatgtgtggattattagagcatgaaatgtgtggattattagaaagacatgcacttgtgaaatgaacatctagtgacacagcaaaacgttattaggagatactaagtaggaaaacatctaaaaaagactgaccattttagctactgggtatttatatatctcccacttgcttcagacaacacgaactgatgactgagtttgcatgaagcttaagacacatttgatataacacacataaaagtattatagaacaaatagtcactttgcacatgaagaaaaacactggtgaagagcaactctgcttatctggaaagagtgaaacaaaatgcaaagtaaataataaagacttacaaaaagggtttcctgcaacataaagttgtttttctcttttaaaatatggaagtcattggtatataaaacaaacaatgaatcactacaaatcagttaattgctatgaactataaggtgcaagtaaaattcataaattagatttttatccagtgtagcacagatttgtactgaaaacttgcaagttactccttagaaaaaaataaccagtggcagatgaagttctgaacatagttttttttaaatataatacctcaatacatttaataataaaagtaagctctacaaaaaatctgttttacatatcatacaaaatgtagaggtcagtgcagctcactgaaccacactattcagtcatgtatcaggaagacttgaaattagaaaattatgcaatttctgtggctcatcctcctcctactggtaacagattcgtgctatgtcctgttcttgacatatttgttgcttcgtccattaagttcactctgtgcaatgcctttcttctgaaaatattgcaaacaaataaaaaggaatagaaaccccaagtccaataaacttttgggctgcctgatgagtcacactctcttgaaaataatttggagtagattttatctgctttgtcagctctaccaagctgaaatcttgttaaaaacgctgttcgtgaagatgtccaccttgctcggatgacatggaggtgaaaaaactggttacgatattcctgagcgctggactgagtagtcaaggtcagttttgttcaacaaacgtcctggcagatgacagtgaggtgtgaccgtggttgtggcatgtgacatgcactttggaaacaatttttctacttaaaaaaaaaaaaggcatgaaagtttttgcactgttacgtgtcaggagaacgatcatctatgacacaggcttcaggctggctttcctcttcttcccctactgcctcctcttcaacctgttcatcaaggggaatttcagtagactctgagtcttgagtacaaagagtcttggagtcactgcagctagtgtcttcttccacttgactgccactgtccttttccgtgtctgactcaccatcttcctctaaagttagttcaaactggaatttctcagtttgaccctgccggccctcctctgggtcatcaggtgcaggagaggggctctgagggattgtgctctggtaccattcacgattgtcctccaaagtgtccaaaatatcctgggcgtcagggtggacgaggtctgcccatgtctcccagaggggatgaacaatatagtctatgaagcccacctagttaagaaaaaaatccagtatgagtagaggacttgggactaagaaacaatggaaaagcttaattagatcatggcccacaaataaaacactgaacagaagactactaaacttagtttggtaaaattgtcactattttcaacaacaacagaccatttaaagtaaagtattgctactagctggtcaaaattagcttctagaacctttggttaaagagcatgttctatagcataaaaaattttccagttgttgacatggtagggcttattttacaatcaccaatttgtaggtgaatccagataactgaaataatgccatgtgctctatgtatatgaatatattaaatgaatatagtcataataaatgaatatgtctttagaatatatatatgactatatgaatgtaagtcataagaatgaaagttctttggatcataaatactaaggtgaaattgagcttgtcaaaaacaaagtaattttaaaaatccagtaaaatactatcatatgtaatacaaagtaaccaaatgctaaagcggtagctctgttctctctgaaagctatacacttcatgcattacctgtgatttttccacggaagcattgtgcttgtcacacatggggcttatctccatgccacgttccctctctcggtctccttggcggaagaactcctccattatccggtccgtccactggcggtacagctggagaggctttgttgggttgctcagatctgcacagtgcaccatattctgaagaacctaaaatagatggatgcattctctattcactcctgttccttttttttaaaaaaaaaaacaaaaaaaactagaaattcacattggatgactgcaacacttaaaaatacacgtagtgtaagatttattccaaacagctcaaccatgatgtgtctgtgtatagttcacacttgtattaatagttccaaattatgccacttctactgcatctaaatagcttaagagaaactgtttatgtgcatggctgactagattcagagctgcttaagtggctggttctgtggggtgtttgtttgttagtttttttaattaatgtagatgcaaacagaaagaccagtagaattttacctggttaattctcaggaataaaaatttggataaaaatcctgcctacaattgctgaaagtataaggtgggagaaggaagaaatacatcttatcaaagctgaacacgcagacatgtgcacatgtgcacagacacacacacacagagcaaactcaaacaaggctttacctgaatcctatcggaataattatcaagaagaagaactccagagcttgtcactttcttagtttcaaccatagtcttcaaatcagccagtagattcatgtgttttgacatatctgttgcaagtaccttaaaatatagagtatattattaagttcagagaaaacagaatttacacatgaaaatattacgcagaatataagaatgaaaaaggaataaaacaacactatgccttttaatgacagtggaaaatccttactactccttgggggcagagtcttttcccctttgctatcaagttttcccaaagcccagataaatgtgtgtaatatacagaaatgctaggcactgacaaccactttcatggtgaaaaatgggtgacatctccatggataagacatcatcacaagtttataagtttttgaaagctagagattttcctgtgtctcataatcactgaataagatgcatagaaaaaagagtaaagtcatggatgtctaaatggcactgtctactgatgagaaaaggtggggaaaaaatccatttgagctgtggcccacacaatctgcttttgttagtcatttttctctgcccgccaccagactggaggggcccagaaaataaatgatgagggtgagctgacattattctcaagtccaaactgctagaagtgaaaaacctattacagaacatcacagccagcatcacgggcagcttctataacataaagggccataatatgttttgaaatgcagttccttttacctaatactcatcttgttcttatgtctaaattataaacaacttgcatcacagttctcttctttggcttttatcagctacttacgatgtcaatgaccattttccttaaagattgtctttgttttttggtcaaattctggaaaatgtcacagttttcttcctgaagcaatttaaagcccacagccaaatgatggttctctaagactgaggaatcattgtacatcaaggcaagttcagagtctgtaaaaaagacaaaaggccaaagatcagcaaaactgtttgtgagaagtttatctgattcttaaaattctggatttaggatgtaatttcccctaaacttctctgctgcccttatcattacctgacaatatccaggagagaataaatcagataacataagagcaggaacaacactggaatgaatcttggggagtgaattctaatgctactaacatgtggcaggtcatttcactctgtaggtctcagctttctctaaagtgaaagaattggatctttaacctctcctctagagttgccatgagctcagcagaatatgacattattcttagtatctataacacatccagagcataaggttttgtattcctgataactgtgaattacctaccctgcactatataaagtgaggatcctgtgttacaggattgtttgtactcaaagagggtacaagaacaataaggaatcatatgaacaagtttagatttgctcatttgctcatgtatagctctgaaagtccaagctttattcattgttttccattttcttttccaagtatcgtggcagtcattgtatactgtacagggatattgctcttcctgcctgcttgctcacagcttcacagtgatgttgtgtttggctgtctgtataccctctggtgaagattctgccactctctccctactgccctagacctgtgaattttaggcagggagagattctgcctctctcctacttcttgtaaatagcagacccagagctacaagataatcattaaaaaacttttgatgctttattctctttccacttaatcactgtaaagactaaaagcaaatccgaggcaggaggattgcttaagcccaggagttcaagaccagcctggtcaacatagggagacctcatctcgacaaataataaaaaattatctggggatggtagggcgtgcctgtagtcccagctacttgggatgctgaggtaggaggattgcttgagcccaggagttcaaggctgcagtgagccattatatcgtgccactgcactccaaactaggcaacagagcaagactctgtttcaaaaagaaaagaaaagaaaagaaaaaggttaaaagcacaggtatttgatcttttttctaacgaatgcatagaaaatatataacgaatgcatagaaaatatatttggaaatatatatctttttttaagaaagaaatacccaatactattcaatggctattttaatggagctaggaaggagaggagaggcttaagacattttcaactgagaaattctattattttatcggaactatagaaatacaaatttgcacacttaaatttctgctcccaaactacaggagcagagctgtttagactagtagggagtaggtttgtacagtatttttttgttattttttgttttctttagataaaacaatagtgtttatcttttaaaaggcagtttctggtgaacttttatagtgtctataaatgcctttatgaacctttatctacagataggtaagcatatagaaatgaaaaatttaaaactatataggttcttagcacatattattgtatttctacagtggaatcaaataaacaaacatatattgaaaggaaggcataattattagatactggataattattagagttcgtttaaggaaggaaatatgcatgtagacaagcagtgttaacagaattgacttagccttacaaaaaccctaattggcttatatgaagctgaaggtgaaggaaattaaggctgttgaccctgcaaaagaataagatgatgagctcttccttcaaggaaaagggtgatctgttgtatggaaggtgcaacaaagagtctgagttctactggatataagtagggcctttcatgtagggcagatgtccaagaatactggcaaggcctgtcttggagagtggttatctcctgacacttaaagagtccagattggctagaaaagccaggaaaggatgccttagtggactggcaggcctccatagcctcttccatctcagatgctgttacaggaaagtggtggtgactgttgatttttaaatgaacaaatgttagcatttaagaaactgaatctcaaggaagttatttaactttctactcttctttaggactgaaggcatatggtcacatttaaattgggaggtaggagtctgcagctcctcagcagattttcatcaaagacactaatccattacttgtaagtagagtccttgaaggttcaggaatgatcagaaagttgctgtcaggatggtacagtgcacagcacagaggggcaaagaggttagcttatataacatttttgttgaaaccctttcatcttcaagcccaatataagttacctcttccatcaagtctttcttaattaccagatgaaactgcccactttctcctgtaaacttctatactactttgtaccacccatttagcatgtatcgcattctaccttttttgtctttatctctacaaatcttttaatcgttcctccccaaaccctcccaacctacttagagacttaagcccctacaaaatattaaaggttattaatttaatatgtttggttatctggcttcccctaggcacttcaattatttcaaacttacaaagtacaaacaggaatacagcaaggcacaacatttagaggatttaggtgccattgtgttaaatggtttatgtgaatcatctcatttaatcctcataactcttttaggaagatactgttgttatcgacattttaaggctatgttccattcatggatggcatggagccatataggtgggaagtaagtctttgtgtccttgggataggctgggggatagaaaatgtcccttggggacatcttttatacacataaatatttacatagacatactcatataatcctgtacaaatgaagaaaatgtacctcagagaaggtaggtaactttgccaacatcacctagccagtaagtgctggggccagcacttaaaaccaggcagtttctagagccctcaccttatactgactatgattacaagtaccttatagaggtgaaaacctgagcagtgaacactaaacatgaaccaggaaatcaacacagtccactcagtgcctggcacacatttataaagacaactttgtaagtatttattttttattgagaggccatgcatacctttacaaactcaaagccatcattttattatatatagatcaattgtgctcatttgttacaactaccctggatcatcaagaataaattaaattatgcccaacatatgctactactgaaggcaggaagaccacttttgtgtccctctcttctgagtgctaatgaaatggggggaagggtgggcaggtactaccacataactgagaacatgtacttcatctgtgctaatcttttctctctctgtattaatcatggttctccagagaaatagaatagacatatgtatgagtgtgtgtgtgtatgtgagaaaaagacacatttatttattataggaattggctcaggcaattatggagtccaagaagtcccatgtctgcaaaggtgaaccaggaaagcaagtccaaaggccagagaatcaaccaggaaccctgatgttagaggcaggagaatatgtatgtccaggctccgagaaagcaaattgcccttcccccaatgttttgttcttctctttgaggtcctcaatggattgactgatccctgccaacaatggtaagggcaatcttctttaatcagtctaccaattcaaatgctaatctaatctcttccaggaacactctcacagacgcaccccaaaatagtgttttaccagctatctgggcatcccttagcctagtcaagctgacacataaaattaaccattacaaattctgccccttgtcaccctggtacccataagcatctcctttaaccatatttaatctccataaggccataattctaccaaacaggctacaactatcctgcatacaactaaaagcacactaacacattccccagaagtgaaagtaaagtttttgagtaatgtttactcttatcctgatagcctataacttaaatactatgatataaaataaatacttaaatactaatataaagttaatacctcttatgttatataagggaataagaaaaagaaaatgaagataagttaatacctcttatgttatataagggaataagaaaaagaaaatgaagatatatgcttaatatatgtatatatacatataaatgcattcataagaaaatactcatgacaattatagtccttatttctataactggtcatatggtcatagctggtatttgtaattaccttcttttactactcattctgtattcccttttccctcagcaagcacctcagctggtcatgattctttacctggtggggtgaccgaaaccttcattcgtgaagggtatgggttattagtggtcctgcctggattgggttattttgtgctgaccttaattacagggcatggttaatactaagggatgccctaagggatctccttattccacacatactcttccttaccttcattgtggagtagtaacccaatttccccttggtagtcaggatcagtcaccccagtcaacactgtaatgcccttcttggatgattgaatcagatgcataaggagctcaaagtggctaggtcttaacttccagttcaacggaatcactgttgtgtctcctgatagaagcattcctccttctgaaactaagacctctagctagcagcacataaatttgcaggaacaggaagcaaactttgctagtgggtcactgggggtaattatgagtcgtaacagtcccatttctatccaatgattcctggacccatgaattctggttatgcgagaaatagcaccacatattggatgctgattcagagcatatatggcctttatggccttctggagaaccttgccccagccctgcaaggtcttgcctcctagctgagtaactgagtcttcaaaaggccattctaccaatttatcaagccagctgattcaggatgttagggaatatggtaagactagggacttccatgggcatgagcccagtgcagctcttctttgccagtaaggtgagttcctggttagaggcaatgctgtatggaataccatagttttggcagaaaaactgcagggaaggcacatctgtttccagagaaagtgccttttccactaaggacaaaatgctaccctttccaccatggaagtggtccaatgtaatcaaccagccatcaggtagctggctgatccccccaaaatggtgttatatgggggttcagtgttggtttatgctgctggtggattgcgcacttagcaatagtcatagccaggtcagccttggtgagtggaagtccatgtttctaagcacatcctgccacctccatccctgccaccatggccactttgttcttagcatgttgggtgatgacaggggtggctagggaaccaagttgactagtatctacagaatgggtcatcctattcacttggttattaaaatcctcctctgccaaggtcacactttggtgagcattccttttttgtccattcagagagatcattcacatatctcttccccaaatttctttctcaccagttttccaatcatattccttctaagtccctcactatccagacaaatcattggctacggcccatgaactggtatataattgcacatatggccattccctcttccaagcaaagtgaacaacgagtcaccttgcctaaagttcttcccactggaaagactccccttcaccaccatccttcagagatgtcccagagaggggcagtagtgctgcagctgtatacttccggtggtacctgcgtatcacgcagaaccatccgtaaaccaggccctctgtcaactacttgcagggaactttccatgcgaccacatgtgtaggctgggagaaagaaggcagtgtaattaataggagtggcattagggccacttctttatgtaatttgtgcctttagtgtctgctcggacctgatagatcgtgtattacactacttttatttgatgatgaaatgtcgtacatgcccaacatatggcttggcgcgttagataataccctattaatgatgggcagacagcttaaaccacatggaaacttggtggcccatagtcagtcagtatctcctaaggcccagcagcaggcctatatctttctttcaaaaggagagtagttagttatctttctttggatgatggcagggtcttgctccagagtctgtgctgtgattcacacagagggctctgtcaaaggctccaaacaacattcctatctgccactgacatttcaagcaccattaaatctgctggatcatgtggcccatgtgcagagcagcttgcacagcaggctggacctgttgtagagccccactcaaaactagcagtttttgtgacactctcttgttctgtgccccatctaaactagcagcttttcagatcacttagtaaatgggccagagtaacacacacaaagaaggaatacattgcctcccaaatccaactaagtccactaggtattgtgcctttttgtgtcttatgatggagtccacatggcagatcagagccaatattaagacctggagctgaaacagttaagactggggcagacactatagatatgtatcctgtaagtaagacttacactcactgttcttacagctttactaggcttagccttgagttagttagaaaatgacagcatgctacaccatgtctctaagttacaactgaaataaacataaatcttcaaaaggacttcagaaacaaacatttctccatgaaatgacagagggaagtggtggttttaacttaatattcagttgtcaagaaaactgcctcattcatcactccactctctatgccctcaccctgcattattttcctccatagcacttagtaccatcacatgccataaattcacttattatgctccaccttttctagcagaatgccagctcttaagagccagggatttgtcttgtcttgtccacccatgtgtcctaagtgcctgaaataatatttattataacatttagtaggcttgcagtacatttttgttgaataaaataatctctgtagctatatctatataatcacatttgataaacatgaatttatccttattttgaaggtgtgggtttatacagaaaaataaaattctacatacaatctactagtgtagctatgaaaattttaatttcaaaataaaagtagagaaataaaaaagtgtatactgacagctagatacatcttaaccttaatataatgaaatgcctctgctcttggaaaccaaaaaccgcatgctttgaatgcatcactaatgtgaataaatctttctgccccaaacttaggcatctttgctattaacaaaaataattcatttgccaagtaaaatttaatgctatattctgtacttttgatactttttttcagaaaataaagctaagttaaatataccctccagcattttatattcaaaagttcatgctgctatttacattttatggatttatttatttatttatttatttgagatggagtttcactcttgtccaggctggagtgtgatggtatgatctcggctcactgcaacctctacctcccaggttcaagcaattctcctgcctcagccacctgagtggctgggaatacaggcatgcgccaccacacctggctaatttttttgtatttttttttgtaaagacagggtttcaccttgttggccaggctggtctccgaactcctgacgtcagtgattcacccatcttgacctcccaaagtgctgggattataggagtgagccactgcacctggcctatggatttatttatatgcatcatcctttaaaaatatttacgcagcttcctgcctgaaatttcaatttctctaaatcctgttcacagtacccacactcaaatcatttattatagcttaaccaactctaccaggtagaattgttctctctgcttgcagaacctccagcatgctttcaacgagtgtaaatacaattagtataaaatcatttggcacctaaagctaaaacaactgaaataattaagaaaaacgaagagcacatgtaagaagcaggaggattaactgccctgggaaccagccaagggaatccccagcgccccccatgtgccttaagctctcagtgcttccgtagcttccttaaagtaagacaagtaaccaactatgggtttataaatttgataatcagaggtctttagaattctttattatgagaaatatggattcagctgcaggctttggacaggatggcagctccagctctgaggcaagagctgagaatgtgctggcttgacacatggatgctcaagccatccataaaatataaaaagtcaaattttaaaaaaggtttactgcaaactaaaaataagcacaaattttgataaaatatttcacgaagctacatatcacaagtttacaagttattagaaggattcctttactgcatgctgggaagataattctcttacatgatccctagccaaaccaaactaactaaggctgtaattttgataatgccctggggcccggaacaaccctgggatactttcctgtacaaagtgacaatgctgattcattccctcaggaataacacagcctcatcacacctcatcgtcaaaaaaactttagcaatccaaagctactctggcaactgtgaacttccctatgtcgctgtggtcacacagaaaggagatcattgcaatattactaaataacaaagaaagaatttgcagcggcaggattagttatccttccatcccaggcaggtcaccagcaaaatgactttaaacagacatcctaaggagataaaattatcttcttcagtttcctccactatttcattggttctcaaactttagagtatcagattcatctgtagactgaggccttgttagcttaaatggcagactgcacagggaccctgatgccagggtcctccaggtgccagtcaaagcccaagtgccctttaaagcaggggtccccgatccatccatcggctgtggaccaatatcggtccgtggcctgtcaggaactgggctgcacagcaggaggtgagcagcaggcaagcccgcatcagtactgcctgagctccgcctcctgtcagatcagcagggacattagattctcctaggagcgtgaaccctactgtgaactgctcatgcaagggatctaggttgtgcgttccttatgagaatctaactaatgcctgatgatctgagatggaacagtttcatcccaaaaccattctctccctgcgcccccagtttatggaaaaattgtcttccataaaacctggtgcctggtgccaaaaacattggagactgctgctttaagggctcaaaagaatgaagaatagagcaggtcctcattacccttaaaaaatgtatcagagtacttggaagacagtgacctttctatcagttgttttaatttgtcttctaaatctactcttaattctaagggaacatataatatgctatataacagaatgcaaagaaaacataccagtttgaatgtttggtgtttaagatagatatatatatatacctttaacacaaaaattttatgtaaaaatacattttatgtatttactaaaaattgataaaattcagaatatctcaagacattcataagcatcaaaataaatcaggccaggctcatgtaaagtgccagcatgcactgtattgcatgacctccctgctcttcttagaaaggacataatgaaccctccccactgatacctccccactgataccatgtaaatgcagggagctgcatccaatgtatattaatatttgtatgtatgctttgatgagttctaaaagtacctcattataggtgctcataggtaggtagaacatgaaatgttatcctgtctaatctggataaataagttcctaaactaaacttgtaaaaaaatacttgactaaccacacatctcaggaaatccctgacttttccagtcctctacatggatgagtcattagagtatattttgctataggatagtccagaggccattataagatataaaaataggtaaataatcctaaagctctgaattaaatctctcaaagcaaggttacctctacattccttctttaaatctggctacagcaaagtacaggaaatgaatggtgaattcataaataattctatagctagattgctataggcacgagaagactattattcatagcctcaagcaaaaatgaaagaaaggtggattcttaagcatacaacattttcaacaactttgcatattttttatatataaaagtgaatttatgattttataatctaccataatttataatctaccatatgggagggaattaagtcatagttcacttaaatcacttaccaattaacttcaagtaccaaatagaatttctataaacctaaatctctttaccaagggatagctcaagcattacctaaacattccctacacaggctttctgtgcggcaatgtcagagatgctccatattaaacagtctctactattccttatatttccaaattcagtgatgacttcttataaggtgagatgttaacagtgagaaaaaaccaaatggttgaaaaaatattaagaagttcctgttacccttattagaagattttaaaaaggaaagaacaggggttgggcatggaggaggaagggaagctatggcctctgaagaggattaaatgatgacctacataaagtgaggaacacttaccattaattctcataactttttttttaatttaaaactttagggccaatacaactttctaaatctttctgcacactttcatttttaattacccttgtctagtaacacagcaatatattacttttaaagagaactggaacacatttttcaaatatcacatgcctcaagggatataatgataattttcagttaaattacattaacatgaactatcactaaaacacatatatacacatctcaaaagaacattatggctctggaagactctgagtttataaagacccttagtcattctaaaatgtacaagggaaaaatgtgttctgaaaaaataaagtttacttacttgtattgatcagaaattgattggacacaccaggatgatctacatcatgtattgcactggcaaaaattgctgcaagaatctccaaatctgtaaacacagcctggaaaatcagacaatatagataatattactattctacaatgatatgaattaaaagtataaacaaataagaaatctctagaatttaaatggaaaacaaaatgaagcttcaaaatgtgttacaatgtgtcaagggagagtcttagatacttgtgaacttttaaagtataatcttggaagaaaatattttatctaattttattacatctcatgatcaaatgttttccattcactgtattttttaaaatattattttaaaactctgaaattattttaaaagaaaataatagtttattttctaaatatttaagatgtctaagaatattctgaaaatgtacataaaattagtaagacattagcaattattttctttcatcgaaaccagggtttctcaacttcagcactattgacattttgggcccaataactctttgcgtgggaggctgtcctgtgcattgtaggatttttagcagaattcctggcctctaccaacaagatgccagtatcatgtacaactaaaaatgtgatagttgtgacaaccaaaaatgcctccagacattgccaaatgtccctggtggtggcaggagggaaagaaaggggaagagaaaccatctccagttgagaatcactcacccatatgatgaggtattaacataattttataatgaaaacaaactgaattataaaatatatttcttaagaaaatcaaattgctttagtaaacaactaatgaaataacttcttaggatttagaaaaattaaagtatgtccttctaatatattctatgaaaaaatatcaatatattgcttatgttttataaaacgttctttggcctataaataaaagccgtcagactagatttcaagaaaacaaatgaacaaaaagtgagtaagccagatgtgctttatgaaatgttcagtggatcatttcaaagaagcaatatcataaacagatcaatcactaaatctgtgaccaactttcataagcaaaatccatcaaagacttgattgtctattaactatagcattttcccccataagtcaataagttatacttccaatgaatccaattatcttctccattgaaaacccttcagataaaagtttaatagacctttatgagtggcaagttagtgttcttgaaatttcagaaacagatttacctccaaagcaggtgtagataatagcacatgagtagactggacaacatctgcagcatggatattgttgtgataggccacatcagcatggtaatggtcttcgagagtcataagatatgtaattaaagtatctactggaattttaaatgtttttaataaatcccgttcctgtaggaaaaaaaatcatcttaacatttttgtctttatgtgaaaaatttctccatagagtatgtttaaaaaaaaaaatcacacaccagtgttgccagtggataacctggaaatggcaactgcactctcacatgtctagtgaggaaaatgggaacctctgagaagatccagggactctgggacaaaaccagagttgggttgtcctgctggaacccaagaatactacgccctagctgtatggtgtcaggaatgaggtgccaactctaaaagtttctatgtcccattatcatggaggcagctccagtcaagcactattaactcaacccctgcatcacaccaactaaaaatcaacgtcctctctagggctgaagtttcccatttcggtcccgagatatctacagcagcctcaacttctcatttaaatcccaccctaagctggagcaaagggtcaataagagagagaaatggatatgaagaaagaagcaggacacaagaaagtgactgaaaaaactatattctaaggttagtagccagcaggggctttattcattttttttaagttagtactccattctctatgcagtcaggttcagatgactaagatgatgtctaaattattattttaataaattgcttcaatttggctatatcacatctttttcttaaatgcaaaaaaaataacaaaattgatgttatttgtggtttatccacactccacctttctgtatctttacttgtcccttggcaaaggagcaaataaggataaaagtataaaaataagcaaaaggtggggaatattaaaaaagacaaaatgtatgcataagctacagactggacattaagttcctaaataaaataaatgtaatagaactcaaccaccttacctgaaaaatggtgtgcatgataacagtcaagggccggttaccagacaactctgctattctgaaaacatgaagaccccatttgttcacatcttctagttcctggagtgaaaaaaaaaaaaagatactaaaatattagaaagtggagtaaaatatgactcaatgaacacaatcatttaaaaattacagaccttaggtggccgggcatagaggctcaagcctgtaatcccagaactttgggaggctgaggcgggcagatcacttgaggtcaggagtttgaaaccagcctgcccaacatggtgaaaccccatctccactaaaaataaaaaaaattagtcaggtgtggtggtgtgtgcctgtaatcccagctacttgggaggctgaggcaggagaattgcttgaacccaggaggcagaggttgtagtgagccaagatcgcgccactgcattctgcaatccaacctgggtgacagggcgagactatgtctcaaaacaaacaaaacaaaacaaaacaaaacagacttcagtgtaaagattgttagattgttttaaacaatgattcattttaaatgttaacagacacaccatgtaagcataggcaaactttaggcacatttacttaaatgtactgaaaattgaacagtatggcttaaccttgtgactttgacattacaacacatttatgtactttttaagtatcaatcacaaagcacttctttaatggataaaatctattcacaaaaccttaactgttttcctaaaacccagaagacatgacagatttctaactctttaaggccaaacaatgaaatgaagatgcaaataatcaccccccaaacccctaaaacataccaaaccacctgtctaaggcactttaaaaggagctttataaaatgccttcccatcttcaaaaaaagaaaaaaaaaaaaccccaattaataaacttttctatccatttaaaagactagaagtgaaaattcatgaaagggcatcatttaatatttatgatcctgatctttgaaatcatcataccttggcaaggacatcttcttgttcagttttaactccaaaccttgggatacttgaattagtcagactagagctgtgcatcaatttcttgactccactgatctgagacattggtcttttctttttctccttttccttctgagttggagaaggaatttccacttcatgttgcttatcttgagaaatttagaaaatgttctatatttattattaattctatctgttttatatcatatgcataattggaaggattataattgatcattatatattccaggaaatgtttccaactaaaaagtttccttttagagagttcagtatttacatttgaattggacttaatttgatgtcttcaaacacaaaattaagcaaataagttccattacaaaataataatatcaaatgtattccatggttacctctttgatacaatgtcctaataaaaaatgctgcaagacttagcatgacagcagactcagaatacacaacaggtggttatttccactgttcaattccattcctttgtgaaactgacttaatgaactgaatattgttcttgccaactaaggactacagtttcaatacatactttgaaatggtagaaactttatacgcaaatgtcatgaaaacagcagtatataaaactaacagctaactgaaatgggtaacactgtgggagctgaaacagcaggttttggatgacttagattaattctgctactttttatttctgtatgatagtgagataagggttaaatccccaggttttatgggagcatagagaatcataaatattacctgataagtgaatacgtacataagctaattgtgttctatagtaaaagacctaagatatcttcttactttcatccacgatttcaaggcagtgatgagcaactctaactcatccttatatatagaacatattctaagtgtttaataaatgttaactatatataacagcaattttgttttgaaagtaagtccaggatacattcaaattactgacctttatttactgcattttctttctgtggatgaggtacaagagttgtcccaggacaccaaactcagctattattagcaaacttttatttagcaattgtattttatctgcccaccagtttactaggcttgatgtacacaagacggtaaattcatcgagggcaggaatcatttctaatttatcattaaacacctattgcccaacaatggctggcatttaataagaatttgttgaagatatgaatagatctctctataaaatatattttacagtttggtactatgaaaaaatggcaatatataatcttaattcaagaattcctaaagtcctaaataaaactaagaaaatgtaccttgtcacctgcaactctaaaactcagaggcggatagtgtcgaattattaatatgacgaatgaaaacaaatagaacttctaacacttgtttggtttccaaaatgagttggcaccccaatcctcctacaaaaacaaacaagcaaacaactgaagaaaaaaatttaattgcatgttgttattctcacctaagaatgtgtttgatataaactctgacacttgatttccagaccgactcatttcagagagatgggtgagctcccgattaagcatccttttaaactgaaaaacagaaaagtaaaatgaaataatagaagaggaaaatttaagtgaaatatatatgcatactctgagatacaggaagatatgcccaaagaatttttaagttgtcctgacaatttagaacagtgccttccagcagaactttcttcaatgaggggaaaacaccataatcggtgctgccaattatagcagtcactagccacaggtggttactaagcatttgaaatgtggctagtgcaaatgagaaaccaaattttgaattttatttaattttaactacttttaatttaaataatcacatgtggctcatggccaccagactgaccagcacaaatttagactcccaagggctgaagggaaaatcaggagaaataagcaaagaaaagggaattaaaaattaagatgtattattagttatttagagaagagagaaactaatttatagcacataaaagtgttgccatacaataaaacatggaatgctttcttcaattaatttatcattagcagaaatgaatatatatactgatcaagggctcaaaatttagtcttttactccaaagcaaaacttaatagacttgagtactcttccaggactatggagaagtaaaatatttaaataaatactgtataatgtttccttttaaaagttgtttttcaagtaagagtataacacttattgtttctcaacatccacaaaatttaccattttcccaagtcactaaataggaaacaggtcaattttcaacaatctacttcacagtttttattactgatgccatagtgcctatttcattgaaagaaacactggaattaacctaccaacaccacatggcattaccagtatccaaatctcccaaagattttacacttctcccacccccatcagctgtttcttaagcattaagcatttcagagtcctttgactctgaaaacaacccgacgaggccttttaataagcctttaatatttgccttaatatacagaaacaatgtattttttctacacatagagtaactgctattagatacttgacaaaaaaaagtcagatgcatttactctaatcatcagattagcctttaaaatttgaaatttcaccataaattctcatttaagtatgaaggtaagtgttgaatgtatattttagtgatgtttgaaatataattcttagtatttaattatttagaattattttgcttctctgcataattcataccaagatggcctaactctataccgtttgctaaataacttccaaagtcaatcttatagaccatctagattaagttttaactccgcatttaactgttatcaaaacaaacaaaaaaccctcaaccatttcaatggactgttggatgagagaaatgtgtattcgcatgccagcgtagtcaaaaacaaagaactcgtcatttacattgggtgtatctcctaatgctttccctcccccctccccccaccccacaacaagccccaatgtgtgatgttccccttcctgtgcccaagtgttctcattgttcaattcccacatgtaccctagaacttaaagtataataaaaataaaataaatgctggggaaaaaacaaacaaacaaacaaaaaaacaaagaactggcatgaccagtacaaattctggttgttaaattactggtctagaaagcttagtctcaaactcaggaacactaaattcacttctttgttcatatgtttttataactcctttctaattataaaatgtacatgtgctatagaaaatgtagaaagctataccaaaaaaaagaaaataatgtaaatccccactgctggaagataaccacagataatttgttaaatttccttttatgccttttttctacccttgtatgtgaatacatatttttaaaactggcatcaggtggtatacagaacataggttactgcttgtgttcactcagcattatatcttataacctactgaaaaaaataaactttgggccttctaagaatatttgtagacatttataatagagttcaaaattttttctgtccctctttacaaagttatattttcttgagtaaattatgggctatcatataatttaatgagctaatatagaagtgtcttctatttagcctggcacatagtagatgctcaatattatttgagttctttctcccagctcactttctggcacttggtccataacttttgggccttttaaagtaatagctgatttttatcattgcaggtcagacagatgaaggatttgactgtagttataaccataaaaatagttacttaaatagctagctcctctttctcaaatcccataaagaatttggaatagcattagtatgggaaaccatagctatgtctcaaaagcacagctaaaatgtcatgcatacacaggtttaaaaaactctttgcttaagacttggagccaacccaaatgtccatcagtgatagactggattaagaaaatgtggcacatatataccatggaatactacgtagccataaaaagggatgagttcacgtcctttgcagggacatggatgaagctggaaaccatcattctcagcaaactaacacagcaacagaaaaccaaacaccacatgttctcactcataagtgggagttgaacaatgagaacacatggacacagggaggggaacatcacacaccagggcctatgagcgggtagggaggggaaggacagcattaggcaaaatacctaatgtagatgacaggttgatgggtgcagcaaacgaccatggcatgtatatacctatgtaacaaacctgcacgttctgcacatgtataccagaacttaaagtataataattaaaaaaaatttgctttacagataaattcacacttggaaaaatatactcattaggcaaagcatattccaaagaaaagagtctgctaaacattttaaacacacattcaatgaaatatctctttgacctaaaattgttcatgttatgagctaaaagttgctattaagaactacctggtcatgacaaagtcttttttttcataaaagataggagatgaggcaaagctttcaccattgctagaatctcagcagtctatacaggaactgctgccctccttgcacttctctcaataaagcaaaacaagggaagccttctgggagtgattgataaagatagatagagacccagttatcacaggtttatcttctaacttgtacacaaactagtataaggattatgttgcccaaagagaacatgtggatgctacctgcagatatgctacatatattattggatttttctaaaagaatataaagaacgaagtataattttcctggcagtttgcttaaacaattcaccaaaatagccagttagtacagataactgaagaaaaaagccagtgaaaggaatctaaatattgtacagactagataagtgacatcctgcatgttcatctttctggtcatatacattattcccagagtactttccagcctttgtttaaaacacaaaaacatggattggagaaatcctccatcacatgcccacctccctaccaaggcttataagggactccaaggaagtcaacatttcattttaacataattataaaagacaatatttgaagcaattacttctctactctaggaagacggtctaaggaatttcctaaagataattctgaagcgtacattaagttataacacaagggtattttctaaaaggaattaacattgttttccttttttgctatccatataaaagtttcagtccagcaaagctaaatgaataaccacaaaaattaccataagtgctttctcaactggtagttgatctcacaaattggttttggagtgcatagctagatgtactaaaaaaatgcactagatcattcaacaaacatttaaaaatgtgatacttctctcatctaaaaataattatataatatttactaagataactacataaaattaccaaagggggaaggactgatttaaagctaatacaatgtattcttctgggaaatcccatcatatttctcaattaatatatttagaagggacaaaacattaaactgctgtttgaaacgaaccgattgtaaaatgcagaaccatttaagcatttagtttatttttttaagtgacctctaaatattttccattgatgaatttctaattgtttttggcctaagtagtctgaaaacaatacacagatttagggttgcaactaaaaaaacgggaggatttctaagtgaatgcttttgaatcctttgttctcattatacatcagaatgtctgtgtacagcagttaaggcataaaggaaagtaaaaatgcagttgaatctcaatactgtattttgcttttcagaactgcaattcttcaatttacattaggcatttaagattgttcaggaagcaaactaaaataataaaacaaaatgtccttaaatgtaatctcctttacttctacatcacgccagtgtgctactgggtatattatatatcctcccaatatatatttaaggaggtggtatgggtccaatagtaagaaaattttcttattttttcctgacaatattctgctaaaaatcatttgaatatgctgcactgtgatgcattacaagtttggtagatatcagtattcaaagttatttaaacaaatactccattgatggtataaaaataaaaccttcaaaatgcataagaccaaatatatctatatttgctatttttacatgtttttaaaggtacagtattaaacataaagctgtccaggaaaaattttcctcaaaaagaaacgtactaaaattctatatgtagattcttggcaatattgttcataatcatagtacaaatggttcataatcacagtacaaatgtgaagcccttcaaaaataacatcagttgtgagctggctaaaagctaggagctgaattctggcggataatgagggcttcttatatttactctctatacttttctgcatttctgaagatttttagccaagaaatggctaacaaaattcaaataatggaagtctatatattttaaaaacatttttaaaaatctgaatcatccacagatttaaagggaggtaaggaatcatgactacttggacaaccaagactgaaataagttttctaatttttttagaattcaagtaaatctctaaaacaaaggggaacttgtccttcaaaaagaaagaaacaaagcaaacgacaaacactccaatctgaaaaatcctcagagtaacagaaaatgaatcttttaaaatgtgttgtgattggctcccaggttcaagcgagtggctcaaataccaaaaatctgtgaagtgatgtttcatttaggactgaataaggtttttctacctccttctattgtggagacaggatcacaatgctaatgttaccacagggcatggaaaaagcctgccaagcatggacacaatcttattgaattgtttattaattcatttcttgagattcacaaaacagtgtaataaaaactttgttcagttttgcaagtataatagacaatcaagttttcactttagtatcacttacatagttaagtaatgtcaatttttaatgtcacctagggctttatagctaaaggtgaaaaaaacgtattcctcgtcaggttaaagtagtatagatttttagaaacagccacaaattaattttataaactttatgtgcaacatactaactggaatccataaatcagtataagtaatttggcccaataatttatttgcaatgaatgtatttaattaccatatatttttcaagcacaattcaaacatataccacatgacaaacagaagaactactgcgtatctaaaaaagctattttaacactcaaactacaactgatgaaagttatacaatcttatcttgaccactattaacacgtatttcttcctagttcatgtgtaaggaaagaatacataactgatagtttgaacaaattacagtagagtctaagctttctaaataattttgtaatcagagtaaggagttttcaaaagctaagtaagtcttacctttatgtagccccaagacactgacagtaaatagtttgcttcaggcatttttgattgattatatgtatatatatatatatgtatatatatagtaagctctaaaatgtatttagcttcaaaatctcgacactttaacaacctccacaagccacgcagagtatgagtttttaaagatttttggtaattaagtatacataagaaagcctcgcattaaatcccatccagccgtcttcccatcgaatacatgccatttgtaagactccagaatggcacaaaattcagcaactattctgaataaagaaaatccacgtgataaaggaatatctaaagatctaagggtctgcatctttctctcccgagctccagggcttaatgaataatgtatgtcaagatgcttagttgcaagaaaggctagtcctgtcaaaagctaccaaataaggaactgcagggaagccgggaagagtgacaagaagcccctcccataaaaccccaactctgcaccaattgcattccagctcttagcctataaggcgagggggtgtggcctcggtgcaggctgctttgggattggttggcaagggccagcctctggggaggctttctcctcacccgacaaacgccattgaataatggtatccctgcagctctgaggccaccctgagaaaagatgaacggggcttccctcttgcagtgatgaataatgaccataaaactcctcaaaattcgtagttcattcttaagaattgcccatccttttggagggcattttctatgaattttaatgtcctctggcttcccttccttccaaataaaaactgctccaaaaatggcaatcgagcattttaattgcttccctctctcaaatccaaaacaagtggctccctggtgatgtagaaatgactgtagttctcccctcatccaacataaaagcatagggattaaacaatacgactaatgtccagaattcacagatggcacagatggcaatgacacattccctcacctgtgtgccatggctgctctcagctccttttgtttctattgttatgtatgacagagttctaaaaccttcaaaatctaggggtgggaccacttgcaattctggggggagggaaatgtgaaagctagggcactgtgtatgcataaggaatgcagtgttttgtatatagaactcaggatctgtattttgatcagaagagaatattttatttatttatttagagacagagtctcgctgtcgcccaggctagagtgcagtagtgcgatcttggctcactgtcacctctgcctcccgggttcaagcgattctcctgcctcagcctcccgagaagctgggattacaggcgcccaccaccacgcctggctaatttttgtatttttagcagagacgggatttcaccatgttggccaggctggtctcaaactcctgacctcaggggatctgcccacctcagcctcccaaagtgctgggattacaggtgtgagccaacgtgcccagccagaacagaacattttaataactgtacacaaagttaagaaaggaatgagtggctcttaggaatccagaattgagctcaagagtaatcagacattttacgaggagggttaaatgagaaatcaaagttctttctagaaaaacagcattttctatttggtttggtgtagtattaccctgtaactttaatactaaagaggtcttgtgggtgagaaacaaggaaaaactaggttttagttgattttagcatataattctgtgcattttacctcctctccatctcaaagcctgtgcttactactctgtgctttaacttgctggtatggctactctgcagtcttcctgacatttaactatttccacatgtggcatgtctgtcttagagagcatgctctctgataagcactcctgtaacactgtgtctctctgagtttctattggcctttagctgctacagtcctctgcttttgttaacatctgttgtattcatttccatcactcttactcctctacaaaaggaagaaattaaagctccaacattccactaaagctacccccagaggaatactaaggtcctccttttctctggtctccctacttctctgaagtgttccacatgtttgatcattcctactactctccctcaactcccaggatcctgaacttctttaattttccctaggcccacaatcttcaatgaccacttctaacttgaacttcagtgccatatttctgaatacaagattctcctctcgaatgccctgctagtcacgacaaactttttcaaaactgtgagacatttttctatttaaagtagttcttagtataattacttccatttcagtcagtgagcctatatttcttccagtatctcagatggaatctatgactctttcctaccattcaacaggtgtttcatgtgcgtcagacactgtcaggtgtttaatataaaccatctagctgaatccttgagtaacccggcatgttcccctatacggcatcaccttccctccttcattcaactttgttagcaagccctatcttttatccagagctgtttctttcagtttattccttaccattacccctcccgtaatctgaatccaaatatttaaaagactgagagaaatagaaagtaactttaatatcaccccctctaactccctcatttccacataaagttgagacctagagagaaaaaatgattttcccaggttcactctggtactgagaacaagaattgcaagtttaaatcttttgtgcacaatcactgacaaataatctttttagtgtgtcagcttcctcatctgtaaagtggattactgtggcagctagtctccaaagatactcttaatgagccacactgtcctacactgaatctgagttggcttgtgtaaccaacaagtgatggtgcatgactgctgaggctaagtcataagaaatcttgcagctctcatcctgctttctttgaatgtgctattgggacccctaagccattaggttgaaaaaaaaaaaggtctgactactctgagaggctatgctacaagaagtccatgttaacttcacagacagtgaagagagaaagcgcaagagagcacttgcacaagaaagagcacacatgcctggccagtcttcagcaatgccagccaccccagcccagagccagacctgaggggcaagaagccatcctagccatccagccagttcagctttcagatagctacccactgggctgcaaccatatgaggaatgccaagcaagaatgtctagccaagaccagttaacccacaaagccatgaaaactaataaaaatacattcatatttcaaagtattaggtttgaagtgatttcttacatagcaataaataaccagaacagatacatatgaggattaaatgagaccatatatgcaaagcacttaaaacaacaaatggtacaaagttgaagataagtaggtatcagacagtaaagatgacagtgacaatgatcattatgataatcattctattatactaatatttaaaaaaattctctggtttgtcatttgtttttaaaatatatatgttatatttcctttcaattgcatcacagcactccatgtctcagggccaaaatgctgtaattgcttcttagctcatcttcttgcccctggcttttccccttctagtctcatattgacctctactgccagatcaattttcctcaaatccagccgcagcctgttacttcaaagctagtaatgcctgcttcatcacatccctctgtaaattccagactgccatatctgaccttaatccccaacgccaagcctattttcagctgctctattacatttgctctgttcctgaaagactagtactcctccaccttcaccatacagctgacaatcccatctctgtcttaccaaattctcggcctaaaataccctccttcttctactctgccaacctcaaactggttttctcagtcagatttaaatcattcaaagtacatcttaggaccaaatattccagcctttttccaaattctaacgattctacatctgccccttcattcaatatttattaagctcctactctatgtcaggcactgcctgagaaagagaaacaaagctttctcacctgcagcttatattccaaaactaagttaataaatacataatacgtcatggggtgataagcacaatggagagaaagaagggataaggattacggatagaggttgctataaggtgatcatggaaagcccctctgatgagatgacgtataccaggagatctgaagaaaggaaacaagccatgtggattgcggggtgagaggtagggtagagaagggaaaaccaagtgaggaatggcaaaagcaaaggcctcgaggcaaaacatacttggtgaggctccctgaagaacaggtggaagtgtcataccacttgtcatttaaatgcaaattacactctgcagtcaggctcactgccttccccctcctttaaaaaaaaaaaaatccatccatccatcaattttattctttgacaaacttaagactcagttactttttactttttataacaagtattcatcctgaaatgaaattcctaaatacacttccttcataatactgtactgaatacatataggctaaatactccctacatagatttaaaaaaaaaatcagtataatggcttatcagtgaaataaaggagaaatgagtaatttctatcaaatactacaaaatataaatacttgtacacaactacattttaaaaagtagtcaaaaactactataactgattagctgtgtgaccttggggaagctatttaaatttcccatacttcagtttactcacatggaaaatgagaataatagtttctaccttacagggttgttgtgaggattaaattagtgcatatacataaggctcttagaacagtaagtgctatctaagggtttgctatgatttctcttatggggagaattaccacaaaagtaacagtagcatgaaaatgaatacaggggtgttatgttagaaaaattttcctttttcctgatatgatgaatgattctttgaaaggtttcaaatgtaacaaagtgccatcttcacaatatacactattgctgcattactagaaaatttggtgtggattaaaaccatgtaaaaatatttaatacttatacgtaaaaagtagttgggttctaggctcagagaattataaatgcattttgttttttcacctatgtgaatagctgctgggactttttggaagttgtgtgggacacacagcaaacctccctggtgaaaggctgtcccatgtatcccaggacatctagcctccctggcctctgcccaccaagcaccaggagtactccccagtcactgtcccctgaaatttcctgaatgttccccagtgttaagaatcactgttctatttttttcaactgtcttcaactttgactcctcatccagggtggaggatctttgaggccagaaaagtatcttattatgtccctgtatttctcaaggtagtgtactattgccacaaaaagattgttggctgatgcagatgcaaaacatcaatatttttatactgattataggtgacaggaaaggacaagggttttcaccctcagcaaaatcatcaaaaacatttaaaacagattacatatagtagataatactccttgtcttaaaacattatgcagaaacacacatacagtttcccttccctctaaaatctgcagcctcttctccctgctgaatgtgagtgatggtcccttcattcaacagacttctatttggcaactattatgtgccaggcattctaataggtgctggatgtgaaaggatttaacttattcaaataagtccctaatttgctgcaataagggagattatttaatcatattgagtaaaaagtaccaaggaaagtttccatatttctagggaataagaaatcttttcaaaaatctctgagccaaattaaaattcatttcattttccctaatctccatttctaggagactagaatctccttcctattgccacggtagctgctatctgcagagagaatctagataatttagaagagaaatttgaatagagccagagagatacaattcttatagtcagacttggcttcaccaaatttaatgaagaaactttaataagttacaacatttactaggcacctactatgcacaaagaactttacatacctcatttctaatcttggcaacattctgataagataaatattatccctattttaacatgaaaagatggaccttcttacatattcaataacttgctccataggtgacaggattgaaatgcaaacccagtccttgctcttaatggtgtatgacagctcatcatataattaggctgatgcaaactctatgataaacagtatgaatctaggagtggatttgtttatcctcaatctttttgctaactttacagtgccttgaattaaagaatcatggttactatcaccatggtcagatctctggacagggtgaggaagcaggtgcccacaggcagacagccctgccatatagtgagacacgcttatgtttgggagcgctatgtgaacaacacacagctgccctcatatgcagatgtaatgatgacgacacattcagacaaggaactgaggtccagaaaagttctgacaacacaacttgagggacagcgttacagctagagctcaggtttcttatctgtaatccactgctctcaaatgcccaaatgattttatatacatatatgcaagtgtgtttgttgaaatagaaaaaatagtttcttggcctggtgaagtgcctcatgcctgtaatcccaacattttgggaggccaatgcgggaggattgcttgaggccaggaggtcgagaccagcctgggcaacatagagaaaccaccgtctctacaaaaaatttaaaaattagccaggtgtggtggcatgtgcttgtagttccagatactactgaggtgggaggtgggaggtgctgaggtgggaggatggcttgaggccaggagtttaaggctgcagtgagctatgattgcaccactgtactccagcctggatgacagagcaagaccttgtctcaaaaaagaaaaaaaaaattcccataatgttcagttagttctctttttcagacttttcctagaaatacccctcagaatttctagaggccacttccctgctattccttgttttctcagtccttaccagatacccaagcaattaacaatctttttgaactatttcagtacatttcaggatatttgaaattctgctgatggagctgaactgctgatacattaacacatgctgtcattattgactttgtaacagaggtcaagagagaaaagatgcatttttgaatagggaaaaacaaaactaaattatggggaaactaaggctcagagaggtcaagttgtcttgctcaaggtcacaaagccagtagtaagtaacagggccaggatttgaacccagactgtctggtttcagagtactctaaattgccaaaaaaagaaaactatttcaggcattattttatatttagcctagagcctacataatagatccgttaatataatcaattctaagctgtatattatattactgtgtttgaaatatttaagaaatattgtttaaaataagtgtattagctcttggacctctccaacataaggagttttccaggcagtagcactgtttgcagtaggacttacattattggaaaatattttatcctataatcaatctacatttattttacacctttcaccttaaaattaaaagtcgtggtagttattaatcaagaagcaaatctatataacgtggtctctcatatatccagtactgttcagcttgaacaaatgcaaatctaatttttaaatgtcccttgaagaattctgaggcaaagttaaacttcaagtattaaacagaatagccacagaaaactagtgtttctcagcctccctttgctttcaaatgccttaaaaatattttagaggcagacaataatctagaattgattcataaccaatattttacataacagaatgttacatgtattttcatattataaaaactatactttctttgattaatgctagtattctgaaaacatcgttagtgccagtaaatccactaaatctgtttgtatttactgccctctagtgataatggctctacatttgattaagaaaaaactattcctttcagtaaatgaaaacatctcttgtaagttttatggagatttgagattaagaggaactccaggctgcttttttaaaaccaaataatcatctgaacaagctgagaatcgttctctaaatgatcttattttaatttttttttaacaaaaaagtctcatttaaaatagtaaacacctgcaacatgtatggagaaaggaaaccatttttgctaagaggctccttgaagctgaaataacatgagactgatctgatagctgtatttatatttctcttctacatgggctaactctcttattagatgttagcatagtattctgtaattgttgatacagtttgaattcatatatggtagagacagagttttgtataactatttagtcaatttacctaaaaccagcagcagcagcatatctactacagacttttgtttcactgaagaataatcatgacaataaatgggtgcaaaaacttcacataaatgaagcctccacaaaaataatcttgtatgaaaaagtattgtctccttatagagaaaattaggatctccaattcacttaaattggcctaaatgaataccataatcatcataaaatagttactaatgtcccctctgtacttcgtggtatgctttgtggaaacaatttaaacaaagagaatatctgtctcctaaagtaataataactagtgtaaataggcatgcttccagaaatatataatcttttacacatatcactttaatatgtgcatcttaaaataattttaagtaataaaatttgagctataaaagagaaatgatattcttttcaacaaagaatgcttgaacaattgagcatccactcataaaacaagaaacttcaacctttatcctgcaccacactaacatctacttgaaatgaatcatagaactaaatgtaaaatctaaaactaaagaacttctagaagaaaacacagtagaaagtagttgtgatcttgcgttaggcaaagatttcttaaaccacaaaagcatgaagcataaaataaaaaatggtatactggactttaccaaatttctctttgaaaaaaactgttaagaaaacagaacaacaagccacagacttgagaagggaatatgtacaaaatgcatatcaaataaaggacttgtatccagaaattattttttaaaaaatctttacaacacaataagaggacaatccagtgaaaagatggtcaaaagatttgaacaaacaaacacttcataagaatcaaaaagatcaataagcatgtgaaaagatccatgaccatcattagacattagggaaacaaaaagtaaaaccacagtgagatgccacactacatacttactagaatgtataaaatacaaaatacaaacaatacaaaatgctggcctggatgcagagcaaattaaattctcatacattgctagtgagaatgcaaaatggtatagaaactttggaaaaaggtttgacagtttcttataaagttaaaaagtagagtgaccatatgacccagcaatcctacttctaagtatctacccatgagaaatgaaaacatatgtctatataaagacctatatgaaaatgtttatagcaactctctatagcagaaacccagaaacagttcagatatcagtcaactggtgaatgggtaaacaaattgtgtccataaaatgacatactggaaaaaaatgaaatactaaaaagcaataaaatgaaacaaattaccaatagatgcaataacacaaaatgtattataagtgaaacttataattcaactcaaaactcaaaagtattgtaagtgaaagaagccattcacaaaaggctatatctttaatgtattattcattctggcaaggcaaaaccatagggacaatcagcactggacgtggggtttggggaatgactataaaaagcaagagaaaactttttgggtggtataaatatcctatattatatagtacatatatattataattacacattacctatatatctagattatggtggtggttatccaattgtacacatttgtgaaaatgcattcaactatacctctagaaagagtaactcttatgtaaattatacctcaaaaatctaactttgaaaaatattagctgatgttatcaaattatttcaattccagatttgcttaactttacaactttgcccaaagataaatgcaaaacaaaaacctcaggcatagttatgtatgataaaacaccatttttaccctttcaaagagctccaccattatttcccagaaaacaggcatacagttatccaaggtccacattagctttaatgatacaacattcagtgaattcccagttgtgaaaagcctttaggttggcagggcgctgtggctcatgcctgtaatcctagcactttaggaggccgaggcaggcagattgcctgagctcaggagtttgagatcagcctcggcaatatggtgaaaccctgtctctactaaaaatacaaaaaattagcagggtgtggtggtgcactcatgtaatcccagctactcgggaggctgaggcaggagaattgcttgagcccgggaggcagaagttgcagtgagctgagatcgcgccactgcactccagccggggtgacagagattctgtctccaaaaataaaataataagagaagcctttaggtgataaaataatagtcaaagtattcttttaagtattattattttatttttttttaattctttgtaataaaaagttccataaagtaaaatattgtccttttttgttttatttttatttgtatcaattcaaggggacaggtgcagtttgttacctggacctgatttttaaataaatcaaactcagtttagttatttcatggtgatcctgggagactgtttgtcagtcatcatcgaatagcgaatgagtatcctttgtatgctcattctaggctgtaagtaccatgtcagctgatggagacacaaaaatccaataaagtaggtatagctgggggaggttccaagatggccaaataggaacagctccagtctactgctcccagcatgagtgatgcagaagacgggtgatttctgcatttccaactgagctttgaaaagagtagtggatctcccagcatgaagtttgagatctgagaatggacacactgcttcctcaagcgggtccctgacccccgagtagcctaactgggaggcacctcccagtaggggccaactgacacctcatacagccagatgcccctctgagatgaagcttccagaggaaggatcaggtagctacatttgccgttctgcaatatttgcggttcggcagcctctgctggtgatacccaggcaaacagggtctggagtggacctccagcaaactcgaacagacccacagctgagggtcctgactgttagaaggaaaactaacaaacagaaagggcatccacaccaaaaccccatatgtacgtcaccatcatcaaagaccaaaggtagataaaaccacaaagatggggagaaaccagagcagaaaagctgaaagttctaaaaatcagagctcctcttctcctccaaaggaatgcagctcctcaccagcaacggaacaaagctggacagagaatgactttgacaagctgagagaagaaggcttcagacgatgggtaataaacttttccgagctaaaggaggatgttcaaacccatcgcaaagaagctaaaaaccttgaaaaaagattagacaaatggctaactagaataaccagcatagagaagaccttaaatgacctgatggagctgaaaaccatggcatgagaactacatgatgcattcacaagtttcagtagccaattccatcaactggaagaaagggtatcagtgattgaagatgaaatgaatgaaatgaatgaaatgaagcaagaagagaagtttagagaaaaaagagtaaaaataaatgaacaaagcctccaagaaatatgggactatgtgaaaagaccaaatctacatctgattggtgtacctgaaagtgatgggagaatggaaccaagttggaaaacactctgcaggatattatccaggagaaattccccaacctagcaaggcaggccaacattcaaattccagaaatacagagaatgccacgaagatactcctcaagaagagcaactccaagacacataattgtcagattcaccaaagttgaaatgaaggaaaaaatgttaagggcagccagagagaaaggtcgggttacccacaaagggaagcccatcagacttacagctgatctctcagcagaaactctataagccagaagagagtgggggccaatattcaacattcttaaaggaaagaattttcaactcagaatttcatacccagccaaactaagcttcacaggtgaaggagaaataaaatcctttacagacaagcaaatgctgagattttgtcaccaccaggcctgccttacaagagctcctgaaggaagcactaaacatggaaaggaacaaccagtaccagctactgcaaaaacatgccaaattgtaaagaccatcaaggctaggaagaaactgcatcaactaatgggcaaaataaccagctaacatcataaagacaggatcaaattcccacataacaatattaaccttatatgtaaatgggctaaatgttccaattaaaaaacacagactagcaaattggataaagagtcaagacccatcagtgcgctgtattcaggagacccatctcacatgcagagagacacataggctcaaaataaagggatggaggaagatctaccaagcaaatagaaaacaaaaaaaagcaggggttgcaatcctagtctctgataaaacagactttaaaccaacaaagatcagaagagacaaagaaggccattacaaaatggtaaagggatcaattcaacaagaagagctaactatcctaaatatatatgcacccaatacaggagcacccagattcataaagcaagtccttagagacctactaagagacttagacttctacacaataataatgggagactttaacaccccactgtcaacattagacagatcaacgagacagaaaattaacaaggatatccaggaattgaactcagctctgcaacaagcggacctaatagacatctacagaactctccaccccaaatcaacagaacatacattcttctcagcaccacatcacagttattccaaaactgaccacatagttggaagtaaagcactcctcagcaaatgtaatagaacagaaattataacaaattttctctcagaccacagtgcaaagtagaagttgggattaagaaactcattcaaaaccactcaactacatggaaactgaacaacctgctcctgaatgactactgggtacataatgcgatgaaggcagaaataaagatgttctttgaaaccaatgagaacaaagacacaacatactagaatctctgtgacacatttaaagcagtgtgtagagggaaatttatagcactaagtgcccacaagagaaagcaggaaagatctaaaattgacaccctaacatcacaattaaacgaactagaaaagcaagagcaaatacattcaaaagctagcagaaggcaagaaataactaagatcagagcagaactgaaggagatagagacacaaaaaaaccttcaaaaaaatcaatgagtccaggagctggttttttgaaaagatcaacaaaattgatagaccactagcaagactaataaagaagaaatgagagaagaatcaaatagatgcaataaaaaatgataaaggggataccaccaccaatcccccagagatacaaactaccatcagagaataacacctctacacaaataaactagaaaatctagaagaaatggataaattcctggacacatgcaccctcccaagactaaatcaggaagaagttgaatccctgaatagaccaataacaggttctgaaattaaggcaataattaagagcctaccaaccaaaaaaagtccaggaccagacagattcacagctgaattctaccagaggtacaaagaggagttggtaacattccttctgaaactattccaatcaatagaaaaagagggaatcctccctaactcatttgatgaggccagcatcatcctgataccaatgcctggcggagacacaacaaaaaaaagagaattttagaccaacatccatgatgaacatcgatgcaaaaatccttaataaaatactggcaaaccaaatccagcagcacatcaaaaagcttgtccaccctaatcaagtgggcttcatccctgggatgcaaggctgcttcaacatatgcaaatcaataaacgtaatccatcatataaacagaaccaaagacaaaaaccacatgattatctcaatagatgcagaaaaggcctttgacaaaattcaacaggacttcatgctaaaaactctcaataaattcggtattgatgggatgtatctcaaaatagtaagagctatttatgacaaacccacagccaatatcatactgaatgggcaaaaactggaagcattccctttgaacactggcacaagacagggatgccttctctcaccgctcctattcaacatagtgttgaaagttctggccagggcaatcaggcaggagaaagaaacaaagggtattcaattaggaaaagaggaagtcaaattgtccctgtttgcagatgacatgattatatatttagaaaaccccatcatctcagcccaaaatctccttaagctgataaacaacttcagcaaagtctcaagatacaaaaccaatgtgcaaaaatcacaagcattcctatacaccaataacagacaaacagccaaatcatgagtgaacacccattcacaattacttcaaagagaataaaataccaaggaatccaacttacaagggatgtgaaggaccttttcagggagaattacaaaccactgctcaacaaaataaaagaggacacaaagcttatagataggaagaatcaatatcatgaaaatggccatactgcccaaggtaatttatagattcaatgccatccccatcaatctaccaatgactttcttcacagaattggaaaaactactttaaagttcatatggaaccaaaaaagagcccgcattgccaagacaatcctaagcaaaaagaacaaagctggaggcatcatgctacctgacttcaaactatactacaaggctacagtaaccaaaatagcatggtactggtacaagaacagagatataggccaatggaacagaatagagccctcagaaataataccacatgtctacaaccatctgatctttgacaaacctgacaaaaacaagaaatggggaaaggattccctatttaataaatggtgctgggaaaactggctagccatatgtagaaagctgaaactggatcccttccttacactttatacaaaaattaattcaagacggattaaagacttacatgttagtcctaaaaccataaaaaccctagaagaaaacctaagcaataccattcaggacataggcatgggcaaggacttcatgtctgaaacaccaaaagcaatggcaacaagagccaaaattgacaaatgggatctaattaaactaaagagcttctgcacagcaaaagaaactaccatcagagtgaacaggcaacctacagaatgggagaaaatttttgctatctatccatctgacaaagggctaatatccagaatctacaaagaacttaaacaaatttacaagaaaaaatcaaacaaccccatcaaaaagtgggtgaagtatatgaacagacacttctcaaaagaagacatttatgcagccaacagacacgtgaaaaaatgctcatcatgactggccatcagagaaatgcaaatcaaaaccacaatgagataccatctcacaccagttagaatggcaatcattaaaaagtcaggaaacaacaggtgctggagaggatgtgaagaaataggaacacttttacactgttggtgggactgtaaagtagttcaaccattgtggaagacagtgtggcaattcctcaaaggtctagaactagaaataccatttgacccagccatcccattactggatatatatccaaaggattataaatcatgctgctataaagacacattcacatgtatgtttactgcagcactattcaggatagcaaagacttggaaccaacccaaatgtccaccaatgatagactggattaagaaaatgtggcacatacacaccatggaatactatgcagccataaaaaaggatgagttcatcatgtcctttgtagggacatggatgaaactggaagccatcattctgagcaaactgttgcaaggacagaaaaccaaacaccgcatgttctcactcataggtgggaattgaacaatgagaacacttggacacaggatgggggaacatcacacactggggcctgttgtggggtgaggggagtgggagggatagcattaggagatatacctaatgtaaatgacgagttaatgggtgcagcacaccaacatggcacatgtatacatatgtaacaaacctgcacattgtgcacatgtaccctagaacttaaagtgtaataaaaaaattaaaaaagtagatagtcccaaccgctgtattctttttgaatccttttgccactgtttcatatcacagtttttttttttttctgagccctagattatcagtctgttctttttttttttttttttttttaatgtagtccataggaatctgctgcctcacggtcagtatcgtgccccttaccccaattctaatatgacaggtttttgtctaagacagcatttcctagaatgtgttgtaatgtacagcagcttcatgtgataattctcaaagactcccactgtcaaatgttagcatattcaaggctctgccaggacctgtaatacatattctttctttattctgtttaacttagcatttctgaaacctatcttactactgaactcttgacatttattaacaaacaaatacaaacgaaaataccagggttccaagtaaaattcttatataaagcaaagggctttaaacatcagagttttttagaatggttattcactcatgcactcaacaaacacttattacatagtatgtgccagcataggggatacagtaataaacaaaacagacaagttccctgttcatgtaaaccttggacttatggggcaaaaagacaataaacaagcagacaaaaaaaaattacaaacactctcaatgaaggaaaagagggtaacatcgtacattgatgggggactataaaattaagtagtaaggaaaagctgcacttgagaaggtggtatttgggaagagactcgaatgcctagaataagccaaccagatttggggcacagcactctcaacaaaggctgagtaacacagccagtctgagggaggacaggtctacggaatgagagccgaggcaagtcaaggcaacatcacgtgggtcctgagggtatgagccttccagagggtgtgaggataccattagaaggttctgagcagggaatgataggatgtgatttacattttgtaaagctgtctctgtagaggatagtttgtaaaagtgcttgaggcaaaactgacaagacttgaagacttgcacaacagaactgaagaaatgagaagaatcaactcctagacttctgggatgatcaatgtctaggatggacattggtgccatttgcaagatggagaagaccgggggaggtacggatttaaaggagggtatgtaaggagaaagaagaatcctatgagacaagaccagaacatgtaaatacatgaagttttggatttcttactcttcaaagacattttacctcctgtccccgaagttcttcacagagttcaggataagaaaagctgccagacagttgagttttgaataagtagtaactttcaaacacttgaaagacattatattagaatagactacatccatcaaaatacttaaaaatgtttttagaatagtccaataatttggaatatgaaagcctaagaaacttccttatccaaggccgcataatataaccaaaattagaatttagtactcctagttggcaatatttttatgaaattactgttttactaagacattttagaaatgaagactttactgaaggcaataataagtgcaattaaaagtggtacaataataagacttctttttcatttgcaacaggttagtagtgtatgagaattatgagatgtaaaatagtgtagagcataggcttctctagttggcttcatgtgagttcgaatcttggccctgcctctcttaccagcaatgaaatatgcagcattttacttaaggatactgggttgtatggagagaatcagagttaaggttggtgatccagcagtgtcatgtgtcaggagctaataaattgtattgtgaccagaaacactgaaacttgttataaggaaagcaatctaattaaaacagctgcattaaaatttctacaatatcttcctaacagcttatgctatcaacagtttgtaaactatcagaatcacggatactggctgagaatgcttttggagatttcaaattggcataattttctcagaatgcactgatctgacaaatgtacagacaggcagacaggaatactaccactcttcatgaataactgtctgcctctcctggatttcttccatgttgtgtaagtctattacactttgggtgaatgtagctttagtacattgagttaatatcattcttgcaaagaagctctttataaattccttaaacttaatttgactctggacacaaacaaatgagaacaaaatacagctcaaggattaagatccttaaccaaatatgtaaaaaacacgaaaagccttacaaacagtgatcaacagttaaacatgcgctatcaccttcccctaacagctagggaagcatgtatatgaatggaacatatgaacttccatttggtgtactaagaaaacacatcacgcagatggcttttatagcttcccaaataaggttctaataattcacaaaagtgttgttccctaaaacccataataaacaataataaaacctaatgtttattgagggtctactatgtgtcaaggagagtcctatgtactctcctggaattacttcatttatttctaataataacctttaatgagcactgtcactcccgtttcacagatgagccttaaggtcttagctatcaactttgcagacaacacccaagtaaaatcctgccccctctttttttttttttttttaaccagaaatccagtcctgacaactgaaagcttatagggcatttccgcttagatacatagccttacctaaattatatgtctaaaaacttaactgtcatattgtccagccctcccccaatacccaactggcttctcttcatgattttccaactataattctgtccattattcaggtttagaatttcatgctttcttctggctgtggtcctgccaagtcttatgtatgctgtcacccttctctgtgcaatctttctcctactcattcctctcttttcatcactatcctatttcaggcccttatcactcttacacctaattccctaacggtttcttcttgctttcagtacaatttccccttgatataatctatcctgcacactaccaccagatataaccttctaaagtcaccttattttagtttcttcataatattttccttatagtcaaatgtaagggttcttcatgaattataggacaatgtgcaaatggcttgacctggcatttaagacagtctgcagtatggcctcaatctacatttctcacacctgccactggtcctataatcacatcctctgttccagagaggctcactcctccagaatgcccactaccctcctctccagcaaacatacaataaagcgaatccacatgaataccccatcctaccctgccttatccagcccctggaataccacctcttccctattagatgcctatataaatcctcagtattcaagatccagcttaaggagcactttttctgggaccaatcattctggtcctctgtattgaatactcgaactcctctacaggacaggaacataatgtattattaccctatcattcattaacacacaacaggcttacattatatggctggttgtattttcagaggtatgtctatatgtttcgctatctatctatctatctatctatctatctatctatctatctatgtgtttgaatacagatacataaaaatctcatttcacctataagaacctctggagcagatacatgtcatacaataattgggctaaaacaaaaatccctcagtgaaaacctaaagactgggttgtggttgtttgcagccaaaacgtacaaaatgaaaacctcctaacgatttattttccacatgaaattagtaccagatctagagaaaaatggacaaggatcaaatacaaataataaagtcatcaccaaactaaaaatttcattcaaaagtgatgatgttggccgggtgtggtgactcacacctgtaatcccagcactttggaaagctgaggtgggcagatcacttgaggccaggagtttgagaccagcctggccaacatggtgaaaccccatctctactaaaaacacaaaaaacagctgggcgtggtcatgcacctgttatacccactactcaggaggctgaggcaggagaatcacttgaatccaggaggtggaggtggcagtgagccgagattgtgctactgcactccagcttgggcaacagagcaagactccgtctcagaaaattaaaaaaaaaaaagtgatgatgtcagtaaagacccaaatcagggtcatatgtttaacaccagaaagtttgtatttgctacaagacagaaaccttgacaaaataacttttctgtgctttgttacttcatctgaatgaagaaggtaaaccagttgatctcacaaatctctttctaagggcttctggaatttttttttttttttaaacaataaaaggaaagagacttctcttaagcagaacaaagtccgactcctctgtaaagtggctgacagcaagtggaaaatggaagaagaacaattacctgcaaaatgactcattcccttgtaacaactacactactagggaattccttctcttaccggctgtggctagcgtcagactcatgacaaagacctcatcctggggctagaactaggtttagggttttctcattcattcctctgtttctcagctgcattttcatttttaatctgtgcaatgattacagaggcctatgtttggttttcatttctagtttccccaggaagagacaactactatcttgatattgattaacacttgaaacttctgttaatcacaatttcagtatttcagggaatcagagaaatcatttggaagagccttgaaggtcatccagggtgagagaaaagcaaagcacaagcaacagaccaatgtttagacacagtgaagtgaagacctacaggagaccctctcaacttcaataagagtcttttttatggctgtcttcatattctttcaaagaaatcataataaaggagttagtgagagtgtaaataaaaaataggctatcatagagtgctgggtaactgagctaaaactaaagtaaacaaactcagtgggccatcacatatgcaagctggtaaggtctcataaatcaccatgactgggtattgggatttcaaaggcacactctgtaagctttctcccagccctgttgattcaagctccaattgcactgggttacttatatggcagcatataaagttgaccttttatgtttaaaaatagttccattcctcatccctcctaaggataggccacagtacctatcatatgtccccaccacactacataatttatgtaagttttcacttaattttcaacacaatcctttgaggtagattatgttagtcctgatttacagggaaaacagaggctcagggaggccaaatttatttatttatccaaggttgcaactctactgtagggcagatttatatccagaagaggaattgcaaagctcctcagaatttaggagatttaaaatggaatcaagataaaggttcacatttttcatcttctattccattttactcttccagcatctaataataacctatgatatattagaacaaatcagcccatacttattttgacagtctcttttcaccccatttcagtttgtaccttgctgtctcagagcccatcaaccacctttcctcactcccaggcagccggtccttcaggggatggcttggcagttggcccaccatcctctgctaccagggcatgactcatggaggcaacaggtgaagctgacgccaactattagtgctaaaaaagactcaagcctcatgaaatataccatccataaatcgctctccagtcagctctacccctccctccatttctacagctgactgtctgttcttccttaaacatttacatccgccactgacctgtctgggatttcttttttacttcaaggttctcctaaaggttcagtccaaccaggtttcaccaaatgaaccctgcggtggaaaggggcagcaacgggcattggtcagtttgcctccagccaaggaaagtctgactcccctccttctcccactcttctctttctctgcctcacactgcctaatacgtctttcctctttctctctttctttccttatatcttcattttccaccctattcagaagtgaaacttcccttgccactttgcccccactaagaaaacagacctccaacacaacctcttaacaggctaattttaaaatcatgaacctgcttacaccttccgtgagtttatcctatatcttctctatctgctgtctgcttcccactaaggttttatccctccatcccacctccaaatcctttacagctcagattctcagatctgctttagtcacttggtctcctcatcccactgaccctattatccttctgtgcacatgttagagggcacatgctcctcctaggaactagggccaggtcagttatgctcccatcctgacatgacctagagaacaaaaaaggcaaaacgaggtactgtaggattcctctctaggaattatactttgctgaaattgctcttgctattttggaatctagtgctcactaaatacatttttaaaatattatttggatatattttgaaaatacaaccagaggtcgggcacagtggcttacgcctgtaatcccaacactttggcgggccaaggtgggcagattacgaggtcaggagttcgagaccagcctggccaacatagtgaaaccctgtctctactaaaaatacaaaaaattagccaggcgtggtggcaggcgcctgtaatcccagctgcttgggaagctgaggcaggagaattgcttgaacctgggaggagaaggttgcagtgagcctagatcacgccattgcactccagtccaggcaacagtgcaagactctaactcaaggaaaaaaaaaaaagagagagagagagaaaatacaaccagagaataaacacttgttcttctatctctccatcttccccaccaatacaacatccagaaaatagtcatctttacacttatttagaagcacatagatcttataaaagtttaactgagcattaggttttcatctttaaaaatattctgaggctgggtgcactggctcatgcactttgggaggccaaggcaggaggatcacttgagcccaggagtttgagaccagcctgggtaacatagtgagaccctgtctctacaaaaaaaaaaaaaaaaagttaaattaaattaaaaaacagaaaagccggtctggtggcacatgcctgtggctccatccactcaggaggctgaggtgggaggatggcttgagccagggagatcaaggctgcagtaagccatgatggcgccactgcactccagcctggttgacaaggtgagaacttgtctccaaaaacaaaacaaaacaaaaaacgttttgacatgtagaatactgtttctgggactaaattagagatttaaggtttgaggtatgagaaaatacctggaatcatgccttacattagaaggtaaggtaaatactggtgtttcccaatgagttgtagtcagattgttcatatgtatcaaacagacaatatactgaaatatttaaaaataaggctaaatagcaacaaataatttttcccatgaattctactttttttttttttttttttgagatggagtctcactcagtcgcccagactggagtgcagtggcgccatctccattcactgcaacctctacctcctgggttcaagtgattctcctgctcagcctcccgagtagctgagataacagacatgcaccaccacacctggctaatttttgtatttttagtacaggccaggttttgccatgttggccaggctggtctcaaacttctggcctcatgtgatcgacctcccaaagtgctgggattacaggtgtgagccaccatgcccagctgaattctacttttttttttttttttttgagacagagtcttgctctgtcacccaggctggagtgcagtggcacgatcttggctcactgcaacctctgcctcctgggttcaagtgattctcctgctcagcctcccgagtagctgagattacagacatgcaccatcacacctggctaatttttgtatttttaggagagacgggatttcaccatgttggccagctagtctctaactcctgaccgcgtgatctgctctcctctgcctcccaaagtgctgggattacaggcttgaggcaccacgcccggctgctgaaattctacttttgaaagaacaaattccccttctgtagggactgatgattcagtctgtaatgatgcattctcttcatcttctttttttgtcttttcttctatatatcctttaggcattctactgtattaacactagatagaaaaattaagatttaggcccaaacattatcttctggcataaagtaaactaatcgtttcctgatgtacaataaataaacagacatatttctagtagaagattccttatgatttatcaaaacccaattatcacttacccttatggagatcttagatcttagaaaccatactgacaatataagattaagaaaacaacagaaaatcaaaatatataccaaggataatgttaataggtttcatccttatcacagcatactgttgaaacttacttgaaatatttttttaaaaaagatacaagaggacaagtgtttagtttttaacaagggaggggactagtcaacaaatattgattacctaatttatgaacagctctggccaaagtggtcaaaaaaaaaaaattaggactttagttttcctaaacctatcttaatttttaacaggattatagctttgttcaatctttacagtctttagcctcttttgtgaaatgggtttccttgtaaataataaaatgacacctatatatatttaaagcactcatgaaataattttatctctttattaaaaactgtgataacccttccaattttgaaatttattgtcttcctaaattcttgctacaaagcctatcattaatattgcagttcattttttccctaaagattgaaaaaaacactaacaaatataaagtctttatggtcaaagaatgtactccttttataaaacttggagttgatgtaaaggcacagacaacacaagttaccttaataataaatgcacttttctttgtaattttgggtaattcagtgtgatttgtaattcttttaaaagacacacaatcacttgtatttttgcatggttctttttttcctaatttcccactatagtgaaatatctgtttttccttctctattgggtttggattggaatgatcaggtagaattaaatgtaaaataacaaaaggaaaatactttatagatcttctcaaaatactttgaagggtataatctctttaagatggctttattcatatttaagccaaaaacaaaaagcaaccaaaacactactgtttatacaaaaagcagcttcaaaatcagccagttattttctgaaatggagatggcagacattagcctgcacttactccaatatggcagccgcatctttgcctctttgctatggacacatccccagcaggcctgtactttctactctccagacctgtttatgacaggccaaggtgtttcctattatggtgcctatggctgcacagtgcactgcttgtcagtaataaaagccagaggctgtccctatagggattacagtgcagcagaccagagatgctgatgggaatgcaagcatgccctaggcaaacattgcagaatactctctgacaggcaaaagccaacaaacacatcctttcttcccagactagcagggaaagtattcagttatgtcattttcacttggaacaaactaataagaagaatgttattgctaaaataggtagagatgagaaagagcagtttatgaccatgaatatggcctctatggtttttgcctgtgcactacaaacttttaatttaaacgagatgagattgatctagcatatactatgataaaatttctgagacatgagtatctaaaagcagaactgagattaagtgagaaatgctcaggattcctgtcactgaaagaaaaagaaaaaaacctttcttgaaaggcacaaagtagaatgctcagactctccatctaccaatacaaggtaaaaaacagcatttgcattaaccaacatcatgcattcttgtactaatttatgtgactaactacaaaatgttatattgacactcactgtgtagggtgtcaggatggccaagtggtctaaggcaccagacactcactgggttgggctaaaaacaccgtagaagacctcatcagaacaataaaacagagacacaaaatattgtactaagagttaagagaattacaaataaaagttctgtggaaagtcaaaggtatccaattaggaaagcctgaggtgggagacataggacaccccagatataggatgggaagaagatgggattaaaaaaaaaggctttataaaggatgtaacattccagataggccttaaaagatggcttcgatcttttaaataaaactttttgttttagaacagatctagatttacagaaaacttgtgtagacattacagataattcctatatactctacactgtttcccatttttaatgtctgactttagtatggcacatttgtcacaattattgaaccaatactgatacattattattaaacaaagtccacacttcattcagatttccttagttttcacgtaatttccttttttctgttctggatcccatccaggataccacataatatttagtcctcatgtctcctgaggctcttcttggctgtaggtatctcaggttttccttgtttttgataaccttgacagttttgaggagtactggtcaaatactggtcaagtttcgagggtagaatatccctcaactgagatctgtctggtatttgcctcatgattacactggggttatatgttttcagtagggaaaccacagattaaaagtgccattttcatcagatcatatcgagggtacatgttatcacttatcactgtcaatgttgaccttgataacctggctgaagtagtgataggtttctccactacagtttcttttttttccctttctacactgtactgtttagaaggaagtcaatatgcacagctcacacttacggtgtagggggttatgttctccctccttgagagtagagtatctatagaagttattgggaattccgcacaggaggagatttgtctattttcccccacttaggtatttatttaataaattgtatcaatatgggtttatggatatttattttaccctttgggatataatccaatactatattattttcttgctcaaattgttctagctttggccattgggagctctttcagtttgctcttgcaactcttcagtatattcccacgggtgtagggttccatttgtttgagcaggtccttactttttggcactacaagatgctccaggctcatcttacatatttccttcctgagtccctagaaatcagctattttttttcaaagagtcttggttccttttaccagagaatggtattagaaaccaaaatgagggtgctaagtgtgctcattgctactggggtatggtagcttctagaccctctcggctgatagagcaaggaaatatttgtgtgtatactagatggtaagatgttgagaggtagaatggagagttaccttcttaatatacttttcttaatattaaatattaataagatattgtgtgcctgggttactttcagtcttatgcagaggaagaacgtatgtacattcatttatgaaaaacactggctagactattcttctgcactgcattatgcatttctgctagaaaaagctcagagattttcagatattctgacaaaaatctcaggcttgcttgatgagctatactgtaaaattacagaaggaaacaaagggcaaactccttgaaggatgaaaataaaggaataaaacatataaaacaccaccaaaaaaagtgattaatgggggagaagagtaaataaaacattataatagtcctctttggttagtatcaatattattaggtcactttatcaaaaggatagaaatcaggatggcagacacccttctctaaccctcaccccccaaaataataaaataaaaactaatgttattccttcacatatggaaatgaatgagttctactgagtatctagtatgattcctgactcagtcgagacaattcccatcttttaattcattaaatcaccacagcaactatttaacagatgagaaaactgaagcacagaaggcaacgtggcccaatttacgtttggtaaaaggcagagaatgaatccaattcaggcaggctgtctatagtagggtgctctaaatccacggaccattctgcctaaggaatgaatattttatgaattggaatatttctgctgaacgaatttgccattttctcctctagtggagaaatccaactgagggtaaagaaggaaaaatgttgattgtttaaaacaataaattagtctctaaattgttcttgcagctgatttagactagtgtgtccaaaagtatgcccagtgttagtaaatggtaggcaaaatgctttaaggtggtgcaagatgaatgttttctcattttgttattcattaattttagaaaaaatacagaaaaaatataacttgaacatcaaacctatgatttcatgtataccattacttaagatgaggcacttgggtgagtatttagatttaacaataagttgctcttagcatttctatactttgacaataaattatccaaaaaagaaattaagaaaataatcccatttgcaatagcatcaaaaaaatacttaggagcagccaggcgtggtggctcactcctgtaatcccagcactttgggaggccgaggcgggcagatcatgaggtcaggagatcgagaccatcctggctaacacagtgaaaccccatctctacttaaaaatacaaaaaaaaaaaaaggcaggtgtggtggcaggcgcctgtagtcccagctaattgggaggctgaggcaggagaacggcgtgaacctgggaggtggagcttgcagtaagccgagatcgcgccactgcactctagcctgggcaacagagcgagactccatcacaaaaaaaaaaaaaaaaaaaaacttaggagcaaatctaaccaacaaggtgaaagatctatacactggaaactacaagacattgatttaaacaactgaagaagacagaaataaatgaaaagatatcccatgttcatgcactgaaagaattagtaatgttaaaatgtccacactatccaaagccatctatagattcaatgcagttcctctattgattcaatgcaattcctttcaaaattccaatgtctttttttttcacagaaatagagaaaaaaatcttaaaatttatatgaaccaaaaaaagacctaatagccaaagcaatcttgaacaaaaagaacaaagctgcaggcatcatattccctcatttcaaaatatattataaagctactgtaatcaaaacagcatgttattgacataaaaacaaacatcaaccaatggaacaggatagaaagcccagaagtaaatccaagtatttacagtcaattgatttttgacaaagggtccaagaacacacaatggagagaggacagtctcttcaaatagtgttgggaaaactggatgtccacctgcagaagaaagaaactgtactcttatctcacactccatataaaaatcaactcaaaagagatataaaggcttaaacataagacctgaaactgtaaagctactagaagaaaatataagggaaaatctccacaacaatggtctgggcaatgatttcttggataggactccaaaagcacaggcaactaaaacaaaaatagacaaataggactacattaaactaaaaagtacctgcacaagcaaccaaataatagagtgaaaagacaacccatggatcaggagaaaatatctgcaaaccatacatctgataagaggctaatattcaaaatatataaaaaattcaaacaaccaaatagtaagaaaacaaatcgattaaaattagacaaaggatctgaatagacacactttcctcaaaaaagaaatatgaatggccaacagagatacaaaaaaaaaaaaaaaaaaaaaaaacaatgttccccagccctgcacagtggctcatgcctgtaatcccagtgctttgggaggctgaggcaggagatcacttgaggccaggaattctagacaagcctgggcaaaatagcaagaccctctctatacgaaaaaataaaaagccaggtatggtggcacacacctgtagtcctggctacttgggaggctgaggcaggatcattgagcccgagaatttgaggttacagtgagacatgatcacgccactgcactccagcctgaacaaaagagcaagaccctgtctcaaaaacaaacgaaaactcaacaatatctctaattctcagggaaatgcaattaaaaccacaatgagctatcacctcatgcctgttagaatgactattttccttttttttctcttcaacttttaagttcaggggtacatgtgcaggatgtgcaggatgtgcaggtttgttacataggtaaacatgtgccatgtttgcttcacgtatcatcccatcacctaggcactaagcccagcatccactagccattcttcctgatgctctccctgcacccatcccacccgccaacagaccccagtatgtgttgctctccaccatgtacaatggctatgttcaaacagatgaatgataacaagtgttggcaaggatgtggagaaaagggagcccttctacactgttggtgggaatgtaaattagaaccaccattattgaaaatagtatgaaggttcctcaaaaatctaaaaatagaactaccataaaatccaacaatcctacttctaggtatacacccaaaggaactgaaattggtacatcaaaaagatatttgcactcccatattcatttcagctttatttacaacagccaagatatggaagcaatctaagtgttcatcaagtgtgcataaagaaaatgtgatatatatatatatatatatatatatatattatatatatatatatatatatatagattatacaggccgggcgcagtggctcagatctgtaatcccagcactttgggaggccgaggcgggccgatcacaaggtcaggagatcgagaccatcctggctaacatagtaaaaccccatctctacttaaaaatacaaaaaattagtggggcgtggtagcgggcgcctgtagtcccagctactcaggaggctgaggcaggagaatggcatgaacctgggaggcggagcttgcagtgagccgagatcacaccactgcactccagcctgggctacaaagcgagactccacctcaaaaaaaaaaaaaaaaaaaaaaaaaaaagattacacagccttataaaagaaagaaattctgtcattcacaacatcatggaatggaactacaggacattatgctaagtgagataagtcaggcacagaaagacaaatattgtctttaataaatgatctcactttatggggaatctagaaaagtcgatctcagaaacagagagtagaaaggtgggttaccagaggctgtagaggaggagggagagagaaatggaagatgtcgatcaaacagtacaaaatttcagttagattggaggaataagttttagtgatctattgcactgcatggagaccccagtaattaataacgtattatatgttttacaatttctaaaatagatttttgacattctcatcacaaaaagataaattggtgaggtaatatagatatgttaattagctttactaaatctttctatgatgtacacattttaaaaatcacattatacccaagaaatagatacaattaatatttgtcaattaagaataattgacaaataaattttaaagattaataaaaaatacattaagttaaaacattcaacatataatagcagatatgaatgtacacagaaatgacaaaatcccagcactgtgggaggccgaggagggaggatcacgaggtcaagagatcgagaccatcctggccaacatggtgaaaccccatctctactcaaaatacaaaaattagctgggcatggtggcatgcgcctgtagtccagctactcgggaggctgaggcaggagaattgcttgaacttgggaggcggaggttgcagtgagctgagatcgtatcactgtactccagcctggcgacagagcgagactctgtctcaaaaatgacaaagtttgagcaacattaatttggactgtaaattcttaaagaatagaaaagtcatgtttttcttctaagaaatattatgtttttacattgcaagaaatatgtgacacagagtttttcttaatctctcttttttagtatattctagacaggcaagcacatgcaatttattgagcacccagtgtgtgctaatgcaccaaacggagctttacatacattatagctaatggtctcaataactttttcattttattttcccctttcattatcgccacttataaatgaaaaaactgagctccagagcggtaaggcctattgcccaaaatattagataggaaacaacagagctggaatttgaaaccaagtttgcctaatgaaaaacatttatgttcttttcactgtacaaagctgctgtaagtatcactggtgcctactccaggccagggagtaaatatcattcatccttatcacatacaaagtataacaaaacaaaaacaagaagctctgaatactaaataataataataaatactttataaaagataaactattctctaagagtaaaagataataaacctattgtcattgtagttggtcactgaacttaactaatttcctaatggacgcagcagaattgtttgttgtttaagcaaatatcaaggcataccccccaatccctgttacagggaataaaaaaagtcttcttcaaatgcctttcaaaactaatgtgaatattaaaataaagtgctactgatctctctacattctagaaagatctcagactaacagtgtcaattaaactattacaacaaatagccatgtaaaaactgctcccctactagagctacgctatcacaaaattaaccccagcaatctacagttctagaaaaagagttggtccctcctgctgaaaaagagaaaaccaaaccctacatattttgtgaatccactgaaaataatgacataaacagcactgcacatccatcatgtatttatatcttaagtgatagctacagtctatgtaactatcgcagaaatcttcttaaactgaacaaaagcattatctatcatcctttctctctagaaaaataccagtttgtttaatctacccataacattagaaaaaatacttcttttatcatgggcaatccttatgtttcggaatttttttcgaaaacgtagacagttcataatgctctcagacagaagttaccactactaccccaaatattaagtcaaaatgtaactgaaaaaaagaaatttatctagtaatgattaatttattgaataattaaaaattaggagtttttgataattaaatgttgggaataattaaactttcactaaatactggcacaggaactgaacggatgacaacagagacaagttaagatttgttttaatcctaagttttatgctaaggtaacatcaagggctctacttttcagtgaaagaaaaatttcctttaaaattgtttccctcttccattattacttaaaagcaaagaaagtattttttctaacagtgattataggattctcaatctttcatattaactttaaggtactacatgtaagctacataaatctttcccaaatctacctttattgagtagatgaaaaagcagatatcgaactcaaaacatctaaatgttgattttctataattatagaagatattttcttttgaaatttaaagtttgtatttaggcatattaacacttttttaatctaagatttaatatgttaatgtagaaaacaactgaggctgttttctctctataaaactaacatgccttttccaattaacttagtttccttcttagcaaaagtttaacatttatatctgttgagttacactgtagttgcataatgtggaaatatcttaagatttagccacttctatgaagatcctatatttgttataacacccctcttgcccagaagaaaatacatcaacaaaaagtcctactatatgttctgcattgactattacaaagcagtagggggagcagccagagaaagctctgagacaaagcacccagcaaagcaatttaatttataggcaacagaaacatgctagagaggtttgccaaaagccaaatacacaaaataaattccataaagaagtcatgaccacatttgtaaagctggcctaagtatatttggaatgaagtatagaaaaatctgaagtctcttagaaagggtctggattctaacttcaagacagactttcagcttgaaacacagtcatttccagccatgccaaacctcaaactgcccccaaaattagagcagaaacaaaatacatttttatagtgatatgtcttgggaataactcaaaatgatttcgttttctcctttgaacctcactgaacttacagggaaggcctggtgaaatgtgcattattaggtcacaagaggataacgttacagggttccatagcataatccttgaaagccctgaggcccaggccgctgtcctgctctcctctctactgactcccatcctcaatatactttccatgagagaaaggtaaccaaaaacatggtgaaactattctgcttaaaaggtgttttactgaaaaggcacattgaccactaacccttattacatttcacatgttctaaaaattagtaaggtctgcattttcagttttagagtaaaacaggaaaagtacttagttagctcttctgtctggcattctgtaactggaatttaagaaaagcctaaacttctaattagaacttcagaatgttcatgtctgtattataccacaaaaactgtaaatataatttaagcatttttatgatacagaaatgtgcgctatagacagttatctaagaattataaaaatccatcaaacttgaagtgtctggtataaattacaaccgaatggtaaaaagacattttagccacgtaggcaaccaatgaagtttgacctaaaacccaaataatagcaataacaacagatacagtgcctactattgtcagatactatattagctagctcttttgtatatattctttggaactcttacactgacttttcaagatagttattatggtgcccattgtatgctaaggaaactgaagctaaaaaaaattgaagtcatttctctaatgtaactccattagcaagaaacaaaaccataattcaacttccaggtttgcctgcctccaaagctttgagacctcactaaaattaccctcaattgtagcaatgaggttccaaaggaaatctgtacaaatctcaggcagattaatgtgcttataagggtaaatgccatagatttaatcactcaaattaaatgccatctggaatctcttaccctacttggtacaagcatcctacatgtgttacagccaaccctagccttggccaagaattcaataattttcctgcttcaatgccatcaacaagcaagaaacatatataataccaatacaggaaatacagctagttgctcctagagcatcatttaaaagctgctaattggctaagatgccttttattgagaagtctaagaaacagaaataatgtgttaacccagtttgttaaatgggtttgaggaatcagtttcctccttcctaatacctaaatccatctccataataagtattctctatcaccatttaaaaatcctgatctcttactagtgtttttattgtgcttttcaatctattagagtaaattttttaaaacctcaagagagaacacagaaaactgtcataatttttcaaaggctaaaggagaataaactgaaaatatcagtttgaacacgtgtatgtaaaaagaatggatggtaataaaactaacaactgaaaagcaatgtttctgactcattcattcatactcaagaaatatcaaataactgagtggagatgatgcaagctgtacacatttccagttcagactgaaggtgtggcaacactcacaggggccttccgatcagctgctccaactcagtttacagcttttgtggatgtggcttattcatgcccttgttatgaagaagaagggtaactttacaacctttagcaagagcttttttttctttctgtgctaacccttttttgtctataacagtcatgtaagcttagcactgatttagaaataaataagttaaagaagacacgaatggcttggacattaaaagtttaagcaacagcttaagctgagctaagtttaatgttaaaaattagtgtgacagcaataatttttcaattcagctctgtcgtgggctaggaaaaaatatcctaatttttcagccacaagacataaacattgctagaatgactacattttgaaaaaattatcttctcactttacctagatttcattttaaccaaacagaccaacctctcctattaaacctgtaaattaactcaaagtctaatctggggccttcataataaagattttttttttaaatccctgtcttatctggtgcctttaaaagaaaggaatcattttaggcaattattatgacctaaaaaatttttaaatcttaacgtatagattaattccttgacagctgaagtcatttacaatacattattaaatttcacattcagttttaaatccaaacatagatctcaacattaagaatatggattttagggaaagtaactagctgctcaaattcatttagctgaaaaactactgtcgaatcaccttgaaaatatacactaatgcttgcacattgctaagtggcttttgattctgctcttcattttcttacacagaatcaaccacacaatagaattaagaactcaggcccatggcaaagtgctcccatttagcagttaggacactggacatattcagcatatgtctactgctattgagaatcaaattatgaaaacaaactatattttataaaactaagaatttgttactcagatgagaataaaggtgcctaatgctacagcagggggtaaaagtcccagtaagagagcaataattggtcattctgatgaggagctgtgccaaatttagaaatgaggcacaaatgacaaaaaaattgatcatcagtgtggacatgggtaggtcagtgtgcatatgggtaggttagtatctgctggccgtgtctacagagccccttttatttatttgaagccaacttttcacttgacaatgctacctacaaaagcactgttaatagataagacaatcaagtggctgttatgccgtggcctttttgtaaaaactgcatgagaacaggtgggataaaaaccatagaaaggtagaaaaaaaaaagcatcactcatttaaagatatgtgcacatagatgaactgtaagataatataaccttcttgaccttgtaaataggtggccaaaaatacttaaatatcttgacgaggcaactattactaattgtctcacaacattaccagtccttactggctgaatccttcagccatctgcatacgacatgcacaggcaaatagccactaaaaacatacacaattccaattatctccttgcataactaaagacaaaaagaacaggaaatccaaaaaatacagcaaaactgaaaacactataccttgccttccgtgctattttaaggctgtcccaggctgaaggttacttctcagccctcaaaactccattaactgccaagaccagcaccttagcacatatggcacagatgcctagttgaagcctccttgtactaaatgacctcaaaaaactgggctttctttccaagattaatggaaacaaaagtaatgatcataaggaaccttctaactctgttaatgtttcctgcggatatgtatggccaactgaatatataaaggctcagttcttgcggggtaccctgacaactagatgaattagggtgaaggttccaagttcgatgaactcttctgagtttgagtgccctaggtggtgacattcaagtgatttcacagacatccaccaattcttattttcaaccgggaatcccaagaacacctttaaacatgcaatgcccatggaccctactgggtttctgctgcaagggctcagtgttacttaggaaccctgtgtcttgggagatacttaaatttagcacgtcaaattgcttttggaaaatgtttatctggcgtgactaggggaggcaaagcaaggaaacaggaacctccctctaaggagcagaatagccaacatgcagtaagcctaaaaaacctctcaatttatttcccggggctatgggtaccagtggctcgccggcatgggaatcagcagcctgggggcaccagtgacagcagaaccggggcttaccttgttggaggccatctcactgacggagtgcctggtctgtagggtctctagctggtccagacaccagtccagctcctccagggtctcgctggccagtttctggtaggcctcctctgcgaagagacagggaaagggggactcagttctcaagcgcttcacgggtccgctagcgagttcaaagggggccatcctgccataccccgccatgctcggatgcccggtgccggcacatgagggctgctccttcatattgcccagcccggcagtgcaacgggggcggaggctgtgctcgcggggcggccggcctcggggaggcacggtctctccagcttggcgtctcgggtcggcctccagggagggcgtgcaaagagcggcgagccaactttcacacagcgacgcgagcggaaaaaccactatgcgacttttcaactgtgcggcgggcccgagtcccagtccaggagcccggctctagcggatggcgagggggtggcgagcgcgcttgggtgcccgccccgcagaggagcgtctggtccacagccggatctcctcggtccccaacccggagccgcggccccacgcccgccccgcctgccgagccttctgcacggcacttgaagtgaatgaatcagccgcggccgggtgcgcggccaccacgtttcctgttttctttctcaactcctcgggcggcaggcgcagcgcggctccaacgccgcagctttccgggaacactccccctcacgcccctctcggccctcggcgctgcctggctcctcctcaacccccttacgaaaagattccgaattgcaaaagcctgtccctgtccgtgccacccgccgcgtccttcccctcgagctctgccccgggggccccgccacctcgcagtgccatccccccggcgcagccgggcgccactcgctttgaagtgcagacgaggaggcgcgggcgcgagcgtgtgtgtctgtggggctgctgtgggactgtctgtgctaggagagcggcggaaaacccggcgtggagcgcctgcagtccgccgtccggggtcgcgcccgccgcggggctcaggagggaccggcacgcaggcgcgcacggccgcgcacctgtctcgctagaaccccgcgcgccccgccgagccactgccctccaggttgcccagaccgctggagcctctgcgactccacgaccggctgcttcctgcgaagtttcacaaacaaggttatttaggaccctcaaggtttctgagggtttaagttttagggtttctgggggttcgtttctaaaggcttaggattcacctacttcaaggaggcagggttgtgggaattaagaccgcattctttttctacccagcccagtccctactaagtaccagacttctaaatgttggggcggacagaaacaagcaaacaaaatatacaatgttgtggggtcggaacgctttataattcacaaatttgacaataggctgcattttcatatgccgaattgcctaagagttctcttaaaggaacagcaatgtgaaagaaccacatggtaaggagaatttacgcatgtcctgcatactactcctttcccctgtgaattgcataagacctagatgatcttgggccaaggaagaaaatctggaagggtgtttctacccaccatgtgcagagtacactacaattttgagaaaacggaaagaccatattcaaaggcatacagaaaagcctgttctgtttacaaaggctgacccagggcaccagggacactgtccctaagcagatcagttgtgggagaacttttctacattagcatgcaataagcaaaccattcatagtgaggagaagtcaaactcccaagggtccatttgataaaactttgtcattgtcgagtggaaagaagatactgagaaacttacactaagtggtgggatcccttgtctttgtctttgaatctacaggtattggagaagaaattctgcccttgaaatttagactccataaattaacatggcacaacaaataaagttcatggactgaatttaggctcctgggatttttgagatagctttttatgtgaactttgtaaaagttagagtaacttttaaagtagttgttacatgtgccacgtggcttattgttatcaagaatacttgaactatttactgttcactttgagtactctaggttaaaatttgcctcttttttgttctacttcctccaccccgcagtctatgtaaatatatactttagatggacaaacaactgcctaaaccttgccaggtgaattaaagtttcagattgaagcttttttttcccccttaacaagcttaaagatattaataattttaaatggtaaatataaaatacctgctctgtatagcttccccaattctaagaatgtaaaaaatattacatgcttgttataaaaattgaagcattacacacaaatataggaagtccattgtaaccccacaccctaaagatcacaaacaatactttcgcctatggctctaacacaatcattttcattttactgaataacttccatatgcaagtatagcatcacctagttgccatggtagtgcatctactatatggtttggttttgatattttcctctctctctcattcccataatataggaatgtaggaaattttaagaggacattgacttgttttatgatcatttgagctgtccatagttagcctatccagtggattaaagatgcataaccattgtgtctgggatttgttcagtgccatcttttcaatcattggttacaatgaagctgggagtcccctctgaggttcggctttctgtggctcctctcccctgcactccaactttctcaaagcctgagcctcaagtgatttcccagtagctaagtaaactgcccccttcctccatcttcaccaagttcccaaagctgttcagactcaggcttcaaatctaacaggatgtggctccacacattatatttcagttgttattttttaatgtggaaaataattcaggaaagttttggctaatgcttcaagacatcatgcactttatacacaggatttgttcttaagaaggtagtatagtgacaggaggaacaatttacttcagaatatccattttatgtccaagccatgcaccagccacttttgacagacaggatttgagtatgatgataaaatggggtaagcatatattttaagttctaacatctgtataaataagaaaaatgaaaaatcactggaacacatctacatgctagtgagaaaataattactaacagagtaaagtttgctctgtgaaactgttgctcaaataaagaattattcttgatattagcatagagctgagaatattgcttttttccaaattcctaggtgagtaggcaatatagctagccacgatttttcaggatcatttgtaaagcttcacttttaggaattttaaccccaagtgttctaagacatcaagtaactgaccttttcatcccgccgaacaaacctcaaagtggagttgccaactatcccacaggaaattgagtcaccacaccaagcaacacacctaaatgtcgacagctagcaggacaaaaacagtgagccagtttaattttggcttttaccaagaacacatactgcattcattaataaaatacttcccctcaacccctgccagagtagtatacactgtggctctccttaaaaatacatgaaaactctttaactgcaccaaatcttgctaagtcaaggaactaaacagagaaaaacacccaagcaaaaactattggctaaactccctaaaggctgggagagggctatggaacagcaactgagaaataaattgagccttgaaggcccctgctacaacagcatcagttttcttcaaggcacctttgaactatgtaacacccgcattctgctgaggctcttctgtgaacaaacagtcctcaattcttgcgggccagcacttggcttctgtcacagtgatatgcttagaggttcccctgacacatggcctgaaactgtgccaggggctccaggagaagatgctgaagaagcagcttccttttgaaaaaggaaaaaagtaatcacctcagagccacagcagttagctagaggttgaggtcattttttgtgaaatgttcagtccattactcttacccacaactcacagtgatgttgaccattgaggtaaaaggatccactgtacgggatgtgtaactatgtggacattagtttctttgccaacacttgaaggtctgctaaaggactgtatcggcttgtcataattcctagatagacctattggtatacatgaagagaacaagtccaaaaaataccacttattttggacactatttgtatgcccttaatttaaaaaaaaaatacaaattataacagctgaggtcgggcacagtggctcacgcctgtaatcccagcactttgggaggccaaggcgggcagatcatgaagtcaagagatcaagaccatcctggctaacacagtgaaaccttggctctactaaaaatacaaaatactagccgtgcatggtggcgggcgcctgtagtcccagctactcgggaggctgaggcaggagaatggcgtgaacccggcaggcagaggttgcagtaagctgagattgggccactgcactccaacctggacaacagcagaagactccgactcaaaaaaacaaaaaaaattataacaactgatccagattttttttattattacactttaagttctagggtacatgtgcacaatgtgcaggttagtttcatatgtatacatgtgccatgttggtgtgctgcacccattaactcctcatttacattaggtatatctcctaatgctatccctcccccttccccccaccccacagcaggccccggtgtgtgatgttccccttcctatgtccatgtgttcgcattgttcaattcccacctatgagtgagaacatgcggtatttggttttttgtccttgtgatagtttgctgagaatgatggtttccaatttcatccatgttcctacaaaggacatgaactcatcctttttcatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagacccttgaggaatcgccacactgtcttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtcatgatgagcactgatccagattttttaaaaataaaagaactacaacaaaaagctcctaagagcaaatacttaaatctccctaaccagttccagcttctcttctcttaattcttacaaaatttcccctttgttctacggaaggaattgatactgtctacagtagatagaactggaaaaaatgatttctgtttcaccgtgtattgctttgagctagtcattcctttagtttgctacagtaaaagatttgtgtaggttaggtctaacttttgctgacttaattttttttcctctatacattttatctgatgggaaatacatgaaggctttggattctctttcaatgtgtacatgtaataggtttaagcagagtttgctagtggcaagctgctctcatctccaagtgtatttctggcatcaaattattgttttgaagtattttaaaattgtataaaatatataaaactttatttagtacttcataaagcttccaaaggaaagatgtgtgcaattttgtgacggttttctttttcttttatcttctcactaactacaattgtttttccgaatgttgcctatgcctctagtagaatttttatatgaaataaacatgaggttggctttcattgacttttagtcccaccagtaactcaacatttatttagcactgactatgtgccatgcactttattagaggctgcagaaacaagatgatgaaaagagtgtgtcccttacccagagtccagcagaggaggtaatttcagcaaacaactgtagagtgcactctcacagaaggaagcatgtgggctatgggacagtaaaagaggactatttaaatcagacagggacagaggtggagtgggaaaaggctgagtcctcaagaatgaaataaaagagagtgggaaggatttttaagagaaaagatgagcaagcacacagacctatgatgaacaagatgtctgtgtcggccaggcgtggtggctcacgcctgtaatcccagcactttgggaggccgaggtgggtggatcacctgaggtcgggagttcaagaccagcctgatccacatggagaaaccctgtctctactaaaaatacaaaattagtcgggcttggtggcacatgcctatattcccagctacttgggaggctgaggcaggagaatcgcttgaacctgggagatagaggttgcagtgagcagaggttgcgccattgcactccagcctgggcaacaagagcataaaaactctgtctcaaaaaaaaaaaaaaaaaaaaaaaagatgtgtgtgtcaaaaaagaaataaccatgagtagggccttgcttaggggaacagattctggagaaatctgagaaatcctcagccactggccatctcaaagactggccatgtcaggcatctgcaggtaggactatatcttcaagagtaggagtcacagagtgactcagagtactgtgtgacatgggatctgattttattttatatggaaaattctagtgctatgcaattaatggaatttaagaaagtaaagttgaagtcagtgcaaccattatctttgaccatattaagaataaaattaaataacttatagaccatttgcttctctgacgattattcttatctaagacaatctctgtattaaaatcctacgcagacatatgttcccacaatatgtcaggtatgaacagaaggactgcccaatgtgacttgaaagggagtggacttcttgctcttaaaaactacaaccttgtagtcactaacttattaatcatactgtaataagatggagaaaaaaacaatggaattcaccagaatttctttcacgagagtctgcctgcattaaaatgttcgataaagctatttatgacagaaggtgagactttgaagagctttggtttgggtggaactaatctgtgcctcatctacacaggaaaggggaggaatatgccagttgctagagagggaatatgtatgtgtgtgcatgtgtgtaagcgcatgagagagcgagagaatgtgtgtttgtgcacatgcatgtgtgtgtgtgtaagagaaaggagtcagcttggtctctgtgtgtgcatgtatgtaagggcatgaaagagtgagagagagagagagaatgtgtgtgtgtgtgtgtgtgtgtatgtgtgtgtaagagaaaggagtcagcttggtctaaagggtaactccaatttgtacatttttcctttctcccaatcatcaataaggttattgaagatgtgtgtgtgtgtgtgtgtgtgtgtgcatataagagaaaggagtcagcttggtctaaagggtaactccaacccgtgcattttccctttctcccaatcgtcaataaggttactgaaggtacaaaatcccgacttgttttgttttgttttattcattgaagggactgagcttgaaggccagattggcccaagcagaaatgtctctctgagctgacataagagaagagtcaaagaaagaggagaaagcttttataagaataaggaggccttttgtccaaaaaattggagtttgagctaagtttaattaggcatctaggttgggggcttcatgtgacatgtgtgcaactgtgagtgatattattctttgaaagaaactggaagagtggagaaagattccaatctctattccacttcatacaagcaattccaggcaattcagctactaatctttctagggccttatttcacctatagattggagataataacaagagccttgtaagttattttagttcaagtgagaggttgtgagttaaataatcttgcattgattgcctaatagattcttttcccttcctcctccattgtatcttcactttctcctggactcaagtctctaacttaaatgcaaacattctattaattttagtgagcctatcaactaatacctaggtataacctcggggtccagaaacttaatagttacctggaacagtttttagggtagttagaaagaaaaaagaatttcaaggaatgaacagggattcattctgaagaagttcacttagagaacacaggccattcaggaagctacaaacaggtagggatataaagtttagatcagacagtggacaaagataaagatggagaactagtcttggaggacttgtatactattctaagacaatattttcttctaaagaggccattaaaaatcttctaagtgaggaagtcacatggtcagatttgcttttcaaaaagattactctgggaatagtataaaggcagatcagaaaagtaaagaccagttaagaggttggtgaccagataaggagaaaatcctaagcagtccctgaaggggaaggagaagctgcagaaagttaggaggaaaaactctcaggagcaaagaaaaaggaaatgtcaaaggaaaatattgttatggactgaatgtttgtgtctctccaatattcatatgctgaaatctaatccccggtgtcacggtatttggagggaaagcccttcggaagtaattaggtcatgagaatggagccctcatgaattagattcgtgccattataagaagaggccagaggttgctctctttctaccatgtggatacatgctatgtgggcagtctgcaaccctgaagatgccctcaccagaacctgactatgctgacaccctgatctcagacttccagctcccagaactgtgagaaataaaagtttgttgtttaagccatcagtttatggtattttgttatagcagcttgagctaagacaaatatcaaggctttgccattgatattcagtacagaccgtatatacccacaggtttgcgctaagataattttcattccaaacacatatttcagcaacacaagactaaagagggtgttaaagaatgctactgaggaagcttttgtctgggaagttgtttgaacaaagttacaggacaatttttgcaaacaggtttaaaaaaagttacaattatgtatgctatttacgtattcttgttgtaattttaggaatcaattttatttccctggggggactgtaggagagcatctgtgtttccatcatatactatcaatcttaggatataacagtcttttgttcttcacctttgtcaattactgcatacagtattccttagagaaaacaaggagtttgaacagattatctttagcacctacccagctctaacattcatttattatctgatttctgaaattgtactatctgggttaggtgttggttttaaggttgttcattatagttagcctggatggggtcagctatgtttgtagagggaattcctaaactgaccagttacttgtcaaggatcccatccaataccatgatcctggaattctgtgagtttagctcaactgttcttcaggggtacatgttttctatttgaaattgaggtattctcagaaataaagctattaataaatagaaagttctggagtatatttacactcactctgcttatctccactcctacccctaccatattcccatccaatactttgccagttgacttaccaatttcttcttaatttctgtaactgtcaccttcagtcaaattctcatctgtgtatttctagattcatataatggtctactactggatctccttggattcactttttctcaacacagtcctatttataaagtcagaataatcttccttaaaccctggttttattgtttcattcttttaagaacctgctgcacaactctctcctacttattgtattaatgtcacacttctgttcacataggcctttttcggctgcttttcaatacctttcccttttatttacatctaagactatcccatccaagactgcccatcttagccaatctttccacctggaaataatttgctggcttctgcctgtatgacttttctaatgtcatttttatatttgtgtctaggcctttctataactgtctagaaaattcctgacatttacaggcactcagcaaatatttgtgagtgaataatcagtaagtatgcttgttttctatcagataagaatatttatttccaaacgagattcaaacagtaatactggcctgggtgtggcttcctacatgtaatcaccctcgtctatctcttgttctcagtcttttgctttcaaactctttctctttttttaaaagagtattaggaactaacattgccaaaatttggtaatggtcaagcagatcatggtgtcttactgaagtgaaatattaacattaaaataaaaatgacaagtattatggtatatcattcatatgtaatgatccttacaaaatagagtaaaattttaaaagaattcaccaatacaccagtatgatgtttgggagaaacagatgaatgcacaaaggtgcatctgatgcaaacacccccagaaaaatgagcataagttcatattatcaatatttttcactctaaaagtgttcactgacttccctgaagtcaccaaggactccaagttaagaatactttcctgagtgaagaaaagaaagcaattattttaatcaacactgccccagaatcttttattcggaatcgctatctctgctttcttcttcttcttttttttaactttctcataaatctctgtttagcatttatatctctctcactatgagatacctaagggttaagaagtaatgccaaagagacatttgtccagttgaagactgggattaagaaaaaacacacagccgggcatggtggctcatgtctgtaatcccagccttttgggaacccaaggcaggtggatcacctgaggtcaagagtttgagaccagcctggccaacatgatgaaccccatctctactaaagaaaatacaaaacattagccacgcatggtggcgggtgcctgtaatcccagctacttgggaggctgaggcaggagaatcacttgaacccgggaggcggaggttacagtgagccgagattgtgccactgcactccagcctgggcaataagagcgaaactctgtcccaaaaaaagagaaaaagaaaagaaaaaacacacaaaagatttcccgaaaagactaggcccttttaaacaggctatgaacagagtctcagaaaggtaatttcttatgtacaatttttaatctcattacttgcattacaagcaacacatatgagtgataaactattttggcctactggtaaacctacatttgttaactgtgtgtgcattatagagaacaaatttcagaactcaagagtatatcggttatatttggcttatccagttgtatatgaactggctccatacacgaataagataaattagttttataattttacaagaatatctatggagatttagatttggctaagaaagttattatacacacagaagaatccacaacctataagagctcttcatgggaaatagtgtgatagatcagaaagagcatggacttttgagtcactcagaacttgaattccagccttgccattgttctagttgtattatctgaaataagccatttaaaagacctgagcacattgtatacattgagaattacagggttattatgagaaatgcataagaaatgtaaagtaccaagggctgtatctgacatatagaaggtattcaatcaatagtaggtatactgaaccactttgcagagttgtttaaataagttaattttaaataaggtagttaatatttgagagtttccttccttttccacagattctcaatcctaaaacagttactatttttccatcatcaccatcaaccctcaaatattaaccagttctgagccaaatgtgagtgaacaacctatgatttagaatagcttttagaccaggcacagtggcttacgcctgtaatcccagcactctgggaggctgatgcgagcagatcacttgaggccaggagttcaagaccagcctagacaacatggcaaaaccgcatctctactaaaaatacaaaaagtagccaggtgtgtgtggcacatgtctgtagttccagcttcttgggaggctgaggcaggagaatcaattgaaccctggaggtggaggagatggtgccactgcactccagcctgggcaacagagtgagactctgtctcaaaaacaaacaaacaacaaaatagaatagcttttacaagaccacaccaaatcatgaaaagtcaactatgtaggaagaatatgtatttgtcattggttaatgacagagcatcacttacactgaggttactgggaagatcatttcaaacatttcccaaagaatgttccaatcaatattgtccttataagattctccttactaatgacgttttgtggtcaaacaagcttgggaaatattgtatatgtaggctttttacagtgatttctaatggacacgaacctaccaaaagctagaaggtccacagcaaaatgagatatttaattttattaacaagcattatctaaacctgtttgattttagaatgcatttttcacacaacaactatcacctcttgaagaatacctggaataggttttcctatacctatacctatatgtcaggtaactccaaaacattaacaaatacatgtgtttagtaggttcccatatggttgaaatctccactaacgacattttatttctcttcctcctgactttgtatgctatcgagaaatggtcagagagtaatcttcctccctccctttcttcttttctttctctctttttccccctgaaagagaatagtcaaaaaatccatacatatttattgagcctctctgatgtgatagttgctgtgaaatacaagaacatgaaagattcagcagcctgggcccaggaaggaaccataataacctgctgagaaaatcagacacatgatcggctgctgcctagagacagtgtaaggtagcatataaatcattcagcctgggagtgctactgtagttcgagcagggagagggaggtatggactatagctcagtgtgctgggtttcaggaagaaggtgaacttggatgtaggtcttcaaggaagactgtggttttaatggctgtgggaggagggagtccgctggcattgttttcaggtgtaggaaatgtctgcagcctgaataaaggttgtatgtgtggacagtaaatgggctgggtggagtagacacattccagggaggagaagggatatagagttgaacacttaaatgtgtggccttgagctagtggatattgtgggaattggataagtgcactggtagcctaagaggatagaatggagaagagagaaggatggagactaaggagctattgtggtagtccagatgcagtggaaagcaaagagttgtggaggtatccactttagtggtctacgatgacagttacaagcaatagaaagagtatgacttgggaacagtggttcaaatgctggctctgcaacttagcaaccatggggcaaatttgggcaaattaacttctctgtacctcagttttcttttttgtaaaatagggctaaaaatacattccctagaaggtggcctccaggccattttcccacactttatttgaatgttaaaactaactttaatctaaaaatcatatattcatatctctatcttttttggcggttcagttcaacttaaatgtgttatttgttaaaaacttgtaattatcatctattacatgtaaaatataagagctgcttttaatagtaattcatctcctccctatctttttttaaaacatggtcaaaattaacaaaacaatcttgtatttttgatactagtagtggtatcactactactagaggtacaaggactcttgtacctctctgaaaagtagcataattagcaacagtattgatggtatctgctattttagattatttaaactgtagtcactaaggtaagcaaggggaagaaggcatgtcatttatgtgtttttcatccttaagattagcgtttggaagcatatattattccacagcaatctggataggtcttgccatgccctgatcttgtaagcccaaattttattttgaatactccagctttgcacttaaatgacagctccttgataaaagaaaaacaattgcctaacaattttcttccaattgtctgaaaacataatgggtgtacatacacacacacacacacacacacacacacacacacacacacacacaatctctagggcatatttactagatagtattatgtaatgtgtagacatttttaattatgataattaagacaaaaatatgtgtagcaagtttttgatttgagacaaatttgagatttactaaaattattatatgtgtgtccttctgaagacttcatattttcattatatatcttcattcttgaagtataactcttaaattgttgaattaagttttatgaattaagttgttttgttttttgtttttttttgttgttgttttttttttttggccaggcacggtcgctcatgcctgtaatcccagcactttgggaagtcgaggtgggcagatgacttgaggccaggaatttgagaccagcctggccatcaaagcaaaaccccatctctactaaatctaatcttgtgcctcaagcgaggcacaagactcacttgaacctgggaggcagaggttgcagtgagctcagatcgtgccactgcactccagcctcagggacagagtgagattctgtctcaaaagaaaaaaatttttttccatttttaccaataccactattctcaattcatccactatttcactaggaattactaattcagtttacataatttattcaatgaataaattattcaatgaagaagcttctgggtatttaggtgctacatgctaatttcaattggcatattttgtttttcaaatttgttcttggtgacccaataattatacctgtccaccttgaaagtgtctttcttcatcaccttcaaggccaccgctaacaagacctttgaaaagaagtaaacagtagagaatttcaacttctgtgatgaccaccgtcttcttctgaatccccagactccactcatacaaggttttggggaagtttaaatgaaatgaagcagtggcttacaaagtttattgacagtaaactacagtaaaatttatattttatactataacctggtagatttgtttaaagtaagaggtgctcacttttgaaggcatgtggatgctggctttcagtaatataaaaaaaatgtacaaaaaggttttatacctatatttatttttaaaaggtagaggagagcagtggactcctatttaaagaaactcttgtgttttataaataatagtcatggcaaaatttgtttacagtctttaacaaaccatgcatttcagtataaattaaaccaataaaaagaattatatatataaaataaaaaggaaatgtatatataggaacagtatataccatacacataagagtaaatatatattcgagccaatacagagaattgaaacataatttaacatgaaataacatttatccttactatgtatgattcactctgatgttttctattttatttaattttaaagtattaattgtgaccccttaaattgattttgaaatctaccaattggtttgaaaacactgaggtaagaaattaccttgcttaataaatgttagttttgtttccctcttccctcttcctccctttttataattaaaaaactctccctctacttctctacttcacgtgagagtagaacacataaaaagatttcagttaactactgtgcatattttttgaagtaatttctccataatgtgtgagttttctcagggtactacaagtttaccaacagaacacataaagcagcggccactcactgaaatgcctataggagacagatagaccatatgaatgaatgaatgacatggttgctgggcatcctggttgcagtggctagaactgtggagggtaggagcagaccaccatatatcctaggcatttcattggcaaatgaacaggagaaggacacctttccgtttggccctcattttcctagatctttcctcccttcctctgtcaatccctcctacatagcctatgttcccaaagcaccccttgtattataataataattattatgatatctgtccttaatcaagaacttatactggatttttaatgcctttaggtcttccccaaacttcagttcatctattcgaagtccctataaaatctacctccttagacttgtctgcccccattattcccctgtggttgacctcacctccatctctatcttttgtcagcaagtttcctcagagttccctctctgcatacttgttcatgctgggttatttgtttttgccacttgatcatctagacctttttccctctttccctccttctattcaatttctgcctttcactgctgtacaaaggaggggcagggaggccctccagggtggagggaatcagtcttgagataactgagagattcagggtgatgagtcccaaagttgaagagaatccacatacttcttctgtttttgttttacctagcaaggagccttttctatagacaaagttgggaaaccagaggttatgacgtgattcatctttgcctacttaaactttagcttgattcatcacttctcaacaaatacttgttgaaccccaccagtaatacgagaagcttggtattctatgaggtgctcaacttccaaagcttagttcagaagaattctggcctcaaggcgtctaccatctagaagcaaacaactaacaaatgaacaaatgcagtgatttcaaaagaaattaaggtgtgctgtggtagaggcatgcacaggtcagaaaagttcagaggttccagacaggcttcctggggaggatatccatgccccgcctccacctggtagttcatgatcagagtttgcaagcttggctgggatagagggaatagcgtgtgaaccacagaaggagtggatctggtggctcagacacggcaagaaccagctcatggcactaggctgcaggcacaccatgcacaaaacagtcttttctttccccagttctccaaattctctaaagtggaagcctaggggtgagggtaagaaggaggtaggaagctacaaccactggagcaaaggacgaaagaaggggcttgagtgtctaaaagtgcagaaactcaaccgactggacgctgagacaatgtttaaaaaggagtttttttgtttgtttgttttcttgtgtttttttttactttaagttctgggatacatgtgcagaacgtgcaggtttattacataggtatacatgtgctatggtggtttactgcacccatcagcccaaactaggttttaagacccgcatgcattcggtatttgtactaatgttcttcctccccttgctcccccaacccccaccaggccccagtgtgtgatgttcccctccctgtgtccatgtgttctcattgttcaactcccacttatgagtgagaacatgcagtgtttcgttttctgttcctgtgttagtttgctgagaatgatggcttccagcttcattcacgtccctgcaaaggacataaactcattcttttttatggctgcatagtactccatggtgtatatgtgccacattaaaaatgactttttaaagtggcaactgtgggaggcaaaggagaaaaaacaggagctgccagataagggagtgaagagaacccagcactttgagaattccgttacattttgcagcttgaattcttcactttttgctcccattatgtgcctctttctcctctccatgaactgggccctgtggacccaggatcctgctgtctttgcagggcaaagaatggttagaaatgaattcattaaggtgagaaaccattgctggcataattctccttcacggaaacctggcacttaaatttaacctgtttggttagatccagctctgcctcccccatttttttctgcagaaacaaggctggcagatccctgttcctcttaatccttgaatggaccaaatgctgggttatgctggggcagtgagggaccttacaaacactgaaatttaagagaacagtttttggagtaaggcagtccttgtttccaaatctgagctttgccactgattgactagcttggcaccttataaaagtgaattaacctagcttgttttctaatttataaaatggagaaagcagtacctatatcacagtatgattctgaaaattatttaaataggactatgtatgtaaagcagtgcctgaaaaatagcaagtggtcctaaagtcactatgatgatgaattttatatgcaggcacctagagcatgttaggatttttgggatctttcccagctcacactgaagcttcactcttctccaacagtctgttatccaatgctggataactgagatagtcttcccagcatttatcaatgtggttaggaacagtaatcctggaaagcattctcaaattatttatctaattaaacaagcaaacctttttagcccagacatcctaaatctctgtagcttgtcttcgctgatttggtcagaatagctcagatggtaggaagggctttctgggtagaaaaaaataaattagcagtctggaaaacaaaagatctctgcttaaaagagtctctaaaacagcctgatcagcctgtgtattttgccatattatctagcattagtaggggactgggaaaaatccagggctccttgtagagatagagactggcaaatattatgtttgatgcatgagaaccaaatcagaagttaactctttaagttattaaatcactaaacagtctatcacaattatgtgtttattactagactgaatttctctggggctggaaccataatgaattcattttttgatctctggtgctaaacactggctgtcatatactaggtatccaataaatgtttgttgaatggaactgaaaaagcatgaaacacttcccctgttaaggcttcttttctataatatttccatagtttctaatgcatctgagaatcattaactggactgttagaggaatatgaatatggttgagggagctacaaacttcatgctctgagatgtcacatgattagtgtaacttttgttccaggggagagaaatccctaagagagtgactgttctccatgcccacccacccacagtgtcctatagagcctttcattctccagatgcctataatgactatcacattgatttgtttacatatctattgccttgtcttccttataggtacagagtccatacatcctaattggcctggaacttccaaggtctatgcctgttataccagtgtaattatgaatagcattgcctttcattctaaaaagtgttctggtttgaatgctaaatcatctagacaccctacttatgagagggttcactgtacatcgtttagtcccccaactcccctccccttggaaatctgggtactaccctctaccgggggctttccactatggaggcagctctctcaatcacagcattcaggaggtgtaagtccactcccaacagaacagacacctgtctacaaagagactcttggtggaagaaaaaaaaaaatcacttccgtaagtttaagtcttccttttaaacttgggtctcttttgcacatcagaaacaaagaatctctaataattacatccctaaatgtactgaagtctagaagacatgcccatttgaaaactctaatctagtaattaaagcttctcaggttaaactgcaccttaataatgtagcttattttgtcaagatcagttaaggccctgtaatgtgatttggaataaatggacagacagaaattaaaatgtgctggacaaggtaatcagaaatctcacttcatttagtcaataacaatggcaattcagcgggttccttttactactgggatgtaattgtgcttggctttaatttcttgtaatgatggaacaaattaaattacttcatacttttaggaacatttggctacatcatgttttggtgcttccataaaccccactggaaattaaatcagctctgtggttgctcattctccctctttagtgccatgtctgccttctgtcagcaaaatggtaatattgtctaccttaatccaccagatgcagttgagttaaaagaaattacctctcccacctctttcctttcaaatctccctatttgtagctatcaaattttggcatgcctgctggaacacagtcttgttagaacaagcacggtaattctctcgtgagactttaggactctctctacgacaaggtcagaatgtacctgtgattcaaatttagatgaggatatgagttggtaagaacatgaagagcatcagacagttttcaggacacccactacttttattttgtgctatcagtttttcctttcccaaattgcaggtggagatgcaatctttaacgctggaaatctcttgctatatgccattaaaattaattagtctagcacattttatctttaggcccttacctagggcaggtaaaatattctagcacaaaataacacaactttcctgaacaccatggctactaagttcatatggtaaagattatactatacattaccttgcaaatagagtgttgcagactgatattaaatatttaaaatgtatgcaggattattaataggcaacattgtggcagagactgctaaatgtcccctaatattgatgcttttcttcatcacttgttttcaaatacctgttttcatgtaagcatgtgactgcccaaaatagagaaaattcacagcctccttggttgccaggtgttgccatataactaagttttggtgaatgagttggtagtagaagcgttatgtagatattatatgatgtgctagaaacttcccttaagagaaatttgtcatctatctttttatctgcctgtatttattgttttctctttcctactggctagaatgtgaagttgatggctggagtcggagcagccatattggatggtgagttgaatttagcaacagaggctacacctcacagtgcaataagatggaaagagcacgtgtccttgaagactgtactggatagaggtgccatattaacctcggactgccaactttcagattttacatgaaggagaaatatctgtcttccttaagccacttctattttaaatctctctatttactgctgaataaaatctcaactaacgcaaacaccaataacaaaaaattcctattcactcatgatataggattataccttagtcttttttgtgtcatatatctgttcattcaccatttttgctttgatgttcaataaacatctcaaatttaacatatctataaaaattttttaaattttacgttcaggggtatatgtgcaggttagtcatataggtaaattgcatgtcatggggtgctggtgtacagattatttcacaccgaggtaataagcatagtacccctacagcttagtcttaagaagaagtatgttcacataggccaggctgagacttggatgttggatgactttcttccagcttactctgatttgaatatattgtgtggtagtagatggctaaactgcttgctccaaaactatctgacaatgctttttagaaagtctgccaaacaaaactacaagaatcaccctggagcttcccttaggcttcagatatttgtcttccctgccctacttggaaatcattccagcctggaagtcattgtgaggaaccaaaaaatggtctccctaccatgaagaataacactgcttccattgttgggaggctctccttcctacaggcactgtccctcactcattagacacttgaataataaggatgttcatatatttattggtgttggtatcagttagacagttgaatgatacaaatgttcatatatttcttcttattcaatagtctcacaagaacactattcttgtaaagtcattaaaaactggatggtcttttcataattatttccatgatttgtcatctaaagccagtgttctctcctcctgtcaatctgatagctttaaagctaagttctgggtgggtccaagtcatgcctgaaaggtttatcaaatgacatattgcagtcatatggtcggagcacaaacacctctgaatgtacaatattttaaagcaaaacagtttatgtgtaagctctatgaggttacggaccatgactatcttatttattaccaaatccccagctcctagaacagtgcccctcaatataaatctgtcaaatgaataaacgaagagtttgcctgcagtagtaaacttgttatttgcacacactcgaggcccacctctatgtgtacattgtcagtgagtcagcctcgtggatgactctgcaggactgtctgtataacatccactacagttaccaggggacccaattttcataaattgctccagcatcacaccctcctcttacagagactcttcctgtccattctaatccctgacacgttgtcatcctcactcagattccccaatagatagaaatgctgttaaatatacttgggtagagagggataggcatgctcaaactcgttttgggaaaaaaaattgcaactgtcagaaatgtgttagctatcttcacagattatgaaacataaatatcaattatctgttcacagcagtgaaagcctgcatatttttttaagatagcaagtataaaacggctataagtaccatgttgagtagagacctaccaccgaagtagagaccttcactgaaatagtgaagggatggttgtgttgcagggtcagaatgattacccactggttgacactccctccaggactaaaggcagcatcaccagcgtccactctgcttctccactgcttactgttaaggagcaaggcaatagcattatctaagtaggaactacttcattctttcaaaacctggaatcggctgatcagaagaagaaaaacagtataaaaatacagaaagacaagattctctggctgtcctaatgaatgctagctagctataatagcatggataagacatataaccaaacatataagatctattaattaaggggaatctctatttgtattaactcatctattttctctaaaaccagtatttagttatctcccatacattggcatattgtgtatatttgcagaattcaaaatgttactgatgtgacttttttccatcagacatctgagctatccctcaactaatagttgagctgttcctctatagctcagtatctgagttagaactcgaagtaaaaaggtataaataagtcatgctataaaattcaaaggcaatcagatgtttgagactatagttatacagaaaagtgtccttgttcttgggaggaatacatcgaggagtttagggatagagggctatgatgtgtgcagttttctctcaggtggttcagagaaaaaaagacaatgtgtgtgtatgtatatttgtgtgtatgtgcacatagagtgatactgcaaatgaggtggaatgtttacaatgagtgaatgcatgtggttttttttttttttttgcactacccatgaagctttccagtgtgtctgaaataacttccagataaaactttttttaaaggcaatcagaacagtggcaatgaataattcaattatttcatatttgagctgtctttcctgccacccccaccccctataacactacatacatacataggctcacataagtgacacttactatacttttttgcctatgtaatgagtgttggcgaagtacgtgagtgggaaattcagtcttttgcattcaagctctaagtaattctaagagaccttttagataatgatttgacttttaagacaacaattttgaggttataatatgatgtcatttcatataaacagaactgcccttttgtcctttcagatttgattgaaaatggcccatggagtacaaccacctgggaacatatcctcgagaaagacagttgaggcttattgcctaaaccacaggctactgaaaacttggccaaaggcgactactctagactggtgacttcaaaagtgctgatgaatacagtgaaccatgaaagatgcattatttgttttgaacattttactatgattgatgacccagatttggcaagttagttcactcccagtggagatgaaagtttcactgccttctttctttcaacattcttgttgagacagatttcacttttattggccaatgtactaacaaatcacttgcatttgcagcataatgaattcattagcaacactgtggatcaatgctatacataatattcctgagtcaacattaactcttaattaaacttccttattataatgcctctggaaattttccttcaggctactaaacttcaagccaacagtctaagtgttaatcagtaatcatgctagtaactttttgagatgggtcagggccagggccagggtcagtgatccatcatgaatggcaggtttaaaaatggatatacgtgatcaaaaatacccataagttgaccaaagcattctaacctttgggttattctaacactcagtgtatcagccttctgagcaagccaattttttattgccttaaaaagtctaaaagaaagataaaaacagagataatcagttttgtttggcaatggcaggggtgtgggaaatgaaaaagaagaaagttaaagatgagtgaaaataggatagtcttggcactttggtatgaaattgaagtacttatttaaactgatgaatattgtacagaaatatacagagagcagtgaggggctaagaacctaattccaaggtaactacaaggaaaaaattattgatctggattgtgaccagaattcaagagtttgactgttgtcattgttgctgttgttattaagttaaaaaaaatgagaaaaaaatatacttttttctagtatacttaccaggaaaggaaagagagaaggagggagggaaggagggagacatggagggggcagagggagagagagacaaagacactgacaaagtctggaaaaagacacaaattcagatttaagatcccaaaatatgctacatttctgcccccttcaaaatattaaactttgctaaaatacactggaaattttttttattgtttattttttaaatcaactagcagaccaattagccaagatgatattttcatccttggtactctttcaggtgagctctgtgggctaccaccagaaagtcctagccaaccaagctctcactgggtcactctgtgctagctagactacatagcctcctaaaaaagcacgcagccctgatgctggtcctgccaaagtgtggtttgctgtcatgtcctacaggctacccgtttcccagtgatttatcataataaaccaaatgggaatgaaatacccagaaatatgccataaatctactagtggtgaattttcaatattctgcacaccatggtgatttgttaattcagttggatctctattaaacctctctaaaatgtcattaaaccatctgttttgacttgttaatcaaacaacttttaaaaatgtatttagagtatcagtaacccttgaattaatgcatccatcagtaataatcccctctccaactttagatttatttttaagctctagcttttttccccaccattccaacaaatagcctgacttccaaaagtaagaatcaatcacttcagttgtagaaatgtccagagggtgccctactttcgaaacaggaagtaacttgatccagcagtcccacttcttggtatatatccaaaagaactgaaatctggatcttaaagagatattttcactgcagcatatttgtaatagctaagatacagaggcaacctaaatgtccatcaacagatgaatggacaaaggaaatgtgatatatatatacacacacacacacacacacacacacacacacacacacacacacacacacacacacatatacaatgaaatattattcagccctaaaaaaggaaggaaatcctgtcatttacaacaagttggatggaactggaggacatcatgctaagtggaataaaccagacacagaaggacaaatactgcatgatctcacttacatgtataatccaaaatagtcaaactgatggaagcagaaagtagaatggtagttgccagaggctgggggaagatgggaattggtagatgtggtcaagggttacaaagttttagtcttgcaaaataagttctggaaagctgctgtataacataagtatacaatcaacaatactatattgtatacttagaaatttggtaaaagggtagctgttatattaagtgtccttaccatgaaaggaaaacaaaacaaaaaaacccaaaaagatgggaggaaacttttggaggcaatgaataagtttatggcattgattgtaatggtggttttagggtgtatacctgtctccaaacatcttgcagaataaacatattaaatctaaagtttccttgggaaagaagatgagaaaataattgtcaagagactgtacaccaataaaatagtcaaggagtacaatgaaaacttaggaatcccatttcttcctttgactcacactgtttgatgatatcattcacatcggcatttggaagttattgagacatttcaacataagattgtccttatgatctatgatttgggactctcttataagaaagtccattctataccaatttgttttgttccttggtaactagaccttctttaattggatctaagaattaatattcctatctcataaagaagactaaaaggatccaagtagatggagtttcaaaggtggtccccataaaagcatttttaccttaagcaaagatgtcccaatttttcctgcttgcttttcggatgctgttctaaaaaaaatgtaccttattccttctactaaaagaaaacctatcaattcattgattcattgaacaaatatttattgaacatgtagtatgtactaaacactgggtaagattccagatatgcaaagaggaataagtccctgcccttaagaaaactcacagtgtggtcaagctaacaattctagagcaactgtgtgataagggctccaaaagcacatgcaggaacacagagagaggcactcttagtcttggaggggcttcctacagtgggcaatttttgatgtgtcacaaaaggaggagctattagggcacaagaagagcaagggtgaagtgcagaaaggagtgaatagatggggaggggacccaggcaaagagaataacatcagcaaaggtgcaacttcatgggaacacagtacatttggaagcctgcccaccatttgttacagcagaatgcatgtgtgggtggagatgaggctgcagagatgggctggagaggattatgagagatggatgactagcaaaggaagttggtcatgtccttatgtggtgggggaccatggaaagatttttatttataagacgtggtttattcttcattctgtggcaaaaagcagatactatagtctgaatgtttgtgtccctccccacattcatatgcgatgaaacctcatcaccaatgtgatggtattaggaggtggggcctttgggagataattaggtcatgagagcacagcccttataaggggattagtggcttataaaggaggcccaagagagctgccttgccccttccaccatgtgaggacaaagccagaggcactatctatgacccaggaaatgagccctcacaaaataccaagtctaccgtgccttgaccttggacattctagtctccagaactgtgagaaataaatttatgttgtttataagccacccagctcgtgatttatttatttatttatttatttatttatttatttatttatttagagagagagttttgctctgtcactcgggctggatttcagtgccatgatctcagatcactgcaccctctccttcccaggtgcaagtgattctagtgccttagcctcctgagttgctgggattacaggtgcttgtgaccacatttggctgatttttttgtatttttagtagagattaggtttcatcatgttgcccaggctggtctgaaactcctgacttcaagtgatctgcccacctcggcctcccaaagtgctgggattacaggcatgagccactgtgcctggctatgatattttgttacagcagcttgaatggactaagacagaaggaaaaataggcctttctgtagcgtgagctgaaagacagaaaatagccataggtttctaaagagagaaaaagatatatgtttgacaatatgtttcaattagtactttttttgaaatgcagtaagttacctataccttattccatttctaatctatatgatggcatttaaatattgactaggtttctgatacagtttttggagtctgaatgtcactgcatggatgaataaaccaaacagatcggattcatatgggtttgccaaatgacaaatttttttccatgtaagattagaggaaaaactgatttcacccaatttcctgccttatttatattagaactgaagtcaatgctgttatccctttgcatgttcttttgtatttaaaatctgatatagaattgtgctgttacagaagaaataatttaatgcattctgccctcttatttctcatgagttttcatttaaaagaaaacaaaaaagaaaaaggacatggacttttctttatttctagactttataaactttttagttatcaaataaacacatgtattaattaagtaggtaaaatattgcatatattaaaaggtacttggagactcatatgttgtcagtttttcatgactcaaaatttatgaaaaaccatctaagactatcgtaatgaagttcaattgtagatcttgaagtgacaaaacatgaaccacattgacttgaggtccagggcttaaaactgcctatttgagctctaggttaaaagcatgtgtgaaatgcaaagtctgacatctgcacagctgactattgtgaagtctcagtatcattgttcataagtaaagcttgtccctaagccataccacaagcattcccagaggatatagatttcatttgatttaacatgattgttgatattggtagtgtatttcacgtgaacttgtgaaatcattgtctatacagacaattgagacactaaaacttttttttaagtattttttgttaggggctagatctgaggttttttattcatttgttcttttgttcactcatttgttagttcagttatttactcaaaaatgtatattgagcaattcctatatggcagacactgacagatgctggattcagtgatgagcaaagcattcgtggtttctatgcccaaggatcctatcccgtggagtgtagagtcaagcaaagaatgtcaacaacaaatgaaaattttaatcttattaatgttatatgcaaaaatgtaacacctccaaaaaagacaatttatttcctattaaggaatgaaggcagtccactgaggaagatcaacatgtaagcacatgtaaagcaaaataatcaataggtaatgtagtttttgaaaaagaaggggctttaagcaggaagtcctgggtttggacttgggtttcaaatctagctatgtactcttgggccacatacccaagtcttgtaagtctcagtttcctcctttttaaagttagcctaaaactacctcgctcatctaatggtgtgagaattaggtaaacagccaggtagctcatcaaattgtaattattataattgttattttttgagtcatgaaagttttcacactgaagggaacatttcaacttgacctggaagagtaagtagtttatcaggcagaaagaatttgttagggtattccagagagaaggaacaaaatgtgcaaattcaagtagtcagaatcaaaatggtttcttaaaggaatgacaaacagatcagtgcagttggagcctaaagttatctaaataatccgttagaccttttctttaactgataaaataaagcaagcattccaaaaatcaatttaaatccatcttcctccttatacctctccattccccataccatggaaacacagttttacctcttttacaatgagttgtcagcatgaagagacttggttcattaagattagcaaacttcacagcattgaacaaaagataaagaaaagtttatagcaaatacgttccatgtgaaagcatctccagcaggttcagaagatgcaatgaaaagactaaaacttgatatagggatatttcagtggtgctcgtaccagcgtcctaacattttgttctaccttagtaaaatctatcccttattactcatcctatctgtagactctcttatggaacaagaagcttttttttttttttccctaatcccgtggggaagccctctccttccctgggtgattcctgagcaaccaggaaaacagcagtcacagtcaacacagctagtacttgcagaaaatctctcttctgtgatgctctgaatgactcacagttccagatggccttgtcagcctttatccgcattccactcttggcaccattaacctggtctactgtggttgcaacaaataacttttcttgttatgaggaccagtgttttgaaaaatttaaaatgttataaaattaaaatgtttatatttggaaattatttccaaatataaaaggagcctgtcttcattatagattatttggaaaaaatgcagaggggtgcaaaagaaaaatggaaacaagccatcttttttttacccataattctaccactcagagacaactactgtgaacattttgatgtatttatctccagtctttctagaaggtagatcactgtaagagatttctgaagcagaagtactaagtcagaaggaataaacatttttatacctcttaatgtgtattgccagatagtttttgagaaatattacagcaatttctacttttagaagtactgcttgagagtgatgttacatggtattctcactaacacatatacaatgttataaatatgtccaaaaataaaacttagcaactatgttatctccttgtttcaatttgaacttattacaagagtgatcaatttttaaatttaaatgttatttttagcaaagttatagatgcaaatagtttagagaactaagtagtaccacaaggattaaaaaaagagatctcctgcagtgcatcccccacccacaatacatacatgtatcttccactccccagagggtacccattttcaaatattttagctgattcatttgctatactccactctatctctaaatgatataactttacagttacttcttaatagttcatttttttgggcattgcttattgatacttcatagcggaagataaggatttacctttgcaacacttcacacttctcatcacccatccttctaatatattatagtcttacttagattgatagtcattgtgtttccatgagcagaaccaaagaaaaactataagcagctaaactatgtaacataccctgattacctttttttctttgttttccttcttgaaaattcttgtcttttgttagtttctttgttcccttagatgtccatatatacttatcactaattcaatcccaaacttttcccatattacaaaaatctaagtatggctcaaacacatcaagaattttattaaattcatcttcttgaagaaatctcatccagaggcctctttgacctggattggttattctccatgtctcttgctcagctgtcactttgggatgttctttccttattatcccaagggtaatgtttttagagtttattcccttgttttggtgagcacgttttccagtagcttcctgagtcagtatgcatcagagatacattttttaaaggctcgcacctcagaaataatctttattccatgctcactcttgatcaatagtttggttgagtatagaattcttggttgagaatcactttccttcggaatttaaaaggcatcacttcattcttttctaggtttcaaaacgaatcttcagaagtctgatgcccttttgatttttgatccttctatacgatacgataatgatccttagaacaagtcacaagtctcttttttaatactttatattgtgctaaatgctccaattaatgagttctggaaatttttcttcaattttgtcctcctgcagttttctcttttttctagaatttctgattttagatgttagatttcctgaactggtcctctgatttcccactttttcttctgtattttctacctttttgtatttttgctccatttccatagagatgtcctcaatttacctttcaacccttctattgagtttttaacttattctatcatgtttttactttccaagagctcttttcctattctctgagttgttttttttttttccatagcatctgcttttgtttcgtggaagcaatgttaatatttatgaatacaatatcaagtgtatttcttctcctctctctgatgataccttcttcctgcaacatctgtacttttttatttctcttctttttttttttttttttttttgagatggagtctcactctgtcacccaggctggagtgcagtgggaccatgttggctcactgcaacctccatctcctgggttcaagcaattctcctgcctcagcctcctgagtagctgggattacagttgcctactaccacgcccagctaatttttttatatttttagtagagacggggtttcaccatattggccaggctggtctcgaactcctgacctaaggtaatccccccgccttggcctcccgaagtgttgggattacaggcgtgagccaccgcgcccggccaacatctgtactttgaagttggtctttttccatttgttttggtttctttcacttactttttctaagtatttgataaatcttatctgtctactcatatttaaggctagagtactaaaaatcagattggaagctctgtttgcataggtaagatttgtcaactacatccactttttgatgatccaactgaacagtttcattcagaaataccttgcaccattatctttgggttttttctcttgggttggtgaattctccaaaggttatatcaatctcctgtccagaaggcttaagcatagttggaagctgactaggggaagaaggttgggactttcaaccttcggaattcattcaacaaatatttgagcatctatatttggcagcctctattctagccaccggagacacagtggtaaacagaatttaaaaagccttgtgttatcatgaacacaaatatataagtgtttatttaatccctctgttttcagaatggcactcagtcttcaacctgcctaggccccccttgtctagggacggttttacattcatcaggaagtataccccttgtatacttgtttttcagcttccaaaattttgttgctgttatctcccttcccactttctttgtccttgtcatttatgcctataaacatccattgatggttttctgaaggcagaggagttaaatggatatgttaattactatagatgtaatcagaggtcttcatgttgtttttttgttttctgttttactattctaacttggcatttatagatcttctttgtgagtagtctgaatttgtctttaatgatttaacattgaaacagtattttccttacttatttgcataagctctttctttgttagtgtattagccattgacctgcaatatcttttaggatgaccgattctgaagcctgctgactgagttgcttgtggttcctgtcatttagaatgtatgcaggtcatgaatcgcttagatggaacagatggaatgaaacttgctctaaatattttaccaaaataaatacatttaaataatgtaaagaaaaatcttcaatcactaggctttgaacttataacagaaaggtatctgcttttaactatattaattcaacaaactttattgaacagttggtaagtatgaagcatcatctctctgagaacaaaataccaaggaactgagtcccatccttacaggattctcaggagtaaatgggtcaatacatagttataaaatgatgagggctgatctatagcagaagtacaaagctgagaacaactcacttgacctgctaagctggggaattcaggaagggttcagatctaaagagcagacatttgaggtggttcttgaaatatgagcacaatgatggttttaccaggctgcaaaggtgacaaagtgcattccaggctgataaaagagggcatgcaaaatatggcaggtacaaaaatgtgtatttaaggaagaatgagaagtttctggaagttgctgaagatacagaaaataaagtggggggcggggggggcgggtggttggagatgaggaggagatggtaggcttgattcaaattatggaaatgtatttataatgcaccaacttgtaaagacactgttgttccctacccagcagccactagaatttgttcaggtgtcaggcggttggtgcttcaagggagatcaggcccctcccaggaccaggatgaaccatgattacttcccagccaatttcatagcatttctcttgccaatgaatggcttagatataagcatatgatgaatttgtttctaatacagatctgagaaagaaatctgttaaggaacttctggtaaagtttttatctttcttaaaaagtgacagaagaaaaggaagttgtataaatatacttagagctgctgtagtcatcttgagaccataagaggataaaactgagatcaaaaactactgtgctgaggatgggtgactagaaagaaggaaagaatctggattcttgatgcatgtttgtactactagaatcattctatcactaccttcttattatataattcaataaatctcttattatttaagctattttaaatgaagccttctgttatatgcagcctaaacaaatatactgattcaagctcccagcaaattctgtcacacataattcaaggaacgtttgttaataacttcatactattatatggggaataaatgattagtcaagaaagactttctgttttgaaaaattctggaaagatgataatacagtatgtagatttattgtcatggctaatatacatctacatataacatgaattaccttggagtagtaataaaagggcagagtaataacttgtgcagagccctagactagaaaagttgaaaatataaaatggaggaaaaagtgagttatgagattcagtaatatgaaagtataagaaataaaagaatccaaaagccatagaaggttgaaactgaaaagaattttagaaagcgtctaggccaggtgtggtggctcacacctgtaatcctagcactttgggaggccgaggcaggcagattgcttgaggccaggagttccagaccagcctggccaacatggtgaaacctcatctctactaaaatacgaaaacataactaggcgtggtggtgcatgcctgtaatcccagctacttaggtggctgaggtggaaggattgcttcaacctagggaggcagaggttgtagtgagccaagatcgtaccacttcattccagcctgggtgacagagtgagacactgtttcaaaaaataaaaagagagtctagcctaaaccccttaattatacagattgaaaaccagtcctggagaaattggaagtcctcaaagagtttaccattaatggtggaaccaggacttccacacaatgttctgacttcctttagagcactttttattatatcatatagttccttacttctcactattaatagagattattttactaagagtaagtataataagagctgatcagaagacctgagagacataatggagtttcaattctaatttgctgttggctccttgaaatgctttgttgagaaggagtaaaaagcttacaaaacacacacacacacacacacacacacacacacacacacacacacacacaatttcttaattatgtctaccatgggcatgggatggtaggaatgccatgtaactagtttccatggatggaaaccacctaatgggaaatagagaaaaagaaaaagaaaagaaattgtgtgtaaattttcagctcattttggcttagattacatgatgaaacttatttctttgaaaaactcatttgattttgaattagattatatggaacttctcctttgtcaattttaatttcttgtcttgttttagtttgcttttctgagcagtagatatcctcccaattggagattccgcaaaattagtacttagtcatcttggttcctttcaagtagaaaagtttcttttaaatacttcaaatcattggtatgcacatttgttgcaaaaaaaaacctcattctggaaaatgttgcttattttattatccaaaaaataggtatttattaatatactgcatttcttttaaataaaataaattacagattttcttccagcatccacttatttggaattgggtacatatgaagaaaagacttcttataatatggaattatttcaaaagctattattacttcttataaatataaagcatacaagaaattctcaccattttctaagatttacattagaaagatataagtattgtcttttagaatactgtttttatttttctaaatattccttataacttacttattaattttatcctttctttgttataaatatccattttttttaaagacccatactatcttttcctatgcaatttaacctaacatattttctgtaaatgaggttatttagttatccatttttctacctcctgttgcttggcagtcctcaaaaccattgcagatctttctagagagcagtttttaagaacagtgctttacttttcaactcttgatcaacctgatgagaattctttgaataaaccagaaggaaggctaaagagacaaaagaatactatagtttccttaaagttaatgagccagaatcctttggcccactttggcattgaacaatgtgaataaaatggccactctcacatcagtaatttacattttatacagtgtgtactttacactgatatttacaaagaggaaaaacaacagttttttacatgtaagaggagctccttggcagataaaagaaaaacttactcccattagtacaacactggagtttaaatctagagaacaagtacttcagaacctagtagaaaaagtccctgatttgtactttgtatgaacaattaggtttgagaatattgctatataatcacagaaaatactggctattatactacgtgaagtcttcagtgacaaagagagaaacagaaaaaatagttaatgccataacaatgaaaatgtggaatgtgaggaacgcccagtgaccgtaaatatctaccttaataagcctgacaatttgtatacagttcatgcaattaacaagtgtgataaatatgattattactctcaagttgaaatcaattttcttggctaaaagcaaagaattgttattgagcagatgggattacttttctttgccaatttatcttcataaaactcaatcaatgccttgccttaaaaatgtcaaataactcagatttcaggataacacatacaaactaatctcttctgcctgtctctacctgatcactccctacttcaaaagctccaacaacatagtataactgacacaaatcaaagcaaaaactatttttctcactgctacatggtcttatcaataatccagtatttcaatatctaataaaagataccacaattcaaagcagtaatgtgccccaagctaccgatccacaacatatatattgatatctaaaaatatatggatataacttgttatctactaaataagtttctttgcagtgtggtgttaatagccagaattttaaatacataaaaacttgggttcaaatcctaactctgccacttaaatgctatatgacaattggtcaagttacttaacctctctctggtctcaagtttcttgtctgtaaagctgtaatagcttttagagtgctcttctgaatattaaaaaggcattatactcttagcataatgtctacatagagtaaatatttaacaacaaaataacaaatattaggtgtgttattggagaattggagttttaaataaaggagttgtccctaaggtacattcaatttaactatgatatttaaaacttcaatttttcacattatttttccaggaaaatatttcactcttatttctccataatttgttttgaattgtaaaagagatttgcaagcggctgaagcagttacactatactgtatatctgcaggatgggcaactgattttttttttcttcttttttttttttttttgagacagagtctcactctgttgcccagactggagtgcagtggtgcgatctcgctgcaacctctgcctctcaggttctagggattctctgcatcagccccctgagtagctgggactgcaggcacacgccaccacgcctggctaatttttgtattgattttcaagatttgtcaagagctcctaatattttcttttctcaaacacatcttaggactaccatgcatatcagtcagtcagctactctggaggtctgctgcaaggatacacaccttccattcccacccatcagatacttgtctcctttctcccccactccaagacagcaaccttccagctctagataaaaagagctagtctttcttgcataagaacaacaaagacaaaaaccattttggtagtgtatactgcagattttaaccaaaacttctctgaagacctctgatttcctaaaaaacctcttcatcccagtgcagttgctctttcctaaatgagcaaccgcgcatctggtcaaatttggtgaatattctgtgctccagaaacaactgattccatcccctttaatctcttcttctcttatatccatctccctccttgttgtttctctccatgtttacaactagttcattgatttaaaaaccaatgtaatacacaaggaagtatgcacgacaatgtttagtgtagtatggtttgcaatattaaaaaaggccatcagtaagaaaatagttaaaggataaacttgatatacatactatgctgcaatttaagaaaactggtatagatttatacgtactaaaataaaataatctccaaaacatagtaagtgcaaagatcaatcacagaataacatctgtagtatatcacttttgatttttaaaaattacccctaattctaaatgttcatatatataaatattcagttaaaaattctgaaaagatactgctatggtttgaatgtttgttccatccaaaactcaggctgaagtttaattgccattgtaacagtattaagaggtaggactcttttttttttttttttggtgacagggtctcacttcaacacccaggttagagtgcagtggcatgatcatagctcactgtggcctcagcttcccaagctcaggtgattctcccacctcagcttccagagtagctggaactacaggcacatgccaccatgcccagctattttgttgtatttttttgtattgatagggtttcttcatgttgctcaggcaggttggtctcgaactccttacctcaagtgatccacccacctcagcctcccaaagtgctgagattacaggtgtgagccaccacatccagcaagagttgggacttctaagaggtgttaggtcatgtgagctttgccctgatgtaagggttaatcctgttatcactggagcaggtttgttataaaagagtgagacgtttggtcccctttcctctctctctcccaatctgtctatctctctcccttttgctttctgccatgtggtgatgcaacaaaaggacccttaacagatgccagcaccttgattttagatttcccagcctccagaactgtgagccaataaatttcagctcatgataaattacctagtctcaagtattctgttagagcagcacaaaatggattaaggcagatatacaccatattgtatccatcactaagtggatactttcaagaaagacagcaagactaaggagcatgaaaaaggactttctcatattctgaattttaaaaatattttatgacatgaatatatttatctattacctatgtaataaaactagacattaagagaaaaatctcatggtagaaatcttaggaaatagagaaaaattagagaaaattaagaaaaagcatgcataatttcacaaaccaatggtagccactgtaaaaaaatgttatttcattctaatacatttctacacacatatgcacacagtgcatttttgaaaacataactgagtcttttctaattgacctcttactctacaaaatttgaaatagccaaaacaaatttttgattcctataaagagatagcactagagctggaagagatggctcatgcctgtaatccctacactttgcatgactgaggccagagaattgcttgaggccaggagtttgagaccagcctgggcaacatagcaggacccatctctacaaaattaataataataataataataataataagctgggcataatggtgtgtgcctattgtccttgctacccagaggctgaggcaggaggactggttgagccctggaagttcaaggctgcagtaagctatgattgcattacactctacccagtgtcaaggaaaggaaaggaaaggaggggagaggaggggagaggagaggagaggagaggagaggagaggagaaggggaatgggcaggggcaggggcaaggcaaggaaaggggcaggggcagaggcaagggaaggggaaagggcactaggacctatgagccaacataggctatggcttccactagtacaacttaaaactcagctgaagacatgacacatagaaaagggttgctgtgtctgtacacacacacgtttcccatgttcccaatcccagtctgtggtcagtgaaagtgaagattgcctcagagcctgcattatctcaagctactgacctaattgctaatgctttactctggtctatttcctgcatgacctcagaatgtgtcagtgtaaattccatagtaagacagtagttgcacattttggagtgtggattctgctttgaaacacaaataagtgtgatgaacgtgaccctggcactctgtagccctcagtttcctcaacgctaaattgatcactacagttccttctagtgtaaacagtcccacgaagaatcgtgctgaatggatgactacataatggcctgctcctagagttcttaaatcaatccttaaaactggctgcaaaatgacttcactcctttaacagtgtgggacttgtctctgttctccagaatgctcaccagatggtgaagaagtatctctctacctaccaacatcgtcatattgcttcttgccactcgctactcaaaaactgtgaaaaacctgtgggagcaagtatcagctgaaaagggtggctttctccttaggcaaaagctacagggcaaaacgggggccccaaacttctatcacgtcaaagacatgaaacagatgatccctagttttgatcttctttgaagtttattaaaaacaagcttgaatctgtaccaatcctgacaggtgtgaatgtaagactcacaaatgagaaatgctaagctttcctaatgttcaatttaatcttatagaccatgaaacatgttataattaaagatctgaactattaatatgaaggagatagcatatattcttaccccaaatatgactaactaggtaaaatcttcaaaatataatcatggcctgattatcagccattgtggaggagaattttaaaaagttcttcattgacatcccaagtttatgttttagacacttctaatcaaacatgaatagattaacttcaagtaaaaattaatagtcacattattgattatcatgattggaaatgtatttgaccagaacaatgaggaaagagcatagagtcctgctatcttcaagtatgaatttacacttttaactgatgtcaagtcatccatagtatgaaaactcatttatttttatttgaaaaatttaaaaccatcaaaatggatagtgtgggagccaaataatatataagcaatattttatgagaactacaaaactattaagagcagtaactagaattcggttactgccgttccttatttcagaagagaaagtcaaatgttttctgatatttaagaagtaataacttcctgttgttcagttatgctttctataattatatatgataagcaacagaaaaataggtctggttttggctgtaatgtgtatattcaattcaatattaatttggactttaaatcattttgctatcaaatattttgaacctcatgaccaggaagtaatcaggtaaaaaaaaaaaagaaaaaaagtgggtttgttacctgacctatctcttaagttcaaactttctataggtatttttctctacctttgtccatatggttatacaattatcactagatgcttgaattactaaatggttttgtatatcttttcctcaaatttatatttgtcctattattggcttagtctctcaaagtattacttttatgatattgctataatggtcctctatagtataaagttgagcccacaccatttatcctgccacttaacaatgtccttaatgtagattatatggtttggccatgccctaaccaaaatctcatcttgaattgtaatccccataatccccatgtgttgcgggagggactgggtgaagataattgaatcatagggcagtttcccccatgctgttctcatgataatgaatgagtttcacaagatctgatggttatataagcttctggaattttccctgctggtgcttactctctcctgctgccctgtaaagaggtgcattctgccatgattataagtttcctgaggtctccccagccatgcagaactgtgagtcaattaaacctcttttctttataaattacccagtctagggtatttcttcacagcagcatgagaatggcctaatacagtagtatatcacacttattaaagagttgatagtaaaatagcactctcagtacaataagaatagaatagttccttttcatggtaatgaatagcttttcttcgacatctataattaacaatgaaatcagaaacaaaaagaagctgtctccactattactgaatgttgctcagaaaattctaacgtaagcaaccaaacaagaaaaccaaatatgctgtacaaatatttttaagagagaaggaaatcattctattttaagataaaaattctgtaactcaaaattcaggagaatcaactgaaaggtataaaaaaggtagaccattatgatttataagaaaggtcaaacattataaagcatgtatccacaacaggtttttttctatataccagttagaaaatagataaatgatcctattcataatagtaataaaacatatcaaatatgtataaataaacaacgaaaaatgtaaaactcttgtataaatattattgcaaaacatcactgaaggacatttttaaaaacttgaagaatatatctagtttcctacatgggaagagtcaatattataaagatatcaagtcttagattaatctatgagttaaatgcagttacttttgccctaaaatgttaaaaggctcttaattatgcaattcgaaatgtgatgtctactttcttcttgaaagcatttttcctggaaccttctgatgactctaacttaggctgcctgctttctaggcctactactacacagttgtcatactgggatttattttcataaacatctgggttggttccaatgctctttgtatcctaggttttctgtataggattcccgttgctttgttttgcttgaatatatcttcgagtaatacttccttttaattaggaagaatctgtaggaggtaaagttgtaaacttgagtccttccatgtttaaatacatctttagtttgtcttaacacttgatagtttgactatcaattttgggttctagttcttcttcctgagaactttgaaaccttgcctagtctgcattcacttctaatcttgctgatgagaagtttgatacctttgaaagatcctttttttttgttctctggaaggattaatttcttatacttagaattccaaaattttcatcagcatgtgtatacacatctagatatgtatccttttttccttgttcggtgttggatgaaacttttcaatctgaggacttgaattactcttcaggtcaaggattttttttctgttattttcccacatcctttcccattcctccacttctaccacattcttcatatcttttttacttttccatcatattttatatccttggctttttgctctatattctaagatatttgcttaattcaatattcaagaatgaatattacttgaattgcattttatccaatctttatatatacatatatattcagtattctgctatttatggaaatcagatcatacttaatggttatattctccccctgaatatctctgaaaatttaatattgacaaatttttcccacacttttcattgtctctgtttcttctggaaagcagaagataaattgtctcaggaaaataaatttgtcctgtttatttattagttcctttttgtttaggctactggtttttttgtttggtttggttttttgtcttttttcaaatgtctggtgatcctttcttgactgggaatatttgtaatttaagaactaggagtttcttaagtagttggcagggatatcataaggagctctgtagtacttataaactgcttataagcaacttaatgcaatttcaatcaaaatcttaatgggtttttttgggggggacttgacaagtagattgtttgtataatttagcacaacgatgtgagaataacccaggaaattctaaaaaataagattaagagggaatatgttctcccagatattaaaatgtatttcttaaaatccataataattataacatggggctttttgtctagaaataggatgtaaagattaaaaaaggaactaaccataaacagtagaagtggcatttcaagccaataaggaaataatagattatgtaatacctaggattctgacaatttagaaaatctaggaaaagaacatcagagccctgaaataaagtaaaataaattccataattattagagatataaatatatgatgtaaaatgattaaatactagaagaaaatattggtgttggaaaagaattgctaaggatttataaaatatatttatatagagactatataaacaatataaacatacaggctacatagggactatttaaacttctatttattaaaatagagtatctgtaaaagtaaaaatagaaatgaataaatggcaaaaaagtgtaaaaaacaaacataaatgaaaagttaatattcttaatctctaaagaacactctaaaatcaataagaggccaggggtggtggctcacacctgtaatcccagcacttcgagaggcagaggcagtcagatcacttgagtccaggagtttgagaccagcctgggcaacaaagtgagacacctgtctcctaaaaaataaataaaaataaaatcaacaagaaaaaacaaatcagcccacgaataaataataaaataataaaaagcaaatatgtataattgccattagacacacaaaacagattttaatattcttgaagctaaattaattcttattaaaacaaaatactatgtgattcatcaaataaagagaacaattaaaatgataaaatatagcaacggaaataatgtagaaatagagactgctgatgaagtatatataaactttctgcagggcaatatgacaataatagcaaaaataaatctttaaaatattgggcaattctttagtttgacaattctaattctagaaatatatagtaagaaaacaacccagccttgctataaagactctacacaaagatattcatcacaatagtgcttataatgtgaaatctggggagagcttcaaatatttaataatagaaaattgcttaagtgtagtatattcatgtaaggaaatgccattaaaatgttatatagagaattgtatttaatggtaagaaaagtgttcatgatgcaatatactgtgaaattttaaaagcagattataaaatattaccttcagtataatctcattgttgttagtaaaactccttctctctctacatacacactctcacacacagagacagaaaaattatctctcaatggcataattattgacagttcgttttctcccccttgcttattattattttgtaatagatatgctatagccactcaataaatatttgttactaatttcaaaaagtatgtattattatatccaggttgttcatggaatttatcatgcaaacaactaccctcttgagagagtcaaaagtggacactataaattatgaattcatataaactatatcaggacaatgggcataaactgagtgtcccaggcacggcaaaatgtgcggataccctggagatgtatcttgactttaagaagtttacaatctttcttggggatagaagattaaaaaacatgaaaccattagaaataatctcccacaattagttttgtaaaagcaagtgcttaattgtacttgacaaacattagatgttactggaggtctaagaagtaagagctgaatactcgtcagaaaagctccctggaggaagtggggactgagtgatacttttagaataggtaagaaaaagaataatgagaacttttcaaatggaggttggggttgtagaaggaaaagaatcaagtattcagaggtagctgataacgatgttgtatatataaaatcaccctgacttttgcaaggggtccgtctatacagaagagtaaaaagtaaacaatctattaacaatgtactatcactgcctccactttacacaggagaaaatcgaggctttagaaggttacataacctgccaagggtcacatagctaaaagtggagagctgagatttgaacctaaggagttggtttcagagtctatgctttccaccctatgctgtactgcccactacagtcaagctctggcttcttgtataaatctgatgtcactctttgtgggactgcttataacatttcctcacccagaatccatacctcctcctttctgctctgtcagagctctttgtctattcacacacagttcaaagaataccttctccatcaaatttttctaacaattccaatcttggaattctctcctaccttggagttgagaacaccactctcctaaatttctgcctacttctcagccactacttctcaatctctttgttggattcttctttctctatatttttgtttttttagtctactcattgcctgtgtgagtaccttcacccccaaaactacaatacctacctaccattgtgctgaaaaccccagcttacattgctcttccacattccataaatttctatctggatgtgcacagacacctcaaacttcatatttccaatactggcatttaccctatctgcagtttttactatcttatggacagcagatgccagaaatctaatcactgaaaccagaaacccatgtacaattcttgagtcctccctctctcaagcctaaaatcctggaagtcaccaagttctgtctattttactctataaataactattagattcttctttcatctgaactcccttagttcaagccctctttgtttctcatatgattattgtagtaggctctgaactggttttcctggtacctgtctttcccctgcctactccaattctacctccacatcaacatttctcaaatttgaggggtcatagacttccaaggacatttccacaatccctgagaagtatacagtttccatatgagaaatcactgtagctaaaagttaaatacttttcttcagttgattatgtatagctaaggcaataattcaagcattagtaaatacaaagccaaaatgcaggcacattacgcagaaaatgcctgttcttgggtttttaaaaaatacgttaaaaaaataaggccagatgtggtgactcccacctgtcatcccagcactttgggaggctgaggtgggatgattgcttgagaccaggagttcgagaccagccaagaaaacatagggagaccttgtctctacaaaaatttttaaaaattagccaggcacagtggtgcgtgcttatagtcccagctacttgggaggctgaggcaggaggatcgtttgagcctgggaggtcaaggctgcaatgagccatgattgccactgctctccagcctgggtgacagagcaagaccctatctcaataaataaataagaccacaaaggaaaaaaattcttacagagaattattgaagtataaattgtgtcaaaattgaagaatataataaaccctaagattaatagtcctgtccttgagaaagatcatcaagtgatgcccccatgctttaaaaaatattccaagctttttagcataatatctaacatttcttagcagttcctaataggttacttctctgtagttacctctctcactccttccccatcacctatagtgccacaatctgtaacctgtttgaggctctctcacacctttcatactgcaatatttgctcgaactattgacccccaaccttactcatctttcctttctaactaactaacttctcctcatcctcaaagccccagctcaagaattttcatttctggaagaatctctgattttcttctcttctctagtcttgaaatggtatgtgtgaacccacagcttgttgtaatgtcattgtcctttctgtttaacaccctcagttgctggtccttgaagtctgggactgtcttaatctactttaaagtcttcaagccaagtacaattcctaggcatgcaatacatgtttgttaaatagatggatgacctttatttatatttatctttcccttttctgctacaattagttaactcattcatttcttcattcactaataaccacttatctgttattttctgggaatacaaaaattcataaaacatcatccttgcctccaaaaaacactttattattgtgccatccttctctctctttctctttctctccttctctaattatctagttgtgtaggtattttcttcaaaggaataacaggtactcagaggaacacttatacactgttgatgggagtgtaaattagttcaaccattgtggaagacagtgtggcaattcctcaaagacctaaaaacagaactagcattcaacccagcaatctcatttctgggtatatgcccaaaggaatataaatcattctattataaagacacatgcatgtgtatgttcattacagcagcattaacaatagcaaagacatagaatcaacctaaatgcccaacagtagtagacaggataaagcaaatgtggtacataaacaccatggaatactatgaagccataaaaaagaatgagatagtgtcctttccaggaacactgatggagctggaggccaatatccttagcaaactaacacaggaactgcatgttctcacttgtaagtgggagctaaatgatgacaactcatggacacatagagggaaacaacagacactgtgacctatcagagggtggagggtgggaggagtgagaggatcaggaaaatcaactaatgggtattaggtgtaatatgtgggtgatgaaataatctgtactacaaaccccatgacacaagtttacctatgtaacaaatctgtacatgtacccctgaacttaaaagttaaaaagaaataaaaaataaacagaatagtagggattcattacaatatcttctctcctcctcataattcttaaacctgtgtagaagttcaatacatatttgtggaatagccttattacgcctttagggaatggagcaatgccttgcctattaatctatacttctatcagagtttcctgctgtatggaaaacctgagtgttacacttcaaacaaatgaggcaatttatacatttttgttgttgttgttgttgttgtttttggcataaatgtgctaagtgagctggagtttcagaagagaaactgaatgttatatgtgaatccaggtcagtagcttggctctgactacaatactgatttcattcaagataaggaaactaattggtatcaattttagttgacattatatgttagttttataatattcaggaatttttgaaggattatttgatttttatttttatagatgttcttgctctttaacactaaataatgaggaaagataatagggctaacatttattaagcatttatgttggacaggcactgctttaagtatttttatatgtatcaactcattgaattttcacaactcttagatctatttgatagctggggaaactgaggcacagagaacctcaagtaacttgcccaaggtaagccagctagttagcatggaccagtgattcaaaaacaggcagtctgtactccttacaactgtattatgctgcctataaaaggaccactagactaataattatgaaaccagatttttaatcttaaattagccatataatagtagagtgcatttaaggatgtcatctgagtttcattgtccttgtaccccttacagcctgtgagaaggaacctttatatagtctttcataaactgtaaagtgttataaattcaaagatttcttataatatgttaaaattacttttaagagttgagaagtccaaataaaagcagagagatgagaggaaacactagcactaaatgttcagacacccactgaccacgtcaagctgcacattttgttgctaaacctaagggagagattagatatgaggagagtgggaagcaagaaggtatgaagtctgggtatttagggactaatagaaatgattttctcgattagtttaagaacattagcaattacttacgggataagcacagttaaaggaatttctggaaggaataaaactataaaaattagtcaaattgttaaaatatcagaactgtgtaaaagcatataaagtttcatcatatctttcttttgaaaaacaaacaaacacttcatgttctagccagttgctaatagtgatcagttgatgaatacacctcatgtttcacgcatataaaattttacaccatgtctagtccataggcattagtgtaggagtcagaatacaacctgaattctgttcgcagctttgtgccttgtcgataaagcagtggacatctctccacagggagatatgtttcctcccgtgatatagaggatgttgattcacttgtctcctctctatttcgaaaagatgctctgaagattagtgagacaatggctgtaaagctctttgcactgtttacaacataaatcatacacagacatactggcatgagaaacgctatcatcatctcttttatacatgagaacaaccataaggaaaacaaacctcagagacagtcctgtattataaaaatgttgggtagagatgccaaaagttgtagggtaggaaacagcaacaacaacaacaagacggaatccaaagaatatttgcattctataatatattctacagagtctcagacgggaccttcgttgagtgctcccaagtattatcagtagccatgttttttttttctttttcttttttttttttttttttttggtaaaagggataaatagtgatgtcaggagatgctgcaaaatatattccagtgataagcatatggcaagcaattaatggatgaattcgcctctcttattgccatgttgtgacaaatactctaacttatttggcctttggctccctaaagggtgctcagaaatgctgtttagaaagtacttttcatgaagagctacaacaacaacaaaaacaaatacaattcaaatatctactaaacatatgaaggagtactcactctcattagtaatcagagaaatgcaatgatcccattatagagccctgtcatttgaaaaaaaagaaagaaaatccaagtgttttttattagaacgtggagcaacaggaattctcattaccttctcaaccactttgtcaaatgctttctgcttatctgctgaagttaaagatatgcatgacccatgaatccactcctaggtatattcccccacaaaaatgtacgcttatgtgcatcaagatacacgcacataagtgttcgaaatatctttattcataatatttccaaactggatatgttcaactgcataaagaaagaagattggacagtaaattgtggttcctttatacaacagaatgctatatatcatgatatatattatgatgtgcaatcctcagctacatacaacattgatgaattttacaactataatattgcacaaaaggagcaaaacacaggagtatctacaagatgagtccatttacataaaatgcaaaacaaactaaattgaactgttgttttggcatgcatacatacgtggtaaatcataaagaaaagtaggaaaagtaaaagtaaagtcaagatagtggtgacctatctggagaggatgaaacaggaaattatagggtctttctgaggggtgatcatagtaggtatttactttagaacaatttgttaaacttaaaatttaaattttacatactttcttaaattttgttatatttcacaatttaaaaatttataaaatgataattttacaaagcctaaaagatgaattatttgggggcttttacttctctttcatctgtacaactgctgatgaaaatcaccaggtgtgtataacatgaagcatctccttaaatgacatgcatttattgggaaaaaacacaaagtccaaatggtaaaatgttagcaaggtaaaacactgaagatttttctccccaaaactgccaaacaagtctggtttaactgaaattgacagcaaagacaacagagcacacttaattgaattttaatctcagtgatctctaagccatgtttgaaacataaacagacatgtcagagttctttatgatgttggacatgaattcattttcataattcaaaggcatactttgcttatgaatctctttaacaagctttggctgaatattcttttcttccagatgtttgctgttgtatacacacagcttccatctctttgcagatgatttaaaacatagttagaaagagtacatttatttaacaaaagagtaagagtacagaattcaaatagatcgtctgtgggtgtatataatgatgagtacataagtctcatgcagtcctcataaagacagcatctattaatctgaagaagtttctcttactaatttgcaaacctaaaagcattttacattactaagatattaataaataggtcaattaatacttttgatagagtagagagactcctaaataatggacatgaaaaatgattttgtaaaagtacggtttcattttaaatccctgcttaagcaatttgtaggaggcaagatagtgtggcagttgagaggatggtctctgaaatcagatctgaatttgaataccacctctaccatttactaacctaaacaagtcatattacttctctgtgtctcaatagctacttcctgaggtgttcttacaaaaacacaaataaataatccatgtaaagaactttgcacagtgcaaatacatagtgagcacgcattgagttttatttatcatcatcatcatcttgctgtacttttgtaaactcaccttctcccgtctttttctactctaaggtgctcttccaagctactttcctcctcagctatcgttcccctggatttccagtaagagagggtgaaatcatgcctgcttatcttctttctcttttactgatacttcactgaagtgaaagtaaaggaataaaaacacaacacacccacccacaaaggcacaaataataaaggaaacaagatcagcaaaggagagatttctactgattttttgaaatcagaaaatagctgaagtgccttagcataatcgaggaaatggttacggagagtaaattccaagagaaagtggactaatgtgttctcccgaatccagaaagacttactgcttggaggcagcagaattaaggaaggcaggagtttagcgaggggctgaaagtgtattaaaattatatggagcctttggatccaaactaactacttcccttacctactggaagcggagtctttcttttttggaggaaatcggctagagagatttgaaactgatgatactaggcactgtagcaaactaggagaggctgcaggttgcgaaataggtgcttatttgaaagcctatagagtttgcaataagaaacccaacttttttatttgtcatgctccccagacattagcagtcagttatatgccccaggcgcaaatctcgcaggcagaaagtggggtaccccctaatcatgaccttggggaaacatttcaaagaacacaccggctttgattgaacaacctatgatgcaacagtgcaaccctacagttgacgagccctatccatgatcacagaacttctgacattgtttcttgccatcattgtcattgttgctttgttttgtgtgtgtgtgcatatgcacctgtatatgtcttgcttttaactaagaatgaacagcctcttaaggaaactctccataatgaagaagagaaactagaagaagcaaacatcaactgaagaaagaaatctacaggaaagagagagacagaggaaaacctcaagaggataataatctgtgaccttagataaaacacacttctgacataagaacatataccattaaaaaggagaggatgaggctgggcatgttggctcatgcctgtaatcccagcactttgggaggctgaggtgggcggatcatgaggtcaagagatcgagatcaccctggccaacatggtgaaaccccatctctactaaaaatacaaaaattagctgggtgtggtggcatgctcctgtagtcccagttactcgggaggctgaggcaggagaattgcttgaacctgggaggcagaggttgcagtgagccaagattatgccactgcactccagcctggtgacagagcaagactccgtctcaaaaaaaaaaaaaaaaaaaaaaaaaaaaaggagagaatgagagtgctaaattatttttaaatcatgaccaaaataaacattttaatagtaaggttggaaaataaaaatgtgtgtgaacaaatcttctagaagaccaaaaaacaaaaagacaaaaaaggaagaaaacaattaagaaattaaaggatatgatctaggagatccaactaagataatgagaattcaaggaagaaagaacagagaaaatagagggcataaaattatcaatgaataagagcaaacatttcagaactgaaggactcatatctctggagtgaaaaggtctattgcgtgcccagggcaatggataaaaatgcagaccaagacaattgatcatgaaatgtgggaacttcagtaaagaaaagaaggtcacaaaaatttctacacagaaaaagatcaggatttcaccaatagaaaatactggagtgatgcctacaaaatgttcaaaaaaatacatttttaacatagaatccaattgcagttaatccatgcctgagacaaaaaaaggtttaaacaaagggctgcctctgaatagtatatagaaaagatttctgaacagaaaatcttaaaaactagcttttatccccaacttggatactaaatatagagacaggcaagaattaggggtcttcttgtcattcttctgagactctggagctcctgagacttctttttcactaacaccattgaatccgggaatcaacaagctgcacaaagttataaagattgccagacttcatgtttctggaaaaaaaaaagtactattttttcatacagctgagacctctgaaaagatggctcaatgggcaagatgccatgagaaatcaaagccaaatactcattctgaagtcagttttgctcagactttgtatactgccactcaatttttcaagtcatcagaaacataactaagaatgagtgactttttgctatcaactaatgacccaccattcaacgatcttgtatgacaaagtagaggagtatcttcttatttttaggcttattaaattacaatggaaaatattcattaacaatctcataatgaggcattctagatgcttattcttacctaaagggaatggaacaaaaaataaccaaaaactaaaaagatgaagacaaaagcctttcttggtattatagtattcttttacaaaggatatggtttatcatagtaattgattccctctgttacactagagatactattatattaaatgcctaaaggttaaacttaggtaacagtggagctatagttctttcagaaataaaataattaaatagctatgtatgccaagaaaccttactttgaacatttctattgtaccatctcattattgctggctgcctgattagcaagcagtaaacttgggtaatagctttcctctgatatcacttcaagtctactcgagttctagaattacccagactaccaggactttacttgcacaatatgctgaaatgtttataacattatgctttcccctcctaattctcaagaccattttgataactggctaagactggataatatcaacaaatatgaaataattataagaatcattctttcttaaaataagaagagtttccagaaacagaaactaaaacagaattcaggctaagctgctaaataggctatctcagggattctcagctcattcttgatgaggatagattgctttttatttcccttaagtgttccgtatttatttcacaaatattacttaactgtgtaccatgtacaaagccgtgtgctagttaagctggttactgtggaagaaataaagggagtgggagcatctagcttttttcttcaaaggagatgggggaatctgtgggagttagtggtaggggcacctacagaggaaatagctgaaaaggaggagctggggaagatgaggatgaggaactaagttgtgaataaaggaagggcagagcaatggtttttttaataatattggaatgggatttgtttttagcactgctcccctttcccttaacagtccccttgagctacaaataaatgtaactggcaaagtggataataagacttcagaatcttctagctaaccatgatcaatgtgtcatggagcccagtatacaaggagaggttctatttcatcaagaaatatgactgcacttttagtgggcaattggttgttatgaaggtccagcatttatttcttcttccttttgaaaaataacaccctgatttcctttggggaacatccccatggtcagatgggaccactgtgattgactgattggttcaggagaggggctatacccttaattatgtgggagctactagaaagagatgctctctttttttgttggacataaaaaacctggaaaggtatggcactagattgcagacattggtctgtctcatgtggatagagcagagaatgaagccaaaaatggagagttcttctgatatcaggcatcagggagaaaacaaaacaaaaaacaaacaaaagaataaaaatggagagttcagatacaggacccatagacagagaaactaaatcctcatgaagtgttctaattgaaacagtatctatggtctacctaaacctcatgggaaccacattaaatggcggataaagccattaatatactatacatagaagagatacatccacaaggacatcttaccaagtgtggacacaagtgtgtaacaaccacttattggtgtataatattataatccacaacatcagattttactctttaaattcactagggagtattctcaaaggaatggaagaaacaaagctggctatcagtgaggggcattatgtgggtaaatataagtagaaacttcaaaataaatttcttaaaagcaattttcactttctgaaagtttatatggaattggcaaatgacaaggattgtgatcattgatacatgcaagtcaacaagcaaaactaaccaaagagacaaacagacacatgaataatgaggcagttctgatgaccaaaaaacacaactttacaagactgtttgggtaatttattttgactggtaatacatcatgtcagtttattttatttaagccacagcaacgtttgtcttcctgacgatagttattgcattccagagaagtacaatacgaagtttcagactagtgctgggcttagtcacacagagaactgcagtaggttttctaagcccctgctcactgtatttcacaaaaatctcatcccttctaccctccactctctaaacacacatccaagcaaatcacaccaaggcataatcattgaagaacaccataacttgccaattaaaatttggcaaacagaaacattgaagcaaaactgaaaaaagaatcatgtaattaacttagaagaaagcttttttcttaaatattatttttcttcccattcagcatgcacaagaagcaaactttgagcactaacgtgttcctttttagcctttgcctgtttgtttcaaagacaagaggagaagagtctgcttaaaagccaaatacactgataaatgtttactgataaaatcttccagatgggactactttcaaggaaggtcaattacaagccttgtgtctctccttttaatgatatcctttaatgatccccttcctctcctagaaaattaagtcacaaaaacatcttaggctgagagtgacccagtaatcctcataatcacattgcaatgacagacaagaagatcaaagtacaggtgcagtgagaaatagggttttacatcctattataaaatgtgaacttgccattaaccaaagatcaaatgtacctttaactcccaaattcccaacttccaatattttttaaattctgtggttttctggattaataaactttctctaatataatattccccctcccaatttttgtactaaacattggtggttttttcttcacatatggtgattatgttttcatatatccaataactaaataattttagaaatttggtaaattgtgttgaaactctaatagcactaagaagttcccaagctagttggtaagctattgtctccaatactgcaaagagaaaacctagcaatggaaattacataaagataatctgatgctaatatgttagttagaaagtgaattaggcatctagtaatggcttcaataagaaagaggtttatttttatctcatattaagaaaatgtagcctgggcatgttggctcatgcctttaatcccagcactttgggaagccaaggcaagaggatcacttgagtacatgagtttgagaccagcctgggtaacatagtgagacctcatctctacaaaaaattaaaaaaaaaaaaattgctgggtatggtggcatgcacctgtggttccagctactcgtgaggctgaagtgggagaattgcttgagtgcaggaggctaaggctgcagtaagccctgatcacaccactacactccagcctgggtgacagagaaagactcaaaaaaaaaaaaaaaaaaaagaggaaaggaaaaagaaaagtaaagaaaataatctagaaacaggtcaaggttggaatggtgacaccatgtttatcagggacctaggttcctattatctttctgatccaccatccgtaacacatggcttccattctcaattctgccatttaggttacaagatggctactgatgctccagccagcaccagcaccaaatcactactacacaaacgggaggaggagtaaaagtgagtgcttctaggcaggagctccctctgctaacatgtagttggctgcatcaatctcttagaaagcctgagaaatgcaatcttttgactaggcagatgtcacccaatataattaagattcagtcagtcatctttattatattggttactaaatgaacaaatctgtaaggatattcagtcagcaccagcagtctttgtcacaccatagaatttctcaatcctggatggaatttggtctaatcccttacttacagaaagggaaatggagagcagaaagattaagaaatttcccccaaaggacacaactggttagccaaagaactaggtgcagaattcagatccttgatctatcagtaaagatccggttctttactggagcaaacttcagtgaggtcagcccaggaaattcagctaaccaacatgaacaaataacacatcttactacctgggtcagaccctgtgactcacacttcaggctttacagtcataactgctcatatgctgtaacatccaccctctttggttataaagtgagaatcaccatattcaccacaagtcatgtacatgtttacatggccactaaataaccaacaaaatgagagatgcgccgcaaaatgtgacagtacgagttactgtttgtaaaagagcagaatgttccacactcatgggtaaaaattggtacttgaacttcatgagtgactctagatcttttatggtggtggctttttaaatacagacaaacacatgattatggtatctcctgaaactgacattctcaaaataacatccactattatacaaaggaagtttgaatgttttgaggcttttttgcttttaagccattgctcttacctcttatctcttcttcgattatggccatcacttacttcctcagactccacccagctgcattctcaacaaaccacagtccaggatgagaacttctataatgcatatgcttccttcagcactttgagatacattattaggccctgctctcatgttttacttcttttatgttccaagcttcttgagggcagggccaatactttctttattttccataacacccctcatatgaaaaagattctagcattctttcacaatgtcatgcttagaacattccaatatttttccaacctatctcccaaactgcttcccatggttccactgattctcttctttcacccctactcacaacacagggtacccgagtgattgctccaaaatacagaacacagcaagccacatttctacatctttggcggtgcgccactgtctataaactttttaataaggtcgccctaacttgctttctcacatagtcttattccttgccatttcctctgtttgcgccctacatactgtaagttactccgaaacattcatctttttctacatgcctgtgactttgtacatgtagttccctttgtctgaaatgccctttcttctttcgtttatggagattccaaatggtctccaaggtatatgtcaattattatccatgaaaggttttgctatatatatccagtattttctgggggatggggaagcttaaacaaaaaaaacttgaacattactctacacacagtccattatgacatcttagtctatttggaaaactccactcgtgtagaaattgtgtttatttcagttgactgtgaatacaggttctgatgcacaggagctactcaatagtttgctgaatgaatgaatgtcagttttcctaaacagacttgaatgattttcttgagagtctaactgcttgtcatactacatcttgtctcatttgattctagatccacagaagctagcacagtacttagatgtaaaaattgttatatctcttttgtttttccagttaatcactggagaccagggctgccctttcaataggaaatctaatatctctctttttgaaaactacccctctttcaaataacccaagaacctcagggattattcagtctaaagcagagtcgtgcttctaaacttcaggtgtagagaggacggcaattggtatgaaggcttctgccactgccatgtggtatcacagtgaacaatggtcctgtccagacctgtgtccttgctggtttgggtctccatgcccagccttggactccaagagtttggctctttgatttaactcatttagtaaagatcagccctcactcaacaatctaagatgctcttcttgagcaggcagcttaggtttccccttcctctacacagatacattaatccctctagggcccgccgtatcagcattctctcccgacaatacaccatgggactgccctttttcatccattctcatgggtttcctcagtacttctaattgtgggacaaagtgagaaagtctcttttctcctggtagactcctgaattcttaggtagtttggtccacgctatcctcaaactgtaccaagaggaggggtagcttttaataagaagggggaaattttgtcacactctttctccaaagaaaaagatgacaggccttatgtttatatagctaagggaatccacttaatgatttttccaaaaataataaatacaaaaacccctagcaggttttccaatagtagagttagaagtggacagtcagatagaatttctgcctctccagtcaccctcttacataggcatggtaatatttattgaaattcactataaaggcaaaactggatgaggacaattgagaaactcttgtcctaaatatcttttcctgactggccaaggaaacagtgagtctaataatcaacttttttttttttttaagtgcatagccctaccagtccaataagacaaaaaagattcattccaaaggaaagatctggcatttcagggtcacatttaagtaggagaggatgcatacaataataagatatttcaattagacgacaaagtcagccataggacacagtaccagtagtgtcttttccactaagaattggggaagggaggcttaaaattcaccttatgtttgtttaacaaacataccagggaatccttccttcaactgtgcccatcgagttgagctacacacatacaacataatccaggggagactgccccaaactgaggctttatttactaatttgcagtacctctgaaactgttaattttttccctacttttttttttttttttttttttgagacagacttttgctcttgttgcccaggctggagtgcaatggtatgatctcggcttaccacaacctccgcctcttgggttcaagcgattctcctgcctcagcctcccaagtagctgggattacaggcatgtgccactactcctggctaattttttatttttagtagagatggggtttctccatgttggtcaggctggtctcaaactcccgacctcaggtgatctgcacgcctcggcctcccaaagtgctggggttacaggcatgagccatcgcgcctggcccctacatttttaatgcctctaaaatccagacatgtttttataatcaatggcaccttggacttgatgaaataaagtaatcaaatagttttaataaatcaaatacctttaaaaatataaacaatttaaaaattgttctaagacccaggttccaacctcaggatctggatatgaccataatgctatattagcatattaaagcagagacacagacaatagcggtaacccttcaaaggggaaaaagcctgtcagctgaagatgatagaggaacccagtgcttctcaaagggggttccccatccagcagttcatcagcatcagcatcacttgggaacttataagaaggaaaattctcaggacccaccccagaagtactgaatcagaatttgtggggcatagggctctgtaatctgtgttttaacaagggcatgggtttgagaaccactcatatggtagctaaataaagaagacacttggtcagtatatacttggcatgcctggggagggggagcataacacttaacagccgaatgttaagactaccataaaaggaggaagaatctcaaaacccaatgcaggaaagccctttaaagtctacagttcctagtttctgactccatatatgtcaaagcagcttctaattagaagtttgtttctcaaggggctgaactacaaggacagaatgaactgatctggccaatatggtatcctgtctacttgtcaatatatttctcactgtgaattccctaattcatgttcttgctcttgcataaagttcatgagttctgagtgtcagtgacagcacctgatctaattgggttctgagaaaatcaattctgaacctgaaaaactaaaggtcagtctttgaaatttgtatatattacaaagacccagtccaaaagggcccagaacatacctaatactcatttaaatggagtatttaccaggtcaagagaagtgaagaattaagggcaattaggtcaagattgcaaactggcaatcctcaggccagatctggtccacagatgtgacttgtttggcccacacacgttgttcaaaaatgggaagtttcgcattaaatattggatttcttccagtcttaaaaaagcaaaaaaaaaaaagatttgacaatagggagcccacatcctggcacttgagcactagcctggagctaggcagaagctgtctcctttaaacaggttgtagcttccaggtcaccccagtcccaggaatctttattgacttctggctggcaagcttctccctttatgtgaatatgatctgcctgacccctggtttgagacgagtttgaagacctttgagctacataatcatttttcatggaacagatcattagactgatttgaataaaatgaattgctcagaaaattagctttattttgtacctttagagctatttgtatgtgtgagcagggatgtagaggttagttacttttgaaaacagacagtgatgaaggcaaatgttgccaggcagagtataaagagaaccagcctgggctgtctagacttggatctgccacttactaaatgtaaaactatcccacagccgtggtttgcatatccactaatgggaatgataatatctactatacacagggtttatagtgataatcgaattagataatatatgttcgagactatatagaacctcaaaaatgttagctgaattaaattttgatggttttgttttctgaattttactttagaaattgttcctaacagattacaaacttttgaaaaaacaatcaaaattaaacctcaatagtcttacattgtgatcaaataatggaattaacatttattgactgtaaactatgaaccagatagtatgctgggtgctttaaatacattgtctcatggaacccataaagaattactgagttagtattatctatcttttacacattaaaatccaaggctagaaaagtttaggtaatttaccaaagtcacacagtaagcgttggataaccaaggtccatcttactccaaagcccttacatgtgtgattactgtagtgtttctcaaactaacatgattatacgaatcgcaggctagtagttaaaagcgtaagctctcctatttatttccaagcttactgaaccagaatctaaagggatacatagccttgaaatgtgccacattttaccacagccccatgtaattcacaacagcggcaaggaaactgcttaagaaagctgataagaatcaaagtaagtagaaaaagaattactttgcgttttattcaatagaagaaaggaaagaaagggggaactaggaagaaaaggagggaaggggagggaggaaagaaggaacaaaggaaagagggaaggagagaggaaaagaaagaaaggagggagggaaggagacaggcagaaaatgtcctggagctaaggcctatggcatttgaaggatgatgtgaatgcacttactagatggatgctttctttctaactgcacccagcctgtttactgcaaacataaggaatcagccaacaggaagctcagcttgccactgcagaggagtaaagcactttgaactacaggcattttgtacacccaaattacatactgtgatacacatagtatttgagctgttccgcaagacagaagccaattattcttggcacgtacttctgtcgtgctatccaaatcaccatccctcacatgtggaactgtgccacatcaaacgcaccaagtcacaaattccttaaactctttgagatgaaagtcaaattttggagaaaaaggatagtctggtatatacaccatatagccaaaaagatgtgtgcttaacttagaactgctgggtctattatgagaaaccggggcagcaaaattctgccttaggaacttttcagagttttgtaaactgaatttttccaatgtaattcagtattatcattgccttttctaatcttagttatttcatttatagtattcatcttaaaataattttccagcctctccctttaaatgtttttaagcacagtggaaaaacatagacactaaaacaaggagtagaggttgtaggtaccatcaaattctattgagaatcacagaaactatgcataagtcctgaatggtagcattatttgataatcagatcagttagttaacccactccccttaccccttacaaatcctgaggttaaaggatttaatcaaaactgtcagatgatatgaaaatagaaatcaaatgataattgttaatagtattataaagaatttaaaacataaatcctgcaagattaaaaagcagaaagtggggtattagatgcaccagctttgtgcttcttaagctttaaatatgctgtggaaactcctagaaatcttgttaaattgcagattctgatttagttccaagattctgatttctaacaagcaccgatgtgactggcccaggggtcagactcagtagcgagtgggtcaatttaagaaggcttgcattggtgaagttctagagatgtgatagagaatctccccataggagggagtgtgacctaacactagtaatacctagaaataaaatgtaaagatgaaagacagatggaagtgttcgtgtaagtgtccagttgctccagaagaaattggttacctatgaaatagaaatataatcttagttttaatgtgagaagaattctaagaaagtaaacagatttacaactaatatataattgggtttctcaaacttaagactctgatgaggatactggatcatccacccagaaaaatacagataatgtacatgcacatactgcacacacaattctttacacagtttcaggaagttcactgagcttcctttggaaaggtgtgaactacctaagggctcatatcacaatttaagactaccaatgcacatgtgtagctggtatagaggaacaacttgtagttttaagactaattgatagagagggcagattagaatctgcttatgtgtttgactgatgatgttattgcacaaaggcttatgatttctcagtcacttctgtaaaatataaactggttgaaatgtatatttttccaaggtaagacattaagtatcttcatattaggtaggaaaaaaaccaccatgttaggccgggcgtggtgactcatgcttgtaatcccagcactttgggaggccgaggcagttggatcatgaggtcaggagttcaagaccagcctgaccaacatggtgaaaccctgcctctgctaaaaatgcaaaatcagccgggcgtggtggcgcatgactgtaatcccagctactcaggaggctgaggaaggagaatcgcttgaacccgggaggcggagtttgcggtgagctgagatcgcgccattgcactccagcctggggtacaagaatgaaactccatctcaaaaacaacaacaaccaaaaaacaccacaccattttacaaagttaaatatatactactttggaaaaaacacaagacaaaaatccaggtttgaaaatgactgcacagtacaggggtttctgaagatgtaaagggcaattgttgttttatgctggtagcatacatcagctttttttctccaatagttttgaatatcccaccacctgcctttttaaactagtgagaaattataattatttagagctgtcatttaaaagtcatagaaaaccagttaatgttttttgaaaaaaacagttattgatcacccaatcttagataagcaacttaaaatctaaaagcaagctacatctgtgtgtgtgtgtgcttgtgtgtgtgtgtaaagttatatgtcaagacataatatgaaatatagacataatgctatgagagtgctgagggcatttttctttttcttttttcttttttttgtttgagctggagtcttgctctgtcatccaggctggagtgcagtggcacgatcttggctcgcaacatccgcctcccaggtgcaagtgattctcctgcctcagcctgccaagtaactaagattacaggcattcaccaccatgtctggctaatttttgcatttttagtagagacggggtttcatcatgttggccaggctggtctcgaactcccaaccttcagtgatctgcctgtctcagcctcccaaagtgctgggattacaggcatgagccactgcacctggcaggagtgattatttccaggatgagataatagagatgtatgaaggaaatcactgagttagctctgagctggattcaggatgagtaggatttcagtagaaggagaagtagaggggaggcatttcatataaaggaactcccaaaagcaaaacattatagagggtaagagtggagggaggaatatgctgtttggtctaagaagagaatgatatttcatcatacttgtaatattactacttgtgtaggctcttcttgactcggtttgctttaaccaacagaacacaaaaaattggccacatgccagttctgggcttaaacattaagaaagcctggcttttgtgttcttggcagccctgagttgccagggaagaaattctgactaccttgctggagagttcacatgaggaatccacatggagagagagaaaagccatgagactacatgaagaaagaaagaaagcaggtcatctcagctaagcccagcctccagtctactggagtgactgcagccatattggggaccatgggtaagaccagcaggactgcccggctgagcccagcacagactgcaaaatagaatggttgtgtttcaagacatcactttctggaatagtttgtttgcagcaatagaaaactgaaactgagtgtttatcaacattttaaatcactactgccttttgataaatacaaaatgcgtaaacccaactggagattcagatgtagcactgtccttctacactcactagtcaagacttattttgaattttattattttgtatcctaatcctaaattttgtttaggatacaaaactctaggtttcttctttttacaaataaaaactattataaaagtaaataaccatcaaaaaccattccctgaatcacctcttctattgctcctccttaacagtagcactttagatggattagtgtacatgtgtatgtgcacacatgtgtgtatgtgtgtgcatgtgtgcatggtaatatttggtcatagggaagattaagaaaaggattagggctaaaaggctgaacatagggtgatatcttcggttttagagggaacctaggacagtgtttctcaaaattcttaccttaaaaaatattggccaggtgcggtggctcacgcccgtagtcccagcattttgagaggccaaggcgggccgatcacttgaggtcaggagttctagaccagcctggccaacatggcaaaaccccatctctactaaaaatacaacaacgacaaaaaattagccaggcatggtggcaggtgcctgtaatctcagctactcgggagtctgaggcaggagaatcacttgaaccagggaggcagaggttgcagtagtgagtggagatcgcaccactgcactccagcctgggtgacagagtgagattccttctcaaaaaaaaaaaagaaagaaattaaaaaaaacaaattcataggaactcaatgtgtgtgtgtgtgtgtgtgtgtgtgtgtgtgtgtgtgtgtgtgtgtggtgtaggcctgcctatccatactgaaacagatttataaaagttattccctatgcgtgatacattctcatctttttctactctattccagttctttttttcttactgatagttgtgacccactatatcagtttcataatgcacatagaagttgaggcactcagatgaaaaacactatctaaaggggcattaatcattaaaaaaaattcgttaaatcctgtatgtgccatacattgttctagtcccttggataaaccagtgataaaacaaacacagttccttctttcatggacaaaatagtcattaaacagcaaccacaacaaaacatgcacaaagtatgatttgattacattcataataaatgctgagaaagaaaagtatgggtgctataagaagctctgataaggagacttcactgaatctggagcatttaagtggatcttttcatggatgccaagttaaggaaagcccaaagtaatagaggtcaatctttagaacatttctgatctgccaagggctagcagaggacaattgcaggaggtcgctgaataagccaagtggggtggaagctgggctgacactccgcccaatcctaaagctggctttaggggctggtgcatgctgtagcctattgggcccagctcatattaatcctttccaacaatttttggcttgtgggatctagagaggagaggtcaaggagcaagagtgaagtatcccccttagagtccagaagtaagagaagtaaaattatttaccatctttcaggggcaaattatgagatccatctagagttatgaaaaactgtgtccaagagactcccaggctggacgctgacagtaattacttgaaggtgttaacatatttggaaaaagaaagttcccattagaatgagggtggttggcaagtaaatcaaagacaaaggagacttgccttgtgctgcccatggagagagggagcgcctgtatgagcctcgagagtgtgcccatcctcctgtgatgatctccctactgctcacatgcatgtcctaggccctcaaaactatgaccactgagccttctgatcatatgtaaatctgtctattctaaatccatgttatgtactatttagcattctaaacctacccataagagggagaatgcgtatgttggcaaggccaaaacactttgtagcttttaaggaatcagctgatactctggctttaaggctcttgtgagcttttgagagtttgaatcagcttactcagaggctgtgacaagatcacctttctgagactgcttggttgaggacagattctggaatatagttaattctccagggaaaacactactctgtaaggacctgtctgggtaaccaactgtctttccctaggcgatacccctagtaactcctaacctccaactacacaccattttaaatttaaaatttctacaaggtagcagctccagcatgtacacagcacacagctaactgttgatgaacactgcctaggcattgtttcaagcactatgtagattatcttatttaatccttataccaagggaggtgctatcggtattcctattttaccattatgaaaactgaggttagttgagcaccgtggctcatgcctgtaatcccagcattttgggaggctgaagcaggtggatcacttgagcctaggagtttgagactagcctaagtgtcatggcgagacccgatctttacaaaagatacaaaaattagccaggcatggtggtgcatgcctgtagtcccagctacttgagaggcagaggtgggaagatcgcttgagtccaggaggcagaggctgcagtgagctgagatggtgccactacaccccagactgggcatcagagctagacccagtctcaaaaaagaaaagaaaagaaaactgaggttaggaagcacaaggtctcacagctagtaaatggcagggctgggattcagggcagcctgattccagactgcaacctttaaccaatttatgacattgctcctgtcaatgcctccacacccaggaggatttgaactatgtcaaaaagtccatttgttcctaaactgtggcttgcaaagctacttttctttaaagggagggagggaacaaatgacctctatccatatgctgtgataatctatacacttttcttggtgtctcatagaacttcaatgttttctcccttgggatattcaatgcttcatgcaaactagtgagaagtggctcgttctctaccccaaatcccaccttttcttcttctggcttttctgtggtctcactggggatagttcctgcagattttcaacttgtttcaatttgcctccttccaagctatgactatgcaagcatgatcctggaattgcagaatggtcaacaaaatgctggcttattctctggggaaattctacagttttctagggagatcatagaaagctatttaggatcccactttccaataggctcttgaggttatgattgttccctggatgctttctattgtgcaactgccctaatgtacaactggccatttatacaaattcagtttataactaagacattgttttgagaaaaaaaaagccatactttctttcttttaaaatactgataaagtgtgggatgtttgaatgtgttctccacctgcatttttctattctaaatcccaaggggaatgagacagagaccaaagccacagctttccaagaccacaaagcttgaggtctttgatgttccttatcttctgagtgaaactttcaattatttggcaaagaaaacaaggctcttaatgggaaaccaaagaagccaaatcatctgtgtaacagaactgagtacatcgataattcatttattcaagaatgtactgagcaacctagcatggctgaggcactgttgtgtatatatatctgtatcagtgaacaaaataggcgaagattgttccacatggtagtttccagtctagtacaggagagagataataaacaatagatatagtaaattatgtgttagaaggatagacatgctatgaaacaagcactcatacatacaatagagcagacattgggaatggtattaatgtgcgatgcatttaaaaaatgggatggtcatggatggcctaatggagatgaaacacaagcaaagacttaaagcaatggaattggccctaagataccgggggaaagagcacttcatgcagcaccaaggtcttaaaatggaagtgtgactgatgtgcttgaagatcagcaaggaggctaatgggctggagctgagtgaatgagagaaagaagagttaaaaagaagaccagagatgaaacaggggtcaaattgggctacacgttgtgggccacaataatcacttttaactctgagggaaatgggagccattgcaaggttatgagcagaggaatgacatgatttgcactgactgctgtcttttgaatagactgttatgcagcaagaggagatgcagggtctcctattagacagccactgcaatcatccaagccagagaagatggtggcttgcaataggatggtaaccatggagatggtgacaaggatgctgggctctgggtatattttgagagcagaggcttcaggagttctaatgtattagatacgagatgttctaaaaagagtagacacagggatattctcaagctttggcctgagcaactgagatgaagaatttatggttagagcacattgtgtgggaggcagttggggaaatctataattcaaccctccctcccttccttcctctcttctttctacccttcccttccttttttctttttctcttcctttttctttcttttttttttttttgagacagagtttcgctcttgttgcccaggctggagtgcagtggcgcgatctcagctcaccacaacctctgcctcccagatttaagcgattctcctgcctcagcctcctgagtagctgggattacaggcatgcaccaccacgcatggctaatttttgtatttttagtagcgatggggtttctccatgttggtcaggctggtctcaaactcccaacctcaggtgatccaaccgccttggcctcccaaagtgtctacccttcccttcttccctccttgttctcttccttccaccttccctcacttccttctttccttccttgcatgcacacctgcaaatgccagacattatacccagtgatacaacagatacaaggcatcttcactagcaagccaaatatgaatgataaaataggggtacagaagtagaattgatggtaggggacctactatattctattattcctttcttaaaaatttagattctgatatgagatttgaataattcacatttctgaaccataactctgaaaatacatcaacatttgcacattgattcttcttcaaaaatcatgttaaacctaaacttaggattccattattaaattgatggtatgttttttgcctactctgttatcaaaaacacatcaacaaatcaaaataatcaccgacatgaatgaaacattcattactacatcttagaaattgtgtcttttttgtttctctagacactatctatcaaaatttctgaaaacttagctaactaactgcactatttattggttttattctaagaaacataaagcgaagtggtacactctggtagaaaggatgccctagggtacaacaaaaggcagataagcattgtgttaggtgaccaatcttggaaacagactgccaaaggtggactcctggctctgtttcttactacttgtgtgaccctggcctagtatttcactcctccgggcctcagtttccacaactatgaaataagaacaataatgtatccaatctcacagatttgtggtgaggattatgcaaagtccttaaagagtgtggcacatagtaagctgtccataaatggcattacatattgagatattgagtgtaactaggccactgttactgctactaccatacactagaaaattctctcctccctttccaagagctaatttttatcactgatattatatacccttttgggggtcattttcaatagtcatttcttaagaaaaaagcaacaagagaaataaagttgcaaagatgatgtaaatgtttaacattattagttaaataactgctagaacatgagcaactacaaaaataattttgaagtatactttgatgcagaaaaattttttttttgttaaatgggaaaaatgtgttatagcagtaagtcaccaaatatgatccctttaaatatatacaagtatacaaacatttggaaggatttaaagtatatattaatggtggcaatccttacatggataaatttatagagttttgatgcttttatgacgtatttttattttattttctgaacatgatagctgggtagtgtcaccaactgagatatataaggaggcacaaatttagaggaaaagctaaatttggttttggatatgaagaattttataaacccatgggatactcagttgggaatttccaataaatattggggttccaagctttgcagaagaggttaagatggatttctatataaatttaggggctttcagcaaacaggtggtaattaaaataagaatgcacaagtcagtcttggaagacacacagagtgaggaaagcaggaatggagaatgggatcctgggaaccccaggtcaaaggaagggtggggggaaaggaaaagaaagagtgtacgacctcatgcaaagatggaaaggtttttgagagggatacactggcaattgacttagagaaacttgatgagaaatgaactgaaaaatatctacttggtttggcaattgggagagcagaggaactacagcagtagttgcaacagagtggtggggctgcaagctaacttcaagggggtagaggaataagtggggggaaaagaaaaagaaaatgataagtgtaaactttctagaagtttgggtgcgaaaatcaatagagatatgtggtaataactgatggaagatacaggatcaaagaggaagggaattttttccttaggaacttcaaccagttttgaaggagatgcagccatcaaagagtaggtcaaagaaagagggagaaggggcgatagatggagcaatgtccaggaggagacattgaaggggatggggattaaatttgggggtagtcttacttttaagtgcactaaacagaaatcttaccataatatagaagagcaatacagattgagcaaaatataattttgtattttttgatgatttggggtcatcagtttgaacaccaaaaattatactcagttgtccagacaggatgcgctcagtgtttccaaagatgggttgagcttattgcccctttcaaaaaggccccaaatagctatgtctgtggttttcaaatgattttgtagattttctttttctgttgttgttttcaggccatcagctgacatttggctaatatcagttgtgactttccctgaaatctcctacccagcctttcttaatttgcttcatccaattatagaaggtttagaaccacatgaccaagcttgtatgaatcatcactaaaatatgaacatacatttctctggctaatgacctacattatcttcagtgagtgaacattgtgaacatctattttgagtgcttagagacctcctttgcttccttccttatgctgatctatgttctagaagaaaggggacactattagggttgcaggctaagttcttaatagttaggatgtatattgttattaataattgaggtataatagatatcatgcttatcaacacataatgtacatatagagaaaaggttaatggaccactctgagcttacttatcaaagtctactgctcttccacaaaacctacatggtttgttgaacaatttcttcagtcttctgcaagccataatctatgattacataaataattaataatagttttaaaataactttgcaatgattttggttgtttagatccccaacaatgtaaatctcacaatcttctggcagatttataattattaatggaaaacacatttcttatctcagtcgatgaattagcgtttgctgtagtcctaataaatatatatagtaaatataatatacagccaaaaaatgtgtaaacgtacaggaaataaaatgggaatctttgtccaaattcattagcaacctgttttcagcatatatagtactgaaccacattataatgttttttgagcacatatattcaagaaattaaaattgtataaagcatacaattccccattatataatcagagtaaacaagaaggaatgatttccaggaagctcatcccttggattgttttctatgtatatgctacatgtaatttatattgtatgacgatgatacaaacgaattttttttgccttctgaccctgatttcccaaactttcacagctcagacctgcagagacaggttttaaaaacaacatttggcaagaacatgtgcaaacgtgatcaatgagcatcgaggtacacgtatattttactacctttcctttcttactcagagtgcttttaaaaatcagcataactgcaataaaaagaacccacaactgccctattattgaattacaaagcaatgtgtgtcggaaacacccctcagcattttaagagggtcaaaaggaagatgctctgcacgtactccacggctgcaggaattctggtgaaaggagataccaacccagagctgtttaaatgatgacgctgcagccaggcaagaagtagagaaagtgactggaaagctggattgcaggcagaacaaggaatggtgggggtggtgacaaagtggactgcgaaaggacagaaatgacagcaggaatgagaaggatttcagatgtgctactatgatagacgtcccattccaagtctccatgtttcaagcaagtttttaaaaagtttcaagaaagatgactttctgcaagatgagaggttgctttaggcacctaatttcaaataactaacaacagctggtaattattcaatacaatcattagcaacaataacagcaagactaaataccaataaaaatactttatagtacacagtggctccatgtgccagttccttcatcttaatttctctacgtttagccactaatttctttggcttcacagtggctttacccaacatcccaggatacaatttctcaccacagaagttacaaatttccaagattactgctgaattgaattactctcacttacatgaggcaggtctcttattctattctggggtctcactgctatcaataattcaactttttataaaaacaaaatcttccttaaaaattgcttttgtcaaaacattgctatgaccatctgtttttaaaaaccattaatggctgtctactaactttaatgtaacaaaatgtattagtttgacagaccaaggctttcatggcctaaattttacctggaccctccactacagacggccacacttgtcacacacatacatgatccaatatttgtgcatcacggtgggagtgtttgttcctttttatttacatttcttatctataagtcccaactcaagccttacttccccctggagcatttcctggctaagctggctctcaactctctcttcttctttgtagtacttatatgactttttggttctattatttgacattgagaactgcagaatcgctgttgcaggaatatgctggaactggatcttgttaagtgttaaagattcaagaattctgcaaaagaactgttgaaccagtggtagcttggaaccagccatgggaggagtatttgcaccatggccatagacaaacactgcagatcaggtttttaactttttttttttttttgtgaggggtggtgggatggtgagaaaaggaggaaggagaactggcttgctagcataccacacaatagattgtcaaattcttcttactacatttaaaatattttgtcaactctctactatagctttccagtataaattcaaatgcttccgggactaagtaattcatgacctctcaaggagttaaattccaacatggacatgtatctatgtacacacattaaagtgtaggctccataatagctagctattttgtattcttcatggtgcccggcacagtgtgtggtaaaaagagatccttctacctttctagcctcagtttccagggcttacattgccctttaacttctggccttattgaaccttggaattgtttcttgaacgtatcaggtatgtcttaccttggtaactttccaaaggccacttacttgccatggctggcccaggctgactgaatccctcctgccactgagtgaccctgtggctttaacaggcctttcaacacgttgtattttaattgtctatcaattcaaccacctctctgctatacaataagctgcttaagtgttattttttccacctgcgtatctcatggctgaggtccccagcatatagaaggtactccaataaatatttattcatagtgaatagagcaattcaaacaaattaatttatataaggtaggtctgctctagcacttttccacaatattgattactcaaaaaaaataggcctcatggactttatgacactgttgcaactacacagcaaccatcgaacataaatttcaaagaggagagagtttatttacaattctatgagcactttaagttttgctttcttcccaggcactgagggagtatccctgaggttgttctcctctctttgtgtttagatgtctgtacttgctggtatgcctctgtcctctttctgccctgcttccacaccaatggcagacgcaccacaattcaagtgaaacctggtttatccccaagaagtcttcacagttgttctgttggtctctgcttaataccacacaaataaaacttaggccagaggacttgggagagtgaatgaatgaaacaaggaagaatggaggaaaaaatataaaagtaaagtaaggcatgagagaattgtataaagtggggtggggaggatacaatttaaactgtttttaagaaaagatataaaagtaaagtgaggcatgagagaattgtataaactggcgtggagaagatgaaattaaaaaaagcttctgagaaccaaatgaggttgtaatactccaaaattcttaattcaaatgttcttcctgcctcctttaaggttcaaaagatagctggcgtgaccatattcacgaaagtgaatttctctttaaattgccaaaatcttattatcattattattactattatttttggtttacagatccaggaatctttctaatgatggagaagcaaaataagaataaaatgcattttataaaaatcctaattttaaataccaagagagaagaggaaatttatgctctctatatattgtataggggctaccagcatatggcctctgtccacagaagtacatttatctgggaaattgaaataattatttagtgagctcaggcaaaagtaagttctaacaccagagcagaggacatagcctaatttcatgaaagctgatttattattgtttataaaacaccaaattgtcattacattttctaccctacgtataacttgtgtttttccagtggtgctaatatgacaaaggaaataatggaagactatcataaagaaagcttaaaatatggtgacttttacatcagtaacactatttttcaatcattgagtcctgctgtgcatcttgacattagctcttcaatcatactccaaatggagtaaaaattatcagtagaggaaacattctatgatccatttcaattccactacctttcccactgttcatattcagagaaatggatatgaagtgctagagacaagagcagaacaaattaaaattctgctttttctgtgtgtcattgctttttgagatggggtcttgttctgctgcataggccagtgtgcagtggtgggatcatggctcattgtaacctcaaactcctgggctcaagggatcctccaggctcagcctcccaagtagttgggactgcagacatgcactactctgcttggctaatttttttattcttagtagagtctgttccccaggctggtctcaaactcctggccttaagtgatcctcctacatcggcctcccgaagcaccaggattacaggtgtgagccaccaagctcaatcaaaagtcctacctataaactaaagttccacagagactgatggttaaaaatgcaaattgaaatcaaatcagcaacactctaaaatctgaaaagattcattatttctccaccagaacactttttataaacaagctgaaggttactttaattttgttcaaggttgtgtcctacctttctttgatctatcccacagcatatagtcaagtggtagccccatgacgtgcacttcactaagaggaggtcagagttatccattcattcattgattaaatacatatgaatcaagtctatgtgtcaggcactttgagtatcaacaattccaaaatcaacaagacacaatgtaagctctcaagaacatcacagtttatggtagccaagaccatttttaaaaaaattgataaacatctactctgatgtacttagtgcccaattctttctccctttctctttaaaaaaaaaaattattgtactgctcaaagcaatctacagattcaatgcaatccctatcaaaaccaatgtcatttttcacagaaataaaaaaaaacttaaaatttctatggaaccaaaaaaaaagcacaactaaccaaagcaatcctgagcaaaaagaacaaagctgaatatatcacactacctgacttcaagatatgttacaacgctatagtaacaaaagcaacatggtataaaaacagacacatagaccaatggaataatacagagagcctggaaacaaatccacatttttacagagtggactgatagatttagagtagacagagagcataatgatagatacatttgattttctataaaggcaccaagaatatacattagggaaaggagatctcttcaataaatgatgctggaaaaactggacacccataagcagaagaatgaaagtagacccctatctctcaccatacaaaaatcaactcaagatggattaaagacttaaacataaaactgctagaagaaaacacagaagaaacacttcaggacattggtctaggcaaagattttatggctaaaacctcaaaagcacaggccacacgaccaaaaatagataaatggggctgtattgaactaaaaatttctgtatagcacagcaaagcaaacaatcaagagagtgaagagacaatctattaaatgggagaaaatatttgcaaactactcatctgacaagggaataatattcagaatatattaggaactcaaacgtctcaatagtaaaaaagcacacaatcccattaaaagtggacaaaggacataaataggcatttctcaaaagaagacatacaaatgtccaatatgaaaaaatgctcaacatcactaataatcaaggaaatgcaaattgataccacaatgagatatcatcttaccccagttagagggctattattaaaaatgcaaaaaataataaaaaataaaaaaaaaataacagatgctggctaggatgcagagaaaagggaactcttacatatcaccagtgggaatgtaaattagtacagccactatgaaaaccagcatggagatttctcaaaaaactaaaaatagaactaaccactatgtccggcaatctcactactgggtatttatccaaaggaaaagaaattggtgtatcaaagagatacctacatccccaagtttattgcagcactatacagaatagcaaagatggagaatcaacctaagggtccctcaacagatgaatggataaagaaaatgtggtatacggccaggcacagtggcttatgcctgcaatcccagcacttttggaggccgagacgggcggatcacgtggtcaggagatccagaccagcctggccaatatggtgaaaccccatctcttcttaaaatacaaaaattagccgggcatggtggcactcgcctgtagtcccagctacttgggaggctgaggcagaagaattgcttgaacccgggaggcggaggttgcagtgagctgagatggcaccattgcactccagcctggatgacagagcaagactctatctcaaaaaaaaaaaaaaaaaaaaaaaaagcaagaaagaaaggaagaaagaaagaaaacatggtatacacaatggaatatgattcagccataaaaaagaataaaatcgtcatttacagcaacatggatggaactggagatctttatgttaagtgaaataaactgggcacagaaagataaatatcacatgttctcacatatgcaggggctaaaaaacttgaactcatgaaggtagaccgatagataccagagcctgggaggagtgtgtaggtgggaggggaggggatgaagagattgattaatgggtgcaaacacacagatagaataagctctaatgttccatagcagattaggtgactagagttaacaacaggtattgcatatttcaaaatagctagaaagaggacacacaggcatgataaatacttgaggtgatggataccgtaaataccccgattccatcattatacatattgtgtatgtaacaaaacatcacatgaaccccataaatatatacagtaattatgcaccaacaaagataatttactgaagtgaaattcatatcacataaacttaaaaatagtaaagtcaagaattcagtggcatttagcacatttacaatgttgtgcaaccaccacctctatctagttccaaacattttcaacattccaaagtaaaaccccttacctattaagaagttcttttctcaagaccacttttaacttcaatgtatgggaagccttcatttcgaaacaggttttgaaaaaaattctatgcccacaatcacttaacttaaatattagaattgagactaatggagtcaaagagtcctgtaacatcagacacagcctcttagggtttttaaaatggcattctgcattctctgttttttttgtttttttttttctttggttttggttttttcagtctgtcaattttccagattcctatctcccaaagccggtagatgtctcctttgatccagtagctaaggcatggttgaactgatcatatttataccgaatttccaaagatcaatcaacgagaattctcgggtctatgtgcttgtttatttagccctgcctctatgcctgaacttcatctggaagtcacacatagtcttctttctgtcttcagccatgagcaatagtgtatttgcactaaaaacgtttccatggcatcttcttctttatttaattttctatcagcagacccttctttgatacttcctttttctgcccattctggtaattcagttgactaaaacacaaaactcttcccaggtaatctttgtttccctttcataatctgccgtttatacatctacttaattcataattttgctaaacatctccaattatttgttcctacattgttatcttgccatcaaaatattgattttaatacctgtgacccctccagtccatttaaaatattaattaccaagtttcctgccttggatattggagttcttaatactaacatcaaaccaaatgttttatcctcatttctaaagctctactccattgcagacaccgtgacatctaacacttagcagatagaaaaaaagtatgccattgtaaatctgaaaacttctgggcttgcatgtcagagactggaagtggtttgtttgaaaggagcttatactgaggcagcatagcataacacagtggttaaaagcaagtctgtgaaagtgagaaagactggggtccaaatcttggctctaacacttctaagctacgtgactctgggcaagttgcttaaattccctgagcaccagctttctcatctgtatgatgtaaaaaaaagagcagcactgtttagtaaacatggtcttggctttataccacttcctaatatttctacaactgtcaagtcaatcaacatgttaccttagaaactgtggaaaaggtataacctttggaaaatgtaatcaggggggaacaacttttcctagcccaagtccagcttctggttctgccctgacaggtatctgtaagttataatgttttactaggtcttcatttccttacttataaactgagggaggttgagtgaggagttctatttgtttgcattttggctctgcaattcaggggttttatttgacacgtgaggaccaaggagtagaaaggagcaatcaagtgcagtggtttggtcaagatcacataaaaagtcttgctgtaaaaccaggagctagtcctaaactgctcaccagcaagcttgatttatactcgagtagaccatattctcttgctcctccagctgcagctccactcctcatttatcttagcccaggctgactctaagctgctttcacttctacctcactgcatttcgccctgataattttgtagcttacctagcctccctctttgagatcccttcttaaaagggtcattctattaacctacccatatcagttactttactactgctgatctatcgctacctgtcaattcatgggaattacagggtgcactgggacaagagtaaaatgatccaacaaacataatgttgcatttaaaaaaataagctaaaagatactgatgactttttataactacaacatattcgtttgtgaataagaacatatatagtaaaaagatgaaaatgtgaacaggttgactatttcctaaatttatggcagaggttgttctggagaggatggaagaaaaatgaggctggcagtgatggtggggaaatgcaacctccaaaattatctatctatatatttttattaaaaacacccacagtaattatggcaaatgttaatgtttgtttgttctaggttttggatacatttaagatctcttgctttctgggtacatttcttttcttttcttttctttttttttcaaattaattccaaaagacttatatctgctacatgaagaacgaagcaagttcagctctcttgctgaaatgttcaaatgctgaggcaaggcctgtactacaaatttgtgtaaccaaaaccacagtgctctcaatgctcctagtgttgcattacagcagttagaagagattgagctattttgtttccatggctcattaagctagagttagactggtgtccataatcaaatttactgcacttacccttgcttcttccctatgaagtacagccagaccttagggaaaatctcaactattccaggtccatggtaatttggtccacgaaagaaattaacacacctgaaaaggattaaattatttttccttttcaaaatgatcctcttccttaagcttcctctgtcaattgactgccaaccttatttgctaattcccatccctcatcgggcttcctagcacttcctgctgcaaattagtgtgcagtgaacctgagcctgctctccaaaacacatccagactcttggggctttctgggcttccgctagggtgcctggtgcaaagggggcctaaatcaatcaattaaggcctgggaagattccaggcaagaggaagggatatcttgggggacaaaaggaatgtgtaggtgggaagaagggagaaagtctttcttcgtttttcactgcaggaaatgatctggacagagagcaattcgaatcatagacagggagggttgggcaggatgcgatgggggagcgaatgacagacacaagtgacaggaacaacttagggagacaggtcagaaaacatctaatctaggcacatagcagaaatagtgaagggaattgaaacagttgttctgtattttgttcacagtgttaaagtcaaagtcagtgctttttaacctcatgggatggagcgggggagggggcacaaggagccttgtgtgaaggctctggctctgcttattgatcccccaaatacaataatacatcctcacaatcataaatttgagagcaaggggctctgatcctgtgatatacaatctaggcccttattggatcctggaactgattttcagaatcctttattcttttaagtacaattgtaaaaaaaaaaaaagagagagagagagagagagagaaagcaaggaagaaaggaaaaaaggaagggaagaaggaaggaaggaaaaaaggaagaaaggaaagaagggttccatttataaacctcagacaaaacaaaaatgaaagcaaaagagaacaaaaaatagccaatacgacccaagttacaaatttacttgtatcctttcagaggataacccaaattcctgcaagacaattagccatctttctttcgattattacagtaagcaagacgggttaagagtatatagtaaatgtgctttgctaaactccttctccctttattgactctatcacaagaagcacacttaatataatttttacaattttttaaagaacaaataggaaagaggagaaggttgtactttagctacctttgtgtatttgaaaggaatgctgttcagggcttcttccttttcaaaaagaaacaggtctttgaaaacgaagaatcattactgtgcatatctctcgagggctgctcctctagtatcagtccatttgaaataggagtttcacataattcaatttattaaacccacatttcctgccagattttgctttatgtgcctatgtccttttgtttcccggctaacatttccacatctcggaaatcattctttctagtataactgaagaatatggatattaaaatcagatcagcaaaagatttttatggacttggaaagctgcccattaatgccgtaaaataaagcgtgttatacagctgatatcatcagttctactctatgttgttttcatattcctggcggtgggtggagagttagagtggaacaattaggagtgggaaagagaatgaaaggattcgatcaattgtggaatttcaaagcggagacaatttacactaaagaattcaaagacttcgtaacctccaagacattttccagtccaggtaaccgttgaattatagctggaggtgatgttcttggagctgcctgtgaaagctgaaatcacaacatgcctgcagtgttcccttcctaaaccaactttgccattttctcaggcagacacacaaacatgcaagcgtccacagtaatgtgcgtgtgtgagggatgggggaagagtgattgttgctttgtagtagctcctttgaagtgtttaattcctcccttgtaatctcttcatcaacacacatttaaagcatatcagttttacctcagcaatttgattctcagaggcttatgtggctcagggcctctgtccagcacctgggtggcacagtttgttttatgtgcatgcagaagtgttaacagaattaatttttttccttctttctctctttcttcttcccccacctcccccaatttaggttaatgagcccaggcagcagtgtgtgtgagtgagcgggcgtgtgcacaggagggccgtgagcctgcctttttaaaatacaggaaacgcatagaagaaagaagagttcagctggagccacgacttccctctttgcttctttccctccccacccccccaccccccacctcaccccccacactccagcaccggcttttaattttcaaaagcactgcaattgcttggtgtggtttcaagagctggggtgccattctccctgatgatgactctgctgacgtcaatggcattcttatcatgcctagtgcgacatcagaaaccagtcctcagaggctcctcttattcacagtgcctgggctctcagcaaaatgtggaccggattctgaaacgcaaaggactccccgttcctaatcagcgctgcaatccaccagacagtctccttctgccggcagcttgccagttaagactttgttccttagcgttctgtcctgcaaggaccccctgaaggagaagagagggctaagtggatcacagcgtgtcctccgtgtctgagctttcagagccgtgtgtgtgtgtgtgtgtgtgtgtgtgtgtgtgtgtgtccctcaaccaaggttagagactagtcaatgctgcttctgattattcttcaggttttactaaaaggcttcagtctttgatataaggctattcccccgacacagtggctaagaccctcttgtgtaagtgctcctagctcactctctggatcagaaccagcgcccaggtccccacgtgaagcccatattcaccccagatggcagcatgcacctcctctcctttttttaataaagaaaaagaaataggaggttgggaggagaaggaaaataatcatagctgaataataatagcagaataggaaaatagtatcactaagaattaaatatttcactctaaatactcatgacttgttaagaggtctgctctcaaaagctgaattcacaagggagttaatacatactaaacccagtatgcattcctacctagcagtttgggggcaattattatggggatgatgaactttctccatttacagtggagtgtattatggtccaaatctaccctaaagcatttgggaaatgtctacagttcaaattaagatgtttagagtcaaggtcatttcgcttgatgatggaatgatacatgtctagttagatttcatctgaccaatctttgacacaaacacatcagaattgtcttggtatccaccaaccaaataatgtttgtttctcttgaagattgctgagtgacccatagtaagcttattaggagattaggagcaactgttccagagagaagctgtttaacaacatatgaaatgtgcaacataattccatctagaactatttagaatcataacatggaagaacagcagcttacacctggttcaacccttctacctttaagtgaggaaactgatgcccaaaggctgcgtcatgctttactcaaggtcatccacctattaagaggcaggactgacaaactaaagctgtctctctctaaatggtatgcttttcctactacaacacatagctcctgattattcaaaacctaatgaccaaacctcaaacccacttgccaagggagtttccatttttcttttaaatctgagcaatatttcttaattttttgattaaagtgatatttcaggaatgtttagatgaattataatgagtttctcctttgttttcagtgagtttcacaactagtgtaaaggttattaagtagaatggaacaaaataatatatgttggaatgcatgaaattcagatggttttgttctttgttattttttgtagagacagcatctccctatgttgcccaggctggtctcaaactcctgggctcaagtaatcctcctgccttgcctcccaaagtgctgagattacagatgtaagccactgagcccagcaaagacgtgtttttaaaaagtgatgatgggctctgggaagaaggagcaaagatttatctgggttccaaatgtatgagctccctgagcccagccatcattctgcttcatctactacatagctctcaccatggtttgtaacattgcttgctaatatattttatttgccacctaattcaagccattaagttaatattcgattatataaatatgatctttatagttactttttccctatccccaatagttttgccttctcttcagaggactgtaactgcttctataaatcaccttttgctactctctttttggtagacgtgcatcacattctggtcgcgaatggtgaggagatggggcagatgctggttttagagtcagacaaacctgtgttggaaacctggcttaaccacttgctactatataatttcaagacataacttctctgagcctcagtttccttatctataaaatatgaccctaccttgcagggttattgaaagggttagagatgatgtttactaaagtcctatcacaatgcctagcacataggagaaactcaatcaaggataattttattaatgatttttaaaaaataaatggggaaaatcataaaattaataaagattagtaagattgaacaaaggacatatagtatttccccccttataaccagagctgttcctcagtaccactaaaattggaaggacaatatttctttaaagaatttttctagtgaaaagctaagccaaatatatgatcattggcctgcattatgaatgcatgtttcactgagtatctgattataattggatgtcaaatagctacaaaacctaattgtggtctcaaaaattgtctcttctccctgagacaaacatccaatatttcctaggtgataactaagctttgtgtacactgagataagacgccaaatcaattccttaaacttaaaggcacaaaggtttcggaaagcctcattgtccatttgagagacaagccacggcatctcgtaaagcacattttcactgtatactatgttactacaaaattgagttaatttcattaataacaaaatttatcaaaataaaaatgctttctcctttgcaggaatccataaataacataaaataataatagcattttaactcagaagcaaattacagccatgactgtttaagttggctaacccaaatttcgtaagtgaaactggagtggtctgcgtaagtcctagattgcatatgattcagggaaacccagatgtcaaaagggtgtgtgaatcaaaagaaggtattcatcttggtgatttagccctgaaccaatcaattcttcccagagcactggagaaaaagttcttgtttctaatggaatcatcctgcccttacctacctagtaaaaattttgtacccaatcaataccttagtcaactttaaattcctgaatagcccttctgcctcattcaagtgaatggaaagaaaaggtttaatcatatttaaatactccagactattgagtaaagttaaatgcaaatttggtcatgttattcccttctttaaaaccatccattcattagtgatgatccattcacctaactatgccctcagcaggcagggctgttagcctgaggaaggggtgcccttttctatttcatccagctagaagatggccctttggaatctatctgctcaatgatattgtatttctagaatataaaaaagatgccttaaatatacaaaaggcacagggggagtcctttttaggtctcagtttaaggctgatttctgagttggttatatgctctcacagcaatttgtatgttgccttcatggtgcttaaggcagttcaatcatacattttgtttttctttcccctactagagtataaggtagaaattgtgactatatttttcactttcgtatccccaactccatcccagtgcctagtacacaagtaccaggtactttattgactgatacacaagtactagtgaattaaaaaattgttatataaagttgggttgttgtcttgtccaatagtagctgtgtttcgcactgcaagtcatttttgagagcatatgaaataactctatgtcctcatgaatgactttatcataatcattcctgaacagcacgggcgtgtggtattccaaaagggagttttactggcccttggttaaatttaaagaaataataaggccaatttaaaacacacacacacacacacacacacacacacacacacacacacacacacattaatgagagatttctaagccccccatgggagatgactgccctttttgtccttgttttgcatattaaaagtatatagaatgtggaaaataaatgtcataatatgaaatcatggttccagtatatgttagtgtgttctgttgaaaatagttttgtttggcaaaaatgaagagttggtaattgtatgttgggcctcacagttttttgttttgaaattccaaagtctgggaaccattgacttagcagggttttcccatcagaacacagatttgagggtttttaaggatacatgtcttagtttctagtcgcgtatggctccaacctacaatccttccttctttcgggtcccacctttattttttacttttctgatagttcccacaactttgcccacaaagttgccaattcctaaatattattatcaaagtgcaattttgtataccccaaagctaatatataattaattttactataagagaaatcagttaaaatgtaaaaagtttaataatatacattataataatggccctggtacactcccccaccgttctttggaataagcaaaggtataacccttgaaagtaaaattaacttttctttgcacatattagacttctcaatggtgtgccaaagagtggagatgacaggtgagccaagctattgatttcccttggctcttgtcgctagtgggtgggagactgaacacaagccacatcctttatttactgcagttttcgtagaaatatagttatcagcgtatgtcatgaaggaacaaatgtggggaagtactgacctaaataacttttacgtgattcagtatacatgtaaattgaaataaagaatattaaatctcaaaactatccagaggaccttattcaatggtataatatttcaaatttaattttttattacagtatattttcaggtacagttttaaaaatggggagcatgcaattaacgaatacataaaaataacactagtttaatcttccctttaagaaaagttcctgtttgctattcctgttacatatacaggcataggacttcatggcctttaagacatgttgataatattaacatttccacttgattgtgggaagtagcattcattttcagctttgcttagagcttattaacctgatgtcaacaagatatactagaaatgtccttgtcagtccaaacccacaagtagaaatgatcatgttgttgaatgtgttcagtctgatttgacaacggtaacaagtcaacactgttctgctaaaggaaggtcaatcatcccattgcaccagggatttctttatttcttttgctaacattagcattatgaccagtgtatgtcaaagaatacattgggataaaaaattctgcttgtccatttctgtttttccattctcttatgacttagagaattgaaaaattaatctcaatttttttctgtctgtaaatatacaatatatatatacacacactcttacacaaaatctctgaaaatgctgtcacatgcatgaaacacaaaatgaaaaaggtagagattttttcataaacatgaaacagaaaaaactttcctcctcactacaattcatagctaggattcatgattttctagtaagagtagcaaaatggatgccgattctatggcatagaagaccaatggctttagacctggattcaaattttaactctgccacttcctagcttggtgaagataagcaagttaagtcttagttttctcatttgtaaattggagtccatagagtcgtgaggatttcacaaggtaatttatttgaagcatttggcacaacacctggtacaaattaggaactcaagcaacagaagacacagcattaaaatacagtgcactacatcaggacattacaaaagcttaatttaataaatctcttgtctgattcattctaattctgctagtatactgtagaaaagtacactaggtcctgtttgtggcctccccaggtcagctctgcccaccctaccccttgggcataagccactctcccagtttcccaggcatgccacagcagccccagtaaagcagcggttatcactgcaattgcctcatgttttccacctccccatccttgcgggcttagcgtgggcaatggcctctgacttgacaggaaccatccagctacacgtgagatggacaaaggctctgtattccccagggactctgggagggccaagggtaccatggagcaaactttgaccaatgagagacaaaagacctatgcacagaaaaattgctcaccctttcttctccatgtggaatgttttacgacacagcctcacaggcaatgtcccttgtaacttagcaactagttttgttgttgttgttgttgttgttgttgttgggaagctctgacaagcttagtaatgcattaccttgtacatggtttctcttcttccctactgctgttcctttcaccccctcaactccacttttgctttcttgggattgcatgactcacctccctcataaagctagcatgtaagctgtccctagggaatttgatcaaaaactgtgagatttagaaaaaaagatgaggcaactagatacagtacaagaatgaaagagaaaaagtcataatatttgacatcaatttacttatctatgattccttggattctctcagtagtggaagctcttaagaccacattaccaccttattaacaaagaataactgataaaatcaacgggacaatgggcctttgagaacaaaccatcattaattttgttccacagagtccaatttcaattataacctaagatatgtttggaaccacttaatgctattttatgagagagagacagttttctctttgaaaagtcatgttcctttgaatttaactaaaacgtaacaggatgttaaaacgaaaccctggcatttttctttccttcagaaatatgcccacattttatagagaaagctatatattgaggttctgcaaacaacaaaatgcaattttcacattaaacatggattctaacatctggcatttctcctagtgcttgcacataattatccaaaattgcagtttttccaacaggggacccacagtggtagctctgattcattccacattatatatatgaccctttctcatagtgagggtggtcttcaacaccaatgctcctgactgctatcttccttcaacttacatggaatacttttcctcatggctccaaatgtatgagctctaggttgttattcagggttctttcatcctcattttttgtaccttttatgactactttctgaaaaggcacatttgctgagttggcgcctcacaggtggtttggtttgtggcatattttaatagctatgaaaccatgagttcagctattgggttgcaatgagttacataatgcatgtgcaattcagtgcgcaccaacaagaagattttcctaagaccccaaatgacccaggaaacggacacattgaaggggttgcacctcaccaaatgtccctgacaaggatgcacttatttggaaggatgtgcccttactctgaaggctggtggtctgaggagagtagatgtggtaatcatccaactacattaaggcacatttatttctgttgctttttggttcattttattttgatttggtttgttttctgttcttagcaatcagtccattttatgagtactttggcaagtagtagcaaaagctgttttctctaggaaatttttaacctttcaaacacagcagagatgttagggacattataaattcaattaaatgtggtccctgtttctggggttgatggtcataaccatttttctttttcttaccactccagtttaatttacttggaatgaaaaaagtaaatctgagcttctgaggattatcagttgagattctgggcctttaaacacaatcctctctggtctggacttatttgcaacccagcacttccagaaatgcccatcattagctcaggaggatgaactccaaataatccacgttctatttatctcattattctctatatttatgtattcattcaatacgtatatctcccatacgccagcactatgcagatgatagggacatcattttgaacaaaacagaaaaaccactgcctgaagatactgggccatgaaattctgttcaaagatatgttttggcattcattttgcaaatctctacatagcatgaggaggaatgaaaagaataaattatatccttcacttattcatgcattcgttgtccatttatttaaaaaacatttattgagaatctattttgtgataggtactgcaccgaatgccaggaaaaacaagcataaaagatacagggtgtccagaaaccatctgaaaggatgaatttgactactcaaatattttaaaagactaaatgataaaaaaaaaaaaccctaaacaaattaaaattttttgaaaagtttacacaaatgaggagagttcattttcttaatatactcaaaacattaacatatccataaaaaataaactcctcaagataattgattcaatgagtctttggaggtaggagggaactggcccataaatgtatgaaaggtgactaattttctttgcaattaaattagatggggaaaatatgttttttgtgaatctcagggtcagtgtgtatagaaatacaagcatttcttgtgatgatggtgggattgtaacttaatatattctttttagaagacagcttggcaatatttatgaaaattttaaattcagtttcacagctaagactttattcaatgggtaaactcacaaagatgttcaggcacaaggatgcctgcagtgttatttgtattaattgtagtaaaaactggaaatgacccacaagactatcaatagagttaaatgggtttttagacataacataatgcaatactatgtgtcaaataagaatgatcattatctctagatcatgatctgtataagtccatacaaaagggccccaagatacactattaaattacaaagagcttggtgcagaatagtatttgtaatactctcttggaggatatgcaagaaactattaacactttactcccgacagtcatgaccaagcaattagagttgccccaggtaacatctatttgctatcctgctctgtcacataacatttactgtaagtagagctctctctgagaaatgtgctggtccaagctctttgaatatttgtatacagttaaaatcacgaagaactgaagatcactgcaattttcaaaggaatgaggactttaaaaggacagcagcagcaagggaaaggtagggtgaccaacttgtcctaatttgtccaagacttccccagttttagcactgaatgccccacatcccaggaaatccctcagtgccaggcaaactggaacagctgatcaccctcacctgccttggggctgctgcagaggcctaagcatgaaccgtagacacaagagaaactgagaaactttctttctgcccccatcctggcttccctgtacctctgcccagatgccaaagagtcctcctcactttcccacagccacaactcccgacttcccttgcacctctgtcctttggtacaaagatttctacgtttgcgttagtgatgtgacctcttggattaggatttccaaaactagaaatgtttttggagtttatgtagggttttacaggagaaaagaagctattgtgaaagaactgtgagggaaggaattggatataggaacaaaagttattttgggggctagaaatcataaatctaaatgggttttcaaggcaaagaaaaacttcatggtatagataggaaaggatacagtattattcattagaaaaatggaaatggtatctatgaaattaatttagatttaaacaagaatattttaagagggaaagtttcttttttttttttttttcttgagatggagtctcgctctgtcgcccaggctggagtgcagtggcgagatctcagctcgctgcaagctccgcctcccgggttcacgccattctcctgcctcagcctccctagtagctgggactacaggcgcccgccaccacgcgtggctaattttttgtatttttagtagagacagggtttcaccgtattaaccaggatggtctggatctcctgacttcttgatctgcctgcctcggcctcccaaagtgctgggattacaggcgtaagccaccacgcccagccttaagggggaaactttcaagagagaaaaacgccaaccctgagggaatatgggattaaaaaatgtatcagtaatttatatgcttctgacactttctatgtgactcagaatactctgctgggaatagctaatggcagaaaatttcaattattcccagttgcaggtgctgtgttgtgaaaggcacaatagcccctagcaaccctaacgaggttaaaggaacagtccctgaggaatctcactgttagtatccatggcaagagaaaagctaaacactggggatacatattacttcacttttgtccctgaaattgggcaaagtttcagatttgagaatggcatcagaagtatagctgtttagtgcatgtgtttctcatcatagtattgatattcatttcacatatattcccacagtaaccatttactgaaggaaagccaaagccattttagcttgattacattttctttttttggtttgttttttttagacggaatctcgctgtgttgcccaggctggagtgcagtggcacgagctcagctcactgcaacctctgcctcctgggctcaagtgattctcctgcctcagcctcctgagtagctgggactacaggtgcatgccaccacacctggctatttttgtattttgagtagagatggggtttcaccatattagtcaggctagtctcgaactcctgaccttgtgatccacccgcctcccaagattacattgtctaagacttcctacagaaagacaacttcatttgatattattcacaagccatctagtctcttgccttcaacatttttggccatgtagtgggtgggtgtgctcctttttgcactgatagatcagcagccatgccacttttctaaaaccatatttattttgccccctgtatcatccattcagtcatttaaccaatatttgctaggaaatgagtgagccattttagcttgattacattttctggggtttcatagatgactaagatgtagcgtccactctcaggagttaaggatacattaaggaagacagataaaaccaactaatattatgacattgtaggatgaaagaggtgtgtgaaagatttatgaaagtatagaggaggaatgcttaaattcgggagaaattcaggaatagctatctcaaggggcaagtaggtaccctgcagtttctataaaaggtgaaggtagggaagacttacagggagactgaacaatatacgcaaaagttacagaggtgtgggagagcttggcttgatcaggaaactatacactgcaggctagaatcaatgagtgctttggaaggaaggggatgcacatgggagaaaggaacctagaaaggtaagtcgcagacaatgagggaaaggcaaaagacaggacatttacatttactgagcttttattttgtgccaggctttttatgtttggtatctcacacaattactccagtaacttcctgacaatgtttgttactccattatgcagatgaggaaacagaagatggggaaggttatacctgggctgacccattttttgaggccaggtgtatctaataccaaagaccctggtcattttaccgcagaacattgtttctagaaggaagtttaaactttaccctgaaggcattgcagactctgatggacatcaacaggagagaggtatgatcataattggattttattttgagacagggtctcactgtcgcctaggctggagtgcagtggagcaatcacggctcactgcagtctcaacctcccaggctctgcctcccaagtagctgggactactggaacctactgccatgccaatttttttattttttttatttttatttttggtagagatggggttttgccatgttgtccaggctggtctcaaactcctgggctcaagcaatctgcccatctcagcctcccaaaatactaggattacaggtgtgagctattgcacctggacttaactccattttagaaaaaaactaaaaaactaaaaaaactaaaaaactgtcgtgtggaggaggaggaactgagaaactgggggcttttcctaggatgacagagaaacattttcctgcaacaaacttcaatgtctaccatcacatacatacaagtctaagtttcataggccttgatgttgtcattcttgcatttatgcctagaaacatgtaagtctgagatgtaaattgcagaactaaagatgatggattccagaaactctgatccacctaagagaggagtaggattgtggaaggcacataagggtaaaatagtatcacatttctaaacttgaaaaactcaattcaaatatgtgcagattcagtcccatatgaacagccatgttggctagaggacatcatacttctcaagggcaacagagatgctgggagcagattaagtagttataacttgcacctgtgtaattactatagcgagtcacacttctgtcaaatgatcctattgctttaaaagtttgagatgatgcctggtctaagagctttctttagctgcatgtctcaatgtggctataaatttcagtcaagtcatgtcctgcacattgggtctaattaaagaacacaagagtgagaagggcagggtatacactcagggatggtggagttagtttatttcttggatggaaaatttaacggtcattataatgcctctttgggttggaaatacagattcttatgtacacattcattttgcacaaatgaaaatggtaaaccaaaatcagagagtgttgaagttcttaaactaaagactaccttatagtgagctctagtaaagaaggttagaaacaatttttaagaaaatttaataacaatatttcagagaaaaatttgttactgaatattttccagaaatagtaacaagacatctgtattcaagtagatacaagtgattgtaccagagggtcaatattttgagatggcaagcacacattcttatcataaagatatggtacaggaactagaagagatgtaatattccttgacgtgattctgtcataaaaggttaacaatgttacatcttagggccaaggagacaatcctttgaaggttgcaaaggactggctagagtcaggaatcatcagcgtattcctttaaagataaaaattatatatatgcatacaagtgctacttttaaaatcaggaatgatcttctatttttaggggccaaagagaagagttaaaaactataaatggatatttgacttatgtggcagaagaaaagttcagaggtttcaggatctgcaggtgagaagaaaatgtaaactaaatggcaatctgttcagtgattttaaaattcctaacaaaatgcatttcctacaaatgttgctacctgaaaagtaacaattagacatccatttatttgtacttacataataaaaatatttcagagtaatgtataccactgtctaagtctttctgttctttatctgtagccaaacctacttgcccaaattagttgtactaagagttttcaggctgtttacaactgaaaccatcttacaaagtattttaggccacatttgttttgttgatgaggccaagagaagtgaaatagtttttccaggggcatgcagtctgttattaacaaagttaagactatggacaatttcaggatcttgttccttggtgttttggaggttctgaggaagttggtgaaaggcttctcctggaaagtaaatgtggttaagagccaaccaggtgaggctccaggcctactgcctcacttcacctaaagcagatgggctgtgttacagagacttatagaccgggctttttttgaagactatttatttgaaacatctcttctgtcaaatgaatttttaaatgctaaatgaaattttttaaattttaaatgagtggcccacgctaatgtattaggcatgtgaaagggacgatgttgtggacatcggcaggcagcctacatgttcctgaaggtcagacccgtaacccattcatcttggaattttcctcacttggtgccttttaaaaggggatttaaaggcaatagggtctggaggttcttgcagttatagcttcaggggctcccttctgatcttgcacagttttctaattattcccttgttttcttccactgacccatgggatgtggttaacttgtgtcttctaaggccagctgtgactttttccttacccacgttacttccaagttgggaacacaatcttgcaacctggccccaccctgttgtctctgcacaagcctgaaaactcaggtaaatgaatgaatgaatgaatattaggctgataataactacagggaaaaagataagaggtaagaaaaataacagtgatgaaattagcaggcaatagagcccctaaatatcaaaggaaggtaaatgagttcattctagcattccactagccctcttaggctttgtcatgattgctttctcttttttctgtttacgttaatattttgtttctgaaatgcatctcatcctttcctccctatagagtctcctaaattgctttcttttctccccaaccttcattttttcctccttcactttcccactttcaattctaatttccaattagatcacttaggtttacaataatccccaacactacgtattattcccatctcaaagcaaactttagattgtaaccttcaaattcaaagtcccttatacagttttattctggaaaagttgacttcaagcaattattgattggcttgacttcttgctaaattttgcctaaaggcgagcctttttgaaatcacacaaagggtggaaaccacacaaaagtagtggttctcaaactaggtgggaattcataatggttataaagaatgaaatgggctggtcacagtggctcatgcctgtaatcccagcactttgggaggcccaggcgggcggatcatgaggttaggagatcgagtgaaaccccatctctactaaaaatacaacaaattagccaggcgtggtggcacacgcctgtagtcccagctactcgggaggctgaggcaggagaatcgcttgaaagcaggaggcagaggtttcagtgagccgagatcgtgccactgcactccagcctgggtgacagagcgagactccatctcaaaaaaagaaatgtaagtaatggattatttgggagttaggtaaggagcactgaaaaatatgttctaaaatttatattcatgaaaaataactgtatttttatttttaaaaaataacatttattaatagagattctatagaggaatgaagttactttttatttcctttcttttcctttactgtttccttctttccttccttccttccttcccttacttcctgcctccatcccttcctccttcccttcctccctccttccctccctcccttcctccttccctccctcttttccttctttcttccttccctccctcccttctcatcttggaatgagaatacacaaatcctcagttaactctacacttttattcaaacacaaacttcagttgccttgactagttttacagtaagaatttaattttgaagaaaacaaaaattaaatgtcactatcaataaatcaacctaaagatcaagtagatgtatagcatgggcagatatatcaatttaatatagggattaagaggttgtggagtcagcctgacccagtctggacttcagctgcaccgcttactgtgcatgtccttgagcgagttaactaaaatataccacacatccatctgcaagcatagcagtgaaggttaaataataatatgtacatgaaaaacttggactgtgcatgggacatagtaagtactcaataaatattataattaatacagttttgcaaaacatagtatctcatactgctcacatcactgcaaagtgataaagcaaaggacatcccaatatcctacctaagaaaattagtgttcaggcaatatttaattcatgtgcttctagtgctatttataattatctcattcaaatgtcattttgtaacaagtatttgatgtcccagctgacttgattctagacctagaacttggaaccaataataaattggtgggctttgaacttggaaaagcttgtgatagagtctaaagttttaattccacagggttgatgttggttcactgcttgtcacgatgtgcaattgaagctggctatcaaagcagaataaggcaaaggtactttaactccttcacaatcacatgttttcactttaatccaattatagctgctagtcacatgctttaaagatcacagatccaaataaagaaaccatcgggggtttctctatggcttataaaggagcaacatcttttatgactttaattagtctaattttctattgttaaagagaaaagaattatctgtccttaactaaggcagtcagttgtgcacaaagccaaacgtgctgtgggtcaggagatgtgagttctgacctctgaccaaccatgacctctctgagtactgagactagtcactggctgtctctggtttcactttccttgtttctaaaatcaatccttgcactgatgatcagtgagatcctttctagccatcatagcctattatttcatacaaagtgatttttccagaataactaaaaagctgtaaatggtatgttcagagatgacaaaatgagacagtaaataaagggtaaacgtatgtctccagaaagcaaaaataaataaataatactcaatgagaaaaaagatgagtggtgttttgaatattaacctctatgatatttcagttattaaaattagcttcatagttaattggctgatataacaggactttgtgtttcttaagcaagtatttgttaaacactgatgaagtctgtagtttatatctaagccccatgaagtttacaacatttgagttcaacaaagtttatcttgcaggagcttgcaatcaagtagatgagtaaaaagtacggatttaatatacattgcttaaaaggttacatataaatcacatcaagccaaaatatcagcctagttaagttgcttgacccagggttataactcgaatacacaggtctctggatttcccttttagagaccgtattccctttaatagggtttaatgggggggggggggggaaccatccagaagctgattgttgttattgttttataaatgtctttgttcttttaaaggtatgtttaatatgctgtttttattacagactatgtatccatgaaaagtaagtttgaaaatgcagaacatagattttttttctcaaagaaaataaagggtgaatttaatggaatgatcattttcaactggaaaggtgtatttgttgaatgctttttgtgagcactcaataatttagcttttggagcattctccatacagtctaatttaatatttgtaatgatccatagtgttatcactatcccacatgacagtaatggaaatgaggttcctggaggtccagtgatttttctgaatttaccaagtaaatatttgggaaagtgaaattaaacccaggctggcaggctggaaaatgtgtgctcttccgaatctttcatcttcttctggttcttggtgcttctctggaattttgcatacagagagaaggggacaggttcttttcacttttgatgtacagaggttatgagaaaataatcttaagaaatttactgaacagctcggttactaaaaatgtacatctatctttccgcatgatttttaagaagtgagattcccaatgaatggatttaaaatgcaattttacattcacctagaatgaatgtgcagatctttcctaaagatataagaaatcgactgaagtaagcaagaaaaacactattccggaattgcaaagggtatccctgaagagtatgtgtgaatgccataaaagttatactatatctaatattatcgagccctaattgaaagccgctgatttcacctacataattccatgtctgcgaaatcatgtggtgtttctagtgaacataaacacatttacagttaaggaaaacttaaaatatgtatccaaagataagttcaataggtttaaaaacccaaaatctggctgggcgcagtggctcatgcctgtaatcccagcactttgtgaggctgaggtgggtggatcacccgagttcaggagtttgaaaccagcctggccaacatggtgaaaccctgtccctactaaaaatacaaaaattagctgggcgtgatgacatacgcctgtagtcccagctactcgggaggctaaggcaggagaatcgcttgaacctgggaggtggaggttgcagtgagctgagatcctgccactgcactccagcctgggtgacagagcaagattccgtctccaataaataaatagatacatatatacatacacacccaatatcttgttcttattctttttaaactaaaaaaaaatatacacataactgtaggaagctttccttttcctttctgatagacacctttgaaatattaacttggtcagattcaacccttcctatgtttttaagagtgctagccaatatgtattttgcttgtatatgcataagatttgtttacataatacacaagaagctgttaataatcgatcctttctagggcacgttttgaattttgaagcatacgaatcaattatcttttaaaatattttcaattaaaaaaagttctagggtggtactacaggcaaggtatgatggaagtgccacattctcaaagccactgaagagagccagttgaaagttagcaaatgagttagttgtttcatcaagaaatggaagtggtctgatttttttttttttccaaatcaaataatgcagtacagtgcaaattcttgaaagatacttttattttcaaattgtacttggaagttcttcttattctgattctgttgagcagtgcaataggattacattggtagtataattgaataaggctctgtacagaaaaactataaaaaacaattgcctattgctttatttcctgagaaaaaaaattaccttttgataaaataagtagaaatgctgaaaagaatgtattcaagttagaagtatactccccactgaacacctctttcacatttctggcccatatagcagggatccccaacctccaagccacagactgcttccggtccatggcctgttaggaacctggtggcacagcaggaagtgagcagcaggcaagcgagcattaccacctgagctttatctcctgtcagatcagtgggactgtgaatcctattgtgaactgtgcatgcgaggcatctaggttgtgcactccttatgagaatctaatgcctgatgatctgaggtggtttcatcccaaaaccaacccctctccccaccatccatggaaaaattgtcttccatgaagccagtccctggtgccaaaaaggttggggaccactgctgtatagctacaacactcaagaatacatggcagttccatttaaattttaaaaattgaatgtctttggtttaaaatattgaatggttttaaatattccttataatgcaagaccacatcttaagctacaatggagggtaaaggacaaaggctatatttgaaaagtagaaaggaaatacaagagttttcagttaaattggaagattttttttaaaaaaaacctcaaacattttctaaaccctcaaattattcctaagatgcattcaactttgaatacattgataaaattcattgcttgacaaagttgcctatatttttcattgaattgggcagtggtgtgattgaattggccaaatcagaacctagagtgagcattctataaactcacctttactttgatccttgaagatcacaagttttgatactgttgaaatctctactctttcaacactttaattaaatggcatttagaatttcatatacttctgttgttgtttccacaatcttaaactggatttagaaatacttataatgtaaatgcaagagctttaacttagtaactgtatttcctattttttgttgtttttcttttgccagaatttctgtttgtctacaataaagtccagcgaaatacagtatttggttaggttacttgttaacataaaattttatcatttgtagagtttttacttaaccttcctattctctagtctctataatctttcaatgaagataaccagttacgaatatctcctataccatattaggcctgccagaatgtgatttcttggtataaagtgattttcaaatgttttcctaactcagtagccacttccatcatttatatctgagttatttcctctttttcttaatagagaaatgaattgatattcaagccaataattgatattcaagtgacatagttatgtcactaatgaaggtaacccatcctcagctaggaaaaaaaaaatatgtattttccaaaactgctgacttttactttgttgtcagtgaccttggagtcctggttctatactgtataggctgtgtgaccttatttcagttgagggtagaagagaaaaattatattgcaaaagtgggaaagaaacacacttataagattttcagtggaacttgagaggacttttcatttttctttttactataactcctcaaacagtatctaaaccttcaagttgttgtttctctccttctctaagcttcagtgctctcatttgtttcatggagataataaaaaacatctgtgcctcatctcatttatagcatggagacaatgacaatagatccacacctcaaacagtgtggagagggtgaaatgatgatgtagagagaaagcgtatcccagcacctgcatggtaaccactcagcacaagttatttgttattgttttaattggttacgaattgtattttacatataacctgtcctgtctggaataaatccattaccaatgaaaacttttaaataggaactccgtagatgataggttattcaataaagatctactggaaataaaactgttttccaaaataaaatatatagcggtgtgtgtgtgtgtgtgtgtgtgtgtgtgtgtgtgtgtatctgtgtgtgtacatacacattttaaaaaattgattctgttctcaatagcagaaaaaagtctttccactaccttaaacccacatttgactcaaatacactaacgatatgtaaccactgttcaaaggaaaagctgacggacattaggctgcggaatcctgcaatgcttgtgctcagcttgggcctgggtgtcaggataggaataggagatgccagacctgtttggtagtagtggtagtagtcattgcctaacctaggcaatcatcagctcatgggatttggtgctttaagcaaaggtgttaattattcccctcctcccttttagtaccattttctcttaaactaacacccatctttgggcttaactaagcagaaaagcaaacagggaagaaccaggtggttaaggaccagtgtcttaaagtaaatactctgtatttgagtccaaaatgaatttcaaactcaggttagatgtttcttcttaatcacttaggagccagtaagactctctaagccttccttcctacgctctttcactaaaggaccaggttctttcaggtgctatcctatttggaatttaatttgccctaacatttctccaagagccattacagcacaccacattgctgtatcccatttaactcccaaaccgcagagaagctggctgcagcatcaaacactattaaaaataccacaagggaaccttagagtgggatttcaggcacaagttacagcctaaggacaaacagcggttgtaaagagcttgaatgatactggaatggagatttaggagaattttcagagtctgaaaaaacagtccttaagattttagtgttggttcctagggctggttctccgtggttatatgggttagttaaaacattagagtaactttgcctttctccctctctcctcgagttttttttttttttttttttttttcggtcaacagatttggtaccaagagtgactacaagtgagaatggcttaacaaatatttccaagaagaggttcctatcactaggccttgcaaaggaacaacagactcattagatttttttttaacctgaatatctttattgtgccatctaagcacttatttgaaagtcttcaggtgtaatcctgattcagggtgtttaaaatgcaaatgcagaaattagcccagccatggctacacaagaggccccaggcatttcaaatttgaatgaatattttggaaatggagcagaaacttaatggattagtcattatttagagtcctgtcatgtgggaggtccaaattcagagccttagagcggggaggaatatgttatagtgtggtggtggcagcctcaaaataggtagtagtggtggtgaaggtggaggaggaatatgaggataaggatggtttttctgggtggaagaacaagaggaagagaagccagtacttgcctttcaagctctgcagtagtatcactgcaaactgagcacaacaatggaagaaatggcttctggcatccacttgctcattttctcttattggccaacatacttctggaatcttctcaaaagatccattctgacagactttttattttcccataaaattccaggagcatgtgtagactggacttctgggcttccattcttatagaatgtttccttcatataaaatgcttcagtttggaattttacattcagtacagattatttcattaatacagtgcatatctcccctgtcctggaccctagattataaggagtaagaatggggataatgcttctttttggtcatcaatgtatctcaagagctttgattagggcctggcacatggaagactctcaaaaaagtattgtttaaaaaaatgtctgaattgttaaatggacctggtctgaatatctaatccaaaggcaggcaattcatgggtttaccagcagccaataatctataatatttaaccacagtggaaagttacctcattgtatttgtaaatttgtaggctcaagttgcaattataaatgggaaattgcaactaaggtaattggtgtcaagagaaaaaaaaatttttaaatctactgatggcctaaaattgggcctagagaagctatggcaagccatgtacaaactcaggcaatgagaaagcagacactatggagagtagagaactatctctagaaaacaaaaaccagaccagatatataaataaacaaagggcagagtcctgagaaagacaccatatttactacaagcaaaagaagaagtttcaggtgcctagaactgtgatggttcccaaaacttctaaaccctagtccacctgtgtccatgtgagaatgacatttattttgatctagttatttctggtaaccgagctgatccagtgaggatattgtcatatggtgatgagggacgtttgtgaattactatgtaaagaaaagatgcttactctgtgccagtagcttgggaatctggaatcccttcctgtaagcctcagagtgtttccaggaaaagtcaccaaatagctttgattcaaggaaatgaatctcttctgtcctgtactggctgcttgaaaacatagtcacctgagtaatatgagtccaaagtactacattacatctcagtgtttcttgcaattgactaacatgtagaaattgtgcttggctgggatctcacagttatctggttggtttctgtctgctgcatggagctcacttcctggtagtgaccatagaaggaggcattatctttttccagtcactaaaaactatatgaacatcaacaataacctaatttgtgagctctctggcaggaatgaaattcctctttataatcactgatggtactccctgtgtatggcagcagagtgacacacgctgtcctagtggaacataccctcactttgccttgtgtttaaagctgggcaccacttctaccttagggagagagatggtgcgaaagcagaagtgaggaatcacagatgggacagagttggactgggtgatgctgcagtgaggaatgagggagcatgatgaaggaagaatgatataattttagggagctgggaatgaatagggtgaagagggagagaaaagaggagatttagacaaagaatgggaaacaagacaaataagggaaggagtgagggaagagactggaaaaagaagaggcagatataaggaaaggaaaaaggcaagagaatagagtagagaacatgtgaaaaggagaagatcggagaaaacaaatgaactgagataaaatttgagggaggcagcagagtgttgactgcagggtgtggaatctgaaatataactgccaagttttgaagcctggctccacagctttccagaataatgaccatgggacatatccctaaattctctgagcctcagtttcttcttctgtaaaatgggaataataattttacctaccttatgtgatcatgcatgcccagtcttagcacagtgtttggcacacagaattgttattattgaggttaaaagagagaaacaaagcaaagaaaataataaaatggaggaagtaggaaagagagatgttcagacagtggaaggatggaaaagaaatgtatttctgctaataattttaaccttagtttttccacattataatcaagatttctatgcctactatattgtttctacctgctttaataacagctggaaaaacatgttgagtatgaacataccttttttaaaggtatttttgtattaaaccagcctgtaatagtttgcaaaacagatgttcacatttccttgagttgaaattattccctagaaatgagtaagacgaaggatacatgaagctaaaccggtcatccaaaaaacggtttgtttatttgccctacctctttactgtattgactaggtcgtttgatgggattaactaaattgaccggttattttgaaatgtgttaacccaactgtaggctttagggaaaataaagcccctagtgttcttggtggtgtttctttccaagtttctctccacaacacaaaccacttccttttacttgaagtcattttgcttttctcattagtctcacagtccaggggctggtgttgagtgctgaggcagctctcagttcaagaccataaaacaacacaacaaaattagcccaaaacataaaaggaaagcactgtggagttgttcttctcctctcaagaaaaggaaagtggaagttagggcagataaagtatgagaaagagatcagagatctattcttgcataggggtggggaggtagaatgaatgaaaccacagcccaagtcagagggaaagaaaatggaaggagcaaaaacaacaaaaatcccccaccacctctctcgacattcatcacaacaactctctgtgcacctggcatggtgctgcacagttgtcagatcccaggcatgactccctagtgtttccatgaggctgaataaatagtgttctcacagactctccagtagcagcgggtgaaaggccaaccttcattgaccactataaggcttttcttaaatgctactcggacacaccaaaagaaatgttgtccttttcacaaaaacatgtccttgttcaggaccatgtaagttatttaaaataatggtcaatgaaacaaatatagcaatggtatcgcttctcacattttcctcattctgctcagagggctgacagagtggagaagatcatccatcatccacttctttcaagttactcccttctgccaaagggattaagagacacattttcatcccactttctcaaataggagaaaaagttttccatgctggtttctactgttccatgttttgctcttatattgcacccaagaatcatttcaagatgttctgagaagagatgtaaaagagtcagctgatcttccctacttcaggtctattgaacacaggtaagttggcatgacagtgccccagaaccacacactagtactatgtgtggttataacaaaagaattgctatactggtgggcagggtttttttttttgttgttgttgtttttttttaataaagaggcatagaccataatttttagagcaatttcattaggttatgctagaggtaggtttgggagaagagcctgactcggcctgaggaaggggactgggcttgaattttaggtgtcctctaaaatgagataaagtgaaccaggcaattatgagagagaagcgagttttagatggtgagaagagtacaagtaaatgaagacagttgtgaaacatggtgcacgtgggtggaaaaagtttgctgctgaaagagtcagccaggggctgggctggagaggaggtacaatacatatctggataggggctttgggtaccacacgaaagagatctgattttatcatggatgatgggaaggcttgaaaaggttttaagaagagtgacatttgcagattaatttttcaactacataaatttgctggcatcatggaaggccagagctaagaagaggtgcaacagagatcgaccatttaagaaagtagttctctaattttaaaaattatagtaagaaatacattttcatggcaaaatgtctgtgtgtgtttgcatgtctgtgggtgtatcaataattttataaaaccatatttatctttgatattatagatgtggttttatactcttattttttacgcaattctgtatcatatttttaaaataaaatgctaaatgcaactgacagtttcaaaaacactatttcaggtactagtactataattcaggggagagttggtgagtgcttgaactagggaaatattagcaggttagagaagagagcatggatttgatcaatagttataaaataaaataaaaattgtattcatttggggccgagcatggtggctcacacctgtaacctcagcactttggaggccaaggcaggaggatcacttgaggccaagaattcgagaccagcctggccaacatagtgaaacgctgtctctactaaaaatacaaaaattagctgggtgtgatggtgtacacctgtaataccagctacttgggaggctgaggcacaagaattgcttgaacccaggaggtggaggttacagtgagcttaaatcttgccactgcactccatcctgggcaacagagtgagacaactctgtttcaaaaatatatatagacagacagatagatttggtagaaggattcatgatttataagtttcgatcttggctaaaagtgtttcactaactgagataggaagaacagatttgcaaagaaatatgtgagtccagctctggacatattggatttgaagagttggatatcaatggacattgggcttttgtgtgaataaatttggaaattggggaagtgcctactctgagtagagacagagttttgggacccactttcataagatggaaaatacaactatgaggtacatgaaaacatctacagagtacacagagtgagaaaaccaattaatcaaaaagaacattctagaatactcacatttaagaggtaaagtggggaggaagagagaccatgaagaatagtgaaaagaagtattcagagcagcaagaagagtgtggaaacatctggaacaaaatggctcccaacaaaaacatgttgaataaatatttactcagtaaatgaacaaagaaagagtttaagaagaagaagcctctaagaactaagaagacaattaggagttcattggcaaccaagggagggcagctggaacagaggtgttgtgagaaagtcgtactacagtggactgcagactgaatagggatgaggaggtagagcaacttgactgaaaagagaagatcaagaactagctaaaggatcaataaagagttggctgaactttgctgtggtttgctgtgtattgtttttaagattgtgagagacatgaatggggaaagagccagaataaaagtaaagattgaagatgtgagagatagaaaggaaaacagacgaagcaaggacttgtgggagctgggaggagagaggatcaagggcccagatgcaggggttgacttagagcaggagggagaagggaaacgtcatccgctgagaccagaagggaggaagggattatggatgtcagtaagagacctatggataacatctatggcaagaggatgtaggagctgaggaagttcatgccttgacacagactttcttcaaaaagcaacaagttatttgctgaaaggagatgaagagctgctggtttgggaggcttaagagagaggacaggtttggaattagcatgaagaggactgagagaggggcacagcaggaactaactgtcaagtgctctgagagtccgatgaggtgacaggtcttgactttgttggaattccagcttgaagtgatgtgggattatttttcccaggaattcaggtaaggaagtggaaaaggcagactgtaaaactgacagagctggattttcccaaagtgagtaaggaggacaggatggcaagagattcgagagagactgggcaggccagagggagaggttaggagaagactcatttgcttaaaggagattgaaatccctgaactagagacttgccagaaaaaaaaaaaatatatatatatgtgtgtgtgtgtgtgtgtgtgtgtgtgtgtgtgtgtgtgtgtgtcttattctcttttgtggcagacactaaatttgagccaaggagatgtaagtagaagcattatgtgggatttctcagaagccttttctaaaaggagtgggtgtactattccttcttttttcctccttcttgctgctggccacttagttgtgatggctagggctcttgtagtcatctcagaccatgaagacaaagcctataatctagaaatgttaaaaaaattatctgaaagaagctctgggcccttggtgattttagagcagccacagcagccctggactgctcactctgaatttctggaaaaagaaatcaacttctgtcttgattgaagcacaattttaaaaaattgaaataaaaatattttatatatttatggtatacaacatgttttggtatatacagcgaaattttcaggactcatttactaaccatattctagctaaaagagaatatatacacagcaactagagaacgaatagagatttcttggaacagaatgctatctttctaccatgtaatgcctaagcagggcacatactttatagtaagcaaaaagctttgatctttgcaggagattatagactgcttttgatttgggtagagaagaaacaaaagtcaaatcttggatttcttcattaattaaaaaaaaaaaaaggcaaaataaagccacatgtatgttgttttttcccgtaaggtcaagcaaagacttctttatactttttgtgagaaaatgtattgaaaattaatgacattaatacccaggatggtacatttccattgcttcacaatttttttttctttctgaagggttagaatttccaccagtcagcataaaatggttaaaactgaagcctagtaaatcacttgtattgcattgttttcaaagtgactaaacagctgtagttttcaaggtcagccaaatcatctgccagggtcacacgtgtttcacatgtcaagtaacgtatatgggttcaattccatccaggatcctaaggaaaaagacatttgcaaacaagtgatccgaagacatttttctaaacaggtgctgtggttactgggataagagttactattgtaaaccacttgaatttacgactaagtttccaatcatttaaaaagaatattcatttcaaattataatgtccaaaccaagaggaccagctcctgatcataatgacattcaatgaggacagaaagtaatattgtataattgttattattaccataatgacattgttcatgtacaaatgagaagaatgtatattgggtatcaaaataaaaccaaccaaacacataattaggatggaacctagttaaacagttgaagagaggagacttaaagcaacaagacttggctaatacttctccctccaattcttgctccaggaaacattgcatagaaacaaaagacatgactaccatatgccaataactgctttaacaagctggagtaattggtatcatggagccagactgatggaacaaagaaaggatgacctcaggatttaaagagtttagggacagaaaaacattttaaaaatccagtttaattcagaggatagttagagatgtctggctccaactgagagaaggaaagggtattgatttgcgtgagtggctctccattgggctcttctaactcaaaagagataattggccttgaatagtagcttttatattgaatttatattgagttctcttgatgttcttggtatgtgctcttcaaagcccaagaccactccctgatcttgtttatatttgctagtcctaatgatctttcatgtgtcagacgtgctgaatgaagacgattgccttctgatcatttaactcttctctgccagtttcaaggttggcttccatattttagcaagcaaaataataggcatctccaagtcacagtatgcagacaggaatagacaaatacccactttagctaagtatgggctgcagtcaagctggaaaaggtctctcagctctgagtcacttatacaatcgagtccctgaacatgtttctgtccctaatattttgttgctctgggcaaccatcaagtccacatgaagacttctgccaactggagaggatgactagataggagtgccagaattttcttttaactctttgttgaaaactcaaaatagcaaatggtgtcaaggatatcccctaaacatccagattggaaaaagtggaattcacacattgccttggtatcttttattcacttcttagggaaatatgactaaagaagataaaggcaattcatcagaggcatgcatttttttataataataaaatattaggaaaaagttagatgattaggtactatttaatccaatatcatcattttacagaacacaacccaggttaaattactgaccaaaaattacacagagagctaggcagagctgggattatacccctggtcttaaaaccctgaggtcattgctctttcctggactttcagaagcccagtgccagaggcaaagtgaagaaatgttaagaaatcacaagtgatcacctctcttttgtaatagcaaacggttctagttgaaaagggctgctttgctgggatactggaagcaatcctaaagctctggagtagttatcacccattaacactcccaatacagaaagtgtgactatggcacattaaactaaagcatctaaagagtgttcaaggcccaacaaaaataccatgtttgctggaagccttcattgcttattattctaatttggtctttgcctcctctgaattcttacgatactctgtggtacagtcctgagactacttaagattttttgcccaggctggagtgctgtgatcatagctcattgcagcctagacctcttgggctcaagcaaccctcctatctcaactcccccagtagctaggactacaggcatgtgccaccatgcctggctaatttttgtattttttttttgtagagaaaaggtttcatcatgttgcccaggctggtctgaaattcctaggctcaagtgatcctcctgcctcagcctcccaaagtgctgcgattagaggtgtgagccaccacacctagacagtttcttttgcacatgtacaattatattgtgtcaagtccttgggggtaggactatatcttattcatttttgttttcttgaaacccagagcacagaattaaacatattttggttgattttattttctctagaggtacagtgacgacttacttatccagattaattatccaggaatttatactattcaaaatcagtaagtaggtgaaaagaacccagaaaagtcaagtaaacacttgtaggatcttgttcactttatgcatctcatatcctaaaggtctacctcagaaatgaattgccctcaaccttcacttttattttgaattaatttacctttattttatgctcaatgcaatagcttggtaatcaggtttgccaaggaaaaagcagcagcagctcacaaaagatgccaataaagccaagcttagtaacatcatgaactgaccaccagacaatatgggacagcagatgagaaattaaagtgcagccagatttgctgctcgttactgtaggggaaaaaaaagtcctcatagatcattagctcctaagtgcatttgtgaatgacagggaagtacaaaagcagatgttcatgaggaaccagagccagcaaaaatgatttaattacattcagtgtacacctttaagaggttaagaataagcataacacctttcagagattttcatgaatattcaatatacaggacattttctcttaaatgaaatgtaggaaatctaaggatggagataaactagccttaaattcagccttagaatccaggtcttaacctatgtttatcctacatataatacgaaggattataaattttcacacattatcagaagcattttacacctactcagtaaaatcatatgattagcagttatgaaatcctatacatttatcctccttatattttttgtaactatctcttcctttttattctggctatctagctatctagtgtacaacctttattacatcttatgcttgaatatcgctgttgtctttgagttggtttcaaaacctcggatttttttttccttcattagctgcattaaaaaaaagaaatttccaggtgattattattatcttctgtagaaacaggatctcactgcgctgcccaggctagtctggaactcttggcctcaagtgatcctctggccttgacctgctaaagtgctgggattacaggtgtgaggcaccacgcctgccccccaaggtgattttaaggaacagacaaatttgtgaaccactatccctaagtgcttagcacaccattcatttcactcttaattatatccttcaatggaactaactcccttagtggcaggcgtaatatgcctgtgatttctgagcttagatgctctttaaaaatagttgtttttggccgggtgtggtggctcacgcctgtaatcccagcactttgggaggccgagatgggtggatcatgaggtcaggagttcaagaccagcctgaccaacatggtgaaaccctgtctctactaaaaatgcaaaaattagccaggcatggtgacgtgtgcctgtaatcccagctactcaggaggctgaggcaggagaatcacttgaatccaggaggtggaggttgcagtgagccgaattgcgccattgcactccagcctgggcaacagagagagactccgtcccacctcccacccccgccaacaaaaaagttttttcatattcattgtgttagcccaaaatatctgagacaggtctcaatcagtttagaaagtgtattttgccaaagttaaggatgcacgtgtgacactgcctcaggtggtcctgaagacatgtgcccaaggtggtcaggctacagcttgtttttgtacattttaggaagaaataatacatcaatcaatacatgtaagatttacactggttctatctggaaagctggaaagcgggaaaactcaaagttgggggagggcttcgaggtcacaggtagatttcaacatattctgattagcaattggttgaaagagttattatcagtagaaaggaatgtctgggttaagataaaagttgtggagaccaaaggtttattaggcagatgaagcctccaggtagcaggcttccaagaaaagagatcctaaatgtttcttatcagacttaaggtctgtggtgatgttaatactggaggggtaaaataaggcatgtctgacttcctttgcggcctaaatcagtctttcaggttaaattttaaagtgccctggccaaggaggaagtccattcaggtgagggtgcaggcgtgcttcaaattttatttttagtttacaactgttagcgaaaagtacgtcctctcaatttccgttttccccctgtatttacttaagaactattttccagttccttctatatcttgctttgcatctccagcaaagagatactaaagttttctcttggtcttcttttcagaggtgcggtttgatgattacgcacaaagagacaaagataatgagtgggggtagacctgctagcttaactttttcttttagagaagcacctaaggggatctgtcacatggatgaatctacccttctttgaaggtctgatttgaaagcagattggactacattctgcacaaaggcattttaaacatgcaggtgtgaatgccccaaataacaatactttgaacttttacagaacctttcatccagtgataccaaaacaattcagtttattaaaggcctaggaagctggggacaaaacatccaattgatctatatatggaaatttattgcattaacttggttggtgattcctttcaagtctcccaacgctggggcatataagcagagaaaactgtacggtttctgcaagctacctctccaaattgtaatattttccatttccaactcctcaagaagagctaatcctcttcttttcacatttatgcttaattagagagttaccagttcacagacagttatttatgttcagaacctaataaattcttgtttctgccttaatttgaccaaggattgccttctatgtcatgttctaaagaagcccattgaacaaataaataaaaacagacttcacctgtagtgagggagaactattatctaatcaatttttcattttaaaaattaaatacttcaaaattggctgggtgtgatggcccacacctgtaatcccagcactttgggaggccaaggcaggagaatcacttgagcccaggagtgcaagactagcctgggcaacatcgtgagatcctgtctctaaaaaaaaaaaaaaaaattaaaaattagccaggtatggtggtgcagtgctatgtgcctgtagtcccaggtagacaggaggatgaggtgggaggattgcttgagcccaggaggtcgaggctgcagtgagctgtgattgtgccaccgcaatctagcctgagcaaaaagtgagaccctgcatcaaaaaaaaaaaaaattgtaattaaatcttatttttaatctgagagcatagatttaagttgccctgaatatacactctcacttatctaattgattttttttttttcttcgaggcagagtcttgctctgtcacccaggttggagtacagtggcatgatctcacctctgcctcccgggttcaagccattttcgtgcctcagcttcccaagtagctgggattacaggcatgtgccaccatgcctccatgcctggctacttttttttttttttttcagtagagacgggggtttcaccatgttgcccaggctgatcttgaactcctggcctcaatcgatccgcctgcctcggccacccaaagtgctgtgggattacaggtgtgagccaccgtgcctggccaatcgaattgatttttaaatgaacaatctttttttttttttttttgagacagtttcactttttgcctaggctgaagtgcaatggcgcgatctcagctcaccacaacctctgcctcccaggttcaagcgattctcctgcctcagtctcccgagtagccgggattacaggcatgtgccaccacgcctggctaattttgtatttttaatagagacggggtttctccatgttggccaggctggtctcgaactcctgacctcaggtgatccgcccctccttggcctcccaaaatgctggataacaggcgtgagccaccgctcctggtccttaaatgaacaatctatcgtacaaatctgttggatacctctactttttaccatatatctttcaaaaaacttacaaatttaatcttttcctcttttccaccttctgacttccttattatatacattgcagtgaactcaggacagctaagattcagagtggcaactggggtatattcctattttcccatattttaaatctgctgtaaaggaaatagttgttatgagcaaaatgtgtctgaggaatgtttatcagactatcgtttttatttggcattgtcccagcatattagtttttaatttttttgccccatttcaatggtgactttgatgttttgttttgaccagctgctgagctttttgtggctgtccatttacatcactttaaaaaatggtacataaatgaaatttgaacaaaatgaacagtactttaacattgtttcaaaatcaaatatcttcctaaggaatctgatttgtggcagatggagaacaaaaccttccagagggagggctgttaaatgagtcttaattgcttgcacatgaaaatattgtgactaagattgtgtgcacaattaggaatttaaacatgtagaaaagaactggccatagaaacaggcagacatttttgcagtcagagctagtttcttgtgaacacagacaataaagacaagtcagtaaaggaaaataatttcaagagaaattcagttgttttctttacttcattgttgcttacattgagcttccaattctaaagatgattcatttgccttggaaactcactgatggaagtatcacagtacagtcaagaaaaaaatgtttattcaagaactagtatttcttttttagttcctactatgcgtcagatgctaggtttcgtgcttaattcacttcatttaattcttacttaatgctctgagataggtttgctattattcccgtcttctaatgagaaatcaaggctcagagaataactttcccaaagtcaaatagctaacaaatagtgcagccaggattctctgtattgatttaatgaatccaccctctgacaatgcctcactgctcccctgggaaaaagcacatatcttttttttaaaaaaatgatttaataaacttattctaagagcgcctatactttgttctgagtcaataatgccttccttctgttggatggcatgatgtaggttgctaggctggacttgttaaacgttgggtaaggaaggcatgattgcacccaggcgaagtgaatggctacgcagagggcacagataatctgaataggggttgggctgagatgacagatttagagacagaggccaggacttcctacaggggccacacgtcacggcgtcttgtatagaaccaagcataaaagaggcatcaataaatgtgtgtggatcaaatgatgagatggtcaaattatttttgtgccttcagaggaactgagttctcaggatacattaatgacaggtaccatctggatctctaaaaaaaatgagtatcataaaaagaaattcagtgagaaataaattaataaaataaatagtgcattgaaaccaatcctactagcatttatttcccctatctaagagcaccctaatttctttcaggaatatactttgtatccctattagataatcttaataatagttaaccagcaatgatcaagtgcttactgtgagccatgcattttgcttcatttttcataaatatctttttttttcctaagacagagtcttcctctgttatccaggctggagtgcagtggcacgatctcagcttactgcaacctctgcctcccaggttcaagtgattctcctacctcagcctcccaaggagctgggattacaggtgtgcaacaccatgtctggctaatttttttgtgtttttagtagagacagggtttcaccatgttggccaggctggtctcaaactcctgacctcaggtgatctgcccgcctcagcctcccaaaatgctggaattacaggcgtgagcaaccatgcccagcctttcataaatatctcctcaaataattttcatgaactccctatgagataaatattattattgtgcttacttcaaaagtgaggaatttcaggctctggaaggttaaatgaattgtttgagcacaagcatctgtaagtcgtagtgctagaatatgaacccacaaaatctggtcccatcattcagctcttactaccacattttataacatagtttggtagaactgaagccacctgcctgttctcttttagccaaggcccaggacgcaaacaagacaaattagatcccttcactgctgtttgactcttgaaataatgacaaagaaactaagaacagttgtggggatctcactcgactactcctgccatgagactttccccttgatttgtagccttctagcactgtaaagatgcactgattccttcaaacctcgtcctccagcacccccaccaccacctgtcgccccactaattctcagggaattcagaattcttcctatattcttccactaagaattttgcattaatgagcagagttggtttttttgtattgcaagcaaaggatcattgctgagacaccattttctaaggggaggtgataagccagccaaggggagaattgtatggaatccccaaagaacaagatgcagacaacactgtttagtgtgccacaataatttaatagactcactgagaaataatagcatgacaaaaggccaggttaatttcctctgctgccctttctgtggaaatgatgaaggttcttgggctcctctctgatccactggtcttagatacattggccttctcctttatttccagtaccctcaacagtttccagtaaagagaaacagcaagggagggtctgtagaaagacagactgtcttgaggttggctgaggggtaaaagaaatttcccagaaattgctccttttccttcacaaactgcctagaattcagattttgtctccttcaaagttgcatctgggaaaatgtgtttatatgcttattccacacattgccatcattgtaatgattttagggctccctgtcttggaattgccttaaaagtccatgtgatacttcttaaaaaactctttaaaatcccttgagaatggtttcatttctggagttagccccatctaagctaatttgacattctgtctggtgaatagggttggtaatcatattggaaataatatttttggtcataagtgaagtgttactataaaccagtgagattgcttattgctttttggtatgtgtgtgtcttatatggtctgtaaatggtctctaaagccacttccaaaatgctttcagcaatggcatcagggctcaaataattgcacagtttccagagatggctgttttgaggatcaacagtaattgaataatataataatatttattggtagtttataatacttttcaacatattaagcactttccacatgcttttaaataagacctgacatttactatgtcccagacaccgtgctaatttttttacacagattatctcatgtaattcctcaaaattaggaaggtataattattacccaccacattttaacagaaaagatctaacacatcggcgtgacttttctaaggtcacacgtaaagtgggtgagcaggacagccagccacgaaaccccaattttctgacccctgagtcttgttcctcctccttcacatagattttgacttgtatgtcaaaacacaaaaacaaaacctaccaatgtttgagatttttttctatgggaggataaaacctaggtctgtctctgtagaagcaatattagtcaaataacagtcagtccactgtcagtgacttcagaggtatcttacttgtcattcaactctgaggtctcggtttcacgaccagttcttttctattttccttttggctattttgaaacatgtcttcttttaccaatctcagccctccactttctcatgctgtgaagtattccctaaatttctgaattattttcccaaaccattttcagtctctaagctaacactgtaggcagcttcttagctctttagaaaaacaatctcacctgcatctgctccattcttcctctctcccttcctttctctcttctttattttacttattcatttatccattcacttataagccctctgttttctattaacttaatgctttttgtcattcaacagaacacattttagctttttaagttccacaaacctctagagtaatggtcctgaagcttactggaggtattttattcatccttgggtccttggagcctaagcatagcctttcacatactagggactaaatgagtaaaagcaaagccaggaagaggcagaaatcaagttctctatgtggacagttctgtgttcaatatgcaaacatcagaaacatatccagaaaagaatgtcataaacacccatctgttttgtgtggcatatagaatacagtcaattagaaatacttccacaggaccaacagtgctgaaaaggaaccacaaaaaaacaaaacaaaacaaaacaaaaatacagaaggaagacggcacactagaaagcactggatatttaagcatcagaaatatctcaaggaagtgcattcaggacatggtgagctaggaaacttttgcctagcaatggtagctaagagatgataatggcatgaagagacttcacccaaagagaagattaatattcccagtagttggggcctgccctttcaggccttcgtggtaagtggtcccagaagcaaggtgagtgctaacgctgaagcactgcgttaccctggttcctccgaaacaccccatctgcctgacttctcacacacacctgggcctttccttgtcaatgctctgcccctgggcactctggtgacaacgggcacttcagaagagtcaggaagagaagtgtgggaattgaagaatcctataccccctggcaggaatcctttccttagcttatataactatagagagtttttagggtttcccaaagagtttctgtgcatccacagatcttatccctcctcttgtcctaccctccactcatatacattcaggaatagatggtatagatttgttttctgttctcaaaagaaaaaagaaaaagaaagagagagagagagggagggaaggagagagaaaaaaaagaagagagatgtccctagggaataacttttgaggaccagcacatccagcagcttgtgtatgtgtgtacatgccagtacattttaggagaggacttgacattctccctctgagtcaatccgtactttgtaattttctacctatgtatcttaatcaaattattcaacttgtctagcccagttttgcatctatgaagcaggaatagcaacggtgtctacctctttggatatcataaggtttaaaaagattactcatctagagtgtttggtacatttcaaatgtcagtaaatgttaacttttattaatattagtattaataatatatccaactgatttttaaagcattttttgagagaggctttttgatataacaaaagaaacgacgctgtgagtgcactccctatttatttagagttaaataattcagtgtaacatccaactagtaaaatttgggaaatgagcctcaaaggaattttcaacattttgccccaccacagtcactgtatttctgagtatgcctagaatattttttaaggctgaaatgggtgggaagcactttgtggagaaagggagtgactgaagaatgcagtttgtgtggttcttttattttttttttttcttttattagtttaaggagacttggtactgtgtccaagaagacaaaaagaatgcaattactaaacatttcccaaattccctccctcccacatccacaaaggtagatgtgatacttgattttcttctcagagacgagcaagctgctctacttaaaatcttgtatgtattttgagagataacagatgatgaccctgacgctgatgcccaggatgacgaagtcagcacagataataatatcaccttgtatcttctttcactaatcgtggagcactttgcacatatgatcgtgcttatcctgggctgcactgtttgttagatgagggtgtgggtgtcactatatatactttccagaaagacaggtattttccaacaagctatcatcaactcaatgacaacactgtacacaggcagccctctcacctgctttcttcagtattccattattctcccaaatttggccaatcaagcccattcacctgggagtatttgttaataatttagatcctgagccttatcctagacattcagttctggaaagtctgggaatcagtcattttgtggttgttctcaggaagcccttggggattcctttgatcagagacaggtttgggaagtattgctctttttaaactcagggcagcggggaagggatgctggcaggagtggactttggtgacactgagatcttttattcatgtggtagcttttcttactctgagacagagttttgctctgtagcccaggctagagtgcagtggcatgatcatggttcactgcagcatcaacttcctgggcataaatgatcctcctgaatagctgggattacaggtgtgcaccaccatgtctagctaatttttaaaattttttgtagagatggaggtctcactgtgtttcaggcttgcctcaaactcctggcctcaagccatcttcctcccttgcctcccaaagtgctggaattacaggtgtgagccactgcacccagccctaagggtagtttttctgatcatctgaaggataatacaacatttttgtcataggctcaataatccataaaatgctgccctatgtgagagatattattattttaaaatacagttaatgctggactgtggaaccataatattgaaatattgttagggcgggtctcaccagtgccctttctaggcaaggagaggcaaactaacaactgggacctgagaaataacatgtttgtcactagattcaatgtaaaatggtaaacctatctacctttgctaactactggtcaacaactaaaagtaacttaagttcaattcaatatacataattaaagtgcattaaatgtgtgcctattgcccacatggcactttattatgtattccttaaaatacaaacatttttccatattattaaaattttctcaaaaataaattatttaaaatcattttattatgggaattttttaacccctacctaaatagaattcacacattatttagaatttggattgtttttaaccctttatgcacattcacagtgctgtaatgaacatgtgtatatatactttcactttttttttttttttttgagatgaagtttctctcttgttgcccaggctagagtgcaatggtgccatctcggctcactgtaacctctgcctcctgggttcaagcaattctcctgcctcagcctccagagtagctgggattacaagcacgtgccaccacgcctggctaatttttgtatttttagtagagatggggtttcaccatgttggccaggctggtcttgaactcctgacctcaggtgatccacccgcctcagcctcccaaactgctgggattacaggcgtgagccaccacacctggctcatactttcactttaaaattgttcatcctcagtctctgctctaatcaacccccaagtcccttcaatcctatctctgaagagttgtgaacccattccctcatctccacagccccacttccaccccagttcagagctgcattatcttgatcctgtacaaggcctgtgacagccccctgaagagtatggggctgcccctagtctttcttcttttcaatctctttctacactgcttccaattactgtcattctgaaatgtgtatttgttcctacgattggaaatgctcaatgattttccactgtccataaaataaagtccactgttatttatgtaggcctcaaatattatttccttaatctacctctggagcatcctgttcagttgctcctatacacctttaactcaatttgtcctttactgttcccagtcccctgatatggacaggcattccatgcttccataccttattcttgctggtcttttgttgtgaggtaatcctcaatcctcccctaaccacatggaaagcattatgttcttcaaatttatcagggagcatttcctaggtagagccactggctctctctctctctatatatgaatacatattcatatatattatatattaaatatataatataattatttaatatatattttatatatttattttataataaacatatatatttatatgagaaatatatttattatataataagcatatatatgagaaatacattatataataaatattatatttatttatatgagaattatatttatatattatatatttatataataaatatatattatatatataataaatatatattatatatataataaatatatattatatatataatatatatatattatatatataataaatatatattatatatataataaatatatattatatatataataaatatatattatatatataataaatatataatattatatatatttatataatatatgtatataatatataatacatatataataaatatgtatataatatataataaatatataataaatatgtatataatatataataaatatatatttatacaatttataagaaatatatatttatataagaaatatatataattttataaaatatataatatataatatattatatattatatattttgtatatattatatataatatatatttatataaatatatatatttaaagaggtttcagtccaggctctgtggctcatgcctataatcccagcactttgggaggccaaggtgggcagattgcttgagcctaggagttccagatcagcctgggcaacacggcaaaacgccgcctctacaaaaaatacaaaaaataaaataaaaaattatgcacacgtggtggtgcatgcctgtagtcccagctactcaggaggctgaggtgggaggattgctggagactgggaggcggaggttgcaatgagacaagatcgtaccacttcactccagcctgggcaacagagtgaggccctatttctaaaaattaattaattaattaaaataaaaaatataaaggcttcaatcatggcatttagctagtacttaactatttataattccttctcccttactttgtaaatttcttgaaccagtagtcacattttacctccagagcgtatgcatgccatatataaggtgcatggaaaatactgttgaccaagcagataataataataataatattatagcaataatgataagtaacatttgttgaatacattctgagtaccaagtactatgttaagcactgaattagaatttactgataaagaatacccccaaaacttggagaatttaagtacattgaccaaaattagacaactactaagaggaaagctgggtttttaacatatatgctagctcatcacctttttgctaggctaaatgaacatgagccccatttaattatttcaattaaagttataacaaagcatccaaatcagatattcagacaagagagacacaattaaattatttcccctcataattaggacatagcccttgttttcactattcttaaaacaagtctaacttcaatcaattcctggtcaaaaagccacggtgtcagatctgatctttttatatattaataggtatggctctactcattaaataaaagcataaaaggccaaaacaaattcatttgtaagaaagagaactgacttttactgctctaaaagatcataagtttaactaataaatagtaatactccatgcatttatgcaaatctttcagttcaatgtttttaccggaagattctttttcaatgaggatttttgtaaaagtaaactccttcagcttaaaagatttaggaaatccgacagtcattagatgtattagatgctttatcagttttttattaaagctattaaacacaatgtatcatcagcatttttcgatcacatttcttaaaaagcttaatgaacacatatttctggcaattattaaagtgtggccacaatctttattctattaaaggaaaaaaagaactacagcatgaagctgctgcctgctggtggttgatgaggaagtagggcttctctggcaatggctgggtctcttgtcttccctatacactgacacaacacatgttttacttcagtatctcctgaggacttacatatttctctcatgtagatcccttttgccttctttatatggttcttgctcccatctattagatctctctatatttctttttaaaaaactatatatactacttgcttttatcacacacacacagatttaaaaggcagatctaagtaagtagccagcatccttattgtcaccatgaaatagttgcttagtttctttcattcgataagctcaaagcattaagtgattagcccagataacaaaaaaataattgtcccaattaaatatcattattgtttttcccccttattaattcttagaaactgcttgtgctttagaacaacaaacatataagattaaatttcttctcattgtgttttgacagactagcattatttggatagtttactttttaattttctacgtgccaattgactaaattctatttagaatgcacttactgtttttaatgaagccatgaatcttcagggtaaaaaaatacaaaaaggaatgaagacttagaccaatttacttatttatttattttctggactaaaaccacttctgtgctgttctatgcttgtcactgcatcatgtgtctccccctacaggtaaagagcaggcagctgtactagtttcaccgctcctgtagaagaatttgtattttccaaagtcaaaatccagaagtcttttgctttagggtgctggtctctatgcctctggggtataagcagtagatataatcaaaatagctataactacagagatatgtccagtgagaggttgggatgagaaattttcaagctcatatacaaataatacaatgccacatctattactcaggagttagtattaatacttcatttactttctctaaagcatatacttccacggtgggtataaaggccacccgaatctaatggtttattttactttataaaggtgtaagaaggaccatggactcgaaaaaggaaccacatgtttattcctggcattgtcactaagcagcaccctctctcactaggtctcagttttttcatctttaaaataaagatatttaaatacgttttctttagagttgtgtccttgcatgaaaatcctctaattgaggatgattaaataaacatattggaaatatggaaattcagaagcattgaaaatggtattgtgaagatgtaacatttaatgagatggctgcagaatgcttgccttgagctaaggttgttcgaaaatgaaatgcttacaaggaaggactgtgctccaagctacatggctgtacttcaaaaatgggatcactgtcccagtgcaggtatggcttgggcatctctgactctttgccaccctctcatgttccaatgcactctttacttctggtgtgcaccacacattaaggacgtatgtaggtgagccttactctaaatgataaaaggattactaaaaatgtcatgccatgactgtgtgaaaacaaaatcataaatgaaatgtaccaaagaagctgacataccaatattctctgttacctctattctaccagtttttaaattagctttaggaacaaaaaaatgtcaggcattgggacagggttataggaagaaacacttggtgagttcctcatcacattcggaactctatccatttttctttcttttttttttttttttttttttttttttgagacggtgtctcactctgtcacccaggccgaagagcagtggcctgatctcggctcactgcaacctccgccctcagagttcaagcgatttcctgtctcagcctcccgagtagctgggattacaggcacctgccaccacgcctggctaatttttgtattttaatagagacggggtttcaccatcttggccaggctggtcttgaactcctgacctggtgatccacccgccttggcctcccaaagtgctgggattacaggcatgagccaccatgcccggcctccatttttttttttttttttttttttttactttaggagacagggtctcattacattgcccaggctggtcttgaattcctgagctcaagcagtcctcccaccttggtctcctgagtagccgggattataggggtgtgccaccatgcccaacttgaactctatccttttatataacttatctccttgaattcttgcaacagtcctaagtgttaggtactcaaatctccaaaatgaggaaatgaagcaaaaaggagagactgggttcacattcaggctccaaatgccacacatcatctttgtcatatcacactaaagagcaaaagagctatttaagtctcttttataaatgcaaacttcaaagccttacttttaaggaattgttagatcattttagacctgtatgtttacctactatatattgaaataaaaactggccagtgacctacctttaaaacctagctttaaaaccctaatgctataaaatcaaactctcggccaggtgtggtggctcatgcctgtaatcccagcattttgggaggccaaggtgggtggatcacctgaggtcaggagttcaagaccatcctggctaacacagtgaaaccctgtctctactaaaaacacaaaaagttagccgggcgtggtggtgggcatctgtaatcccagctacttgggaggctgaggcaggagaattgcttgaacccaggaggcggaggttgcagtgagcctcagatcgcgccactgcactccagcctgggcgataagagcaaaactctatctcaagaaaaaaaaaaaaaaatcaaattctcctggctttaatacatgtcaaatgcaataaccttgaaaagaggaagagggtattgtaaattctatgtgacaactccttagaaagcatggtatgtgatatgtagactgctgaagttcttaactcttcttttttaaaaattagagttggtttacagaaaagtgatagagaattaatatttctccttcaaacaactatgactcaaaagtgagttcttagacttagaaattcatcctgaacaacagtgtatcatctctatcacaaagctaccagcgtctgtgaattgtgatgagaataaaggagacagtgctgggagcaggaggagaccccattttgatgggcacaaagcaagcgcatccattttggccaatttaaggacccacaagttttcctctcatgatcttgcaagcttgcctttctctcactgttccctttccttcgtttgtgtctttgtcctattctttccattacccccttgttacggaatgagtgcttgtgtgcccctaaaattcatttcaatatcctaacccaatatgtgttggtatttggaggccgggcctgtgggaggtgattaggtcgtgagggtggagcactcaacactcacaaatgagactagtgcctttacaaagggcactgatgcaacctagaagaagactctcaccagaccccaaccatgctggcatcctgatctcagacttccagcctccagaattgtgagaaataaatttgtgttgtctataagccacccagtctatggtactttgttatggcagcctgaattgatgaagaaacccctagttctatgtatacagtgggccctagaaacaaaaccaagtaataacaacaaaatggaatttaaaaagatgtattaagtgctggttctgtgaggcactatgctaagggcatcatgcgtgttcactcattcaagccagcaacaactgcaggaagcagtgtcactattttataggtagggaaactgagcagagaaagggtatgcaacctgcccagggccacaaagctctcatgatagagcatgatttgagtgctgggtaggcagagcaaccacgtggtataattctaggggcaccatgttgtgatgttctgtggagttgccctccggaggcacttggagctgtgtgctctagcagccttttggatcagccatgaacttaactgttaggctacactgttactctagaccttattcctatgttgagggatagacaggcatacatttgcgaacctgtacctggggcctctagtgagagaagccacatggaagctggtcctcatgctgctccaggcactaggtctgacccctatcaacagggacccattcatcttaagggtgcctcactgactctttttaatacttctttgcccttcccaggactactgccacagtacagccaggttccaacttcagggggagtgagcctagagggtggggcctgagtggtcagctgcagagggaggaaaggcacaagcactgccttttctgagtgtctcaaatcttactaatgtcaaaatctcaaccatcattattattactagcactgaggttttaagggcccactttttcaaaatgggctcagaaaggggaaccttcccctgctactgccctcatccctccatccctatgccatgttcccaccttggtttgctatgcttgggcaagaaaaacgacttcccagttttagtcagttcatttcctgttgtgctttgtgaggagcccagcagcactaagtggtaacaacagttaattagtttccctttctagataaggtatttctgtgtcccccttgtccctaggcctcaggtcaggagcttgtgggtacgaatgaggccatattcaccttaatttcttaatttctgtggctcataattccctctggtattgctccaggacccccttactatgtatacatttctaggagcttctatgaggtctgtcacatatgcttaagatcaagtgtgtgccctttgagtgtagctactctctcctgttaatctgtgcctggcatctgctgggatggctgggcagctgccctgaccactgagcacccaaccatctgttgtcagccacaacaatttccactggtacctgatgctgctcttctgggagaatgctgctccacctgtgaggccagctcatatgtgacctcaagctaaaaaagcttccagggaccaaaatagcactgcattctgcccaaatagcaatgtcagttcttgcttattgcaaaattgggggttgagggtagttcctcttgataggggtcagatttagtgcctggagcagcgtgaagaccagcttccatgtggcttctctcactagaggcctcaggtacaggttcataaatgtaggcctgtccattcctcaacttaggaaagtgcatagaaacagagggatccggttccacacctccaactcagtttagactcatttatgttgaatttgaattttggcagaagaaatcagttactcaaagtatttattttagcatataggaattgttattgttcatctctctttctctttattttttggagacagtcttactctgttgcccaggctggagtgcagtggcgcgatctcggctcactgcaacctctgcctcctgggttcaagcgattctcctgcctcagattcccgagtagcttggattacaggtgctcgccaccatgctaagttttgtatttttagtagagatggggtttcgccatgttggccaggctggtcttgaactcctggcctcaagtgatccacccaccttggcctcccaaagtgctgagattacaagcgtgagccaccactcctggccctattgttcatctcttgatcaatatcaagaacaaaactggttaaccatatatgtactataaaatgataattggaagtcatcaccaataatatgttgaaagagaaacatgaagaagagatcaataatttaacattcattgaaatacaagtttcacttgatgacattcagaaaagatgacattaacaatgattccagaatcaactctaatgtggtgaccacaaacacagacagacgtctggacatgataaagttaaatttcaagcaaagtgtactcactaataacttaataagagctcctcagcacattatgggttggagctcaaggaagacacttgaatccaatgacgaattgttttagtttggagaatatgctaattttcttctggtaataattttagaaaacataggttttcttttccaggcaattattttaatgaatcaattggggtttcaagaaatagtcaaaagagttcaatttggtttcaggttcagcaaaatgagatcatgcattctgtttttggttcagctggggtcaagtcctgtgcctaaaacagactaataggaattgagataattttatttttatgcacttggctcctctcatctttcctcctatttttctttcccaaacatctatagatcccaacgttttgatctcattgaactttttctgcattgtatattaacttctctcccctcccaaactgagtttattctcagctctctcagtcctttattggactactggtacaatgttgcttcctacacacaagtgggatattgatgaaccaacacgttactccttttatttatgccttcactcttattaaactaaatgatgacatattatatcatgctaataacacatgtgtggaaccagaatgggaagtgacttgaaagtaacatcatctctcaaaatacaaatgcccagagcaatgctcaaatgagtataagcacatagttaaatggttaaaaataatgtacatcagtaaaaaacgtaaatcggtaaaaatgttccaaataacagcttagacaatttgtgagatcaatgatagaaatgataatgtagagaagaaagaatttctttaacattttcaaattgcagcatgaaattggtgttggtgttatattgactcttggcagaaatggtttcttcctagacacatgaagaataagctccagatctttcttacctgttatggtggctttgttgatggatggttggttgcacatgggtgatcttctgacaaagacagaaaaacacaaagcagtaaatatgtggggcttattgatttgatcactctctgagtcatttcagatatagcattttactttaaagaattatttttaagtttggacacgcaaatgatttctttcagactagccagacaagtccctaggcgttctttgtattatggctcagatcacacatgtccaaaaagaaaactggtaaatctcacagtgattgatttggggtaaataaagctgatgtaagtgtcactgggacatgagagaagaggaaattcttacagactttattcgctgaagccagagcttatagactctgaatttgaaaaagcagtcaatttataattgtcttccctaatacagggttaagaaatttttattgttggcctaaattctcgtgattgcctgtacattatcagaagtgaatgatttgttgtaaactatcttataattagagaagctatttgaactttttcctttcttttcttatattgaaaaacacctctgatatatttgttagagaggtatattaatgacttgtccaaatagatactatagaagctttagaaatactctaagccaaaggtacttaaataaattatatcttgtgttctctaagttttcagatgtttgccaagttccacaaaatgactataaaccccttgaagtaaaaaaaaaaagcatgctgtctgattaacttatattccctacagagcctagcacaatgcatccagtattccgtcagtgcttaataaattatgttgaaaagaatatcatttataaagtatccatcaacatttttgaaatataactttataaagttattacttgtaactgacagcttttaaaatataatgattaaaaaacacttttagatacattcaaagatgtctgatatatatatatatatatatatatatattaggtatataataattatatatatattgcctctaccaagggtgaacacttaataaacacttcttgtggatcagacattgctaaataagtactttaaatgaattatctcattgaatccttacaataagccttaaggaagtaagtttcattgttctcattttaccaatgagaaaaacaaaactttgagaatttgaagaacttgttttaagtaacgaagctgagatttgaactaaacgaatgtgatcctagggtctatgctctgctttgctgccttagtttgagatgtttttgtggaacctgcatgcacagcctcacatatgtgccaatggcatcaatctcttcaaatatgccttgctgagatgatgaatttcttagcagggtgggggaaagttggggaaagcagcctgggattttgtaaattctcactggttccactcagcctctggctccctttcattgctcctaaggttattggtatcgatttgggattaaaattttgtgtttgattgaaaatgcaccaaattttacttctgaattattttagttttttttagttataaaataaaatggttgggggaaaaatggggagaatttaaactcgataaaccaaaatattaatattttaagcagctgctctgaaatagctctggtctatataccagtaattatcttcttcttcttaaatttttttttttttaaagttttgagatagggtctcactctgttgctcaggctggagtgcagtggtgtgatcatagctcactacagcctagaactcctgagctctagtgattccccccaccacctcagcctctcaagtagctgggactacaggtgcatgccaccatgcttggctaattaatttttttttttttagagatggggtcttgctgtgtgtaacagggtgttatctgttaccttctggctaagagtttatcattcaaataattgatatcctgattactcctttttagtccttgctctgtgaaaatttagaaaccattgattttgtctgggaatggtattaaataaatattttcacactcttctacagttttggaaaaccaaatggttgactcaattctaattatctccttttactatcaatcctacaattaactggtactcaggaacttgatatctgaacaagtaatggcaagcagaaaatattaatactttgatccatggttgcctcgatacctcctctaatgacagatgagccagaactcacttctggaataaaaaatctcaagggcaaaacaaaaacaaaaaacccaaggtgacaagaagcagtaatgtgttaacaagtcagcaatgtgcatctgaatacccacccaggggctgggtttggaatgcattcttcctagactccttttctgcagcaaataaaaagggtggcttgtgcaaaggagcacatgccttccataaaatccaaggatgagcttggaaatgttctagtggctctgtgagtgcccagcaggaaaggttctgattctcccagggtcatcatgtgatgaggcagagttacagcactttgttctcactgaacagaatcgagtttagccgtgaatagattgaatcctactattctgatacccaaagaagccgatttggtttgaatcagtaatggaggcacaaatttgcattgaccaaaaggaagaccacagtggcctttacttagagtctgccagataatactgtttggttagatgtcaccctgggcattgacaaggcagagaggaagttcaggctcaagctatgattttctgttttcttctagctcctcctttccatttcaatctgttccatccctgtatgtcagctgaaaacttctgtcttgcatagaaacaggcctcagatcgtctctggagcctgactgatcaactatttacctgccacagatttaaatgctggtacccaggtgaccacatgtaaaggaagcataaagggagtttcttgttcactttttaaagacaaaaatctcagtttcctgggtaaaattcgagactaaaaagtttgggagtgacaaccagttaacttcatttcttctgcagagctgagactttctaagggggaggtgattgaccttacaagctaccaaatccccaaagcccaagggggccgctgaggtcagtatgacattgcacggccacgttacatagaaaacgtgattggtaatgaacaggtacctcaaagcatgccctcagattttacatgctgagttactactttgccctttcagcgaacaggcctttgcagactgatagactctgcattatgctaggcacagggaatacaaatgtgaaccgactacattcctactcactgggaactgacagtgttcaggagcatcccaacagacaaacaggcaacaggagcacagagagctacgtgctaacataggaatcaagtacaaggtacaatcagacagagatggaaaggcacatcactttgattagggcttgtgggtgtgtgtctatgttgggtatcatcagggacaatgctccaagagaaattttatttaagctgcaaccaaaagaatgaatgacaattatcccagtagatgaggagaggaagaagaagatgagaagtattcaggctgagagaataggactgcaaaaattcattacctggaaaaacagaacctaatgggttccattccaatagcttgcattgttacatttatattgatttttaaaaacttttttctatcacaagaagtacttgaataacggccagagctatttttgataatgaaaaacgtgaatctgggaggtcaattttattactatgaaatgtaaagttcagatttctcattgtttttaagaagtagtaactactatgaaatgttatgcacttaggtaagttatagttcctaatacacttatatttactatcctcttaatatgatttaaatgttttttttccttctggaaaattatttgaagttggcattttaatattttatttcatattaatagcagattttttttaaaaaaatggacattgaaataacagcaaaccagttttccatttaatattgaaaaattacttttatctttttagatttttttgcctttatcaagaacctgaaatgataatcctttcccatctttcaaatgctttccctgttgtcatataaaccacaattctattaattgctccatgaatgctgctgatctgaaagtcagtaacagcaggagaatcaaagatctttgctatgatatggcgcttctccaaatcatcgttgtcttgagaggatgactttcagctgatcttaaggtgtgatgagattattcacccacggttaatttatgaagtaagccgaaactataaagttaccctgagtgtaaataactgggcggaggactgatcatgccaggtgatttctgacagatggaatcaccatatttatttgtcatactgcttcatttctgatattagaaccatcaccacgaagtatttatagaaaattaacaggacatcatatgacttagtatacacagacaacatggcaacaacacagagaagtctaacatattgccttgggctcaatcaagttgagaaaacttatttaaaagttcagcaaaaaagaggggggaaaaaaggatatcttacttgctaggtgctcgatcttgcaaattagttaatgcagcaaagttgtttcgtacagttcgcagactggccaagacctacaacaagaaaggattcttgaaacttcttgagctaaggccattttaaatacacttgaaaatggtttgttaagagaaaacttgatattgcttgcaacttagtttcatataccactaaagaatctcccaacacttagtgcagtttgtaggtatccacacgaaatccagagaggccagactgcagaaattttccagaaatccctccacattgtctatgcacatggtgacagtagcagcagtttccacagtatttctgggttccttagtcaccaagacaatattccaggcaatacacagataacatgattgcatttttgcacatttcaaatagtataatataaaatgctaataaagctcactttagggataaaaaattccctactcccaaatctcttcaaaaattgatgaagaatctcataataataagttggcaagtgaagtgaattttaaactgtttttctacctttgccacatggctactctagctagtaagcagacattgttttcttttgttaaggttatctgaattgtgcattgtaagaagctctcagggatgcgtttcttatgtaaaatgctacgccctgtacatgcacaatgcttggcacacagaagatactcaataaaaatttgttgactaaatgaatacatagacacaacatgcccacacacataacaaggcaggaccaataggtgtcactatctctaacagtcgctttttctaattccagttggaactagaaagtagccaacggactggaagtgagcctaggagaaggttcctagagccttatctccttcttccctcctctctttctcctgaaatgggcaagtttccccagggtcaaacccatattagatgggattataggtgatttgggtgacagctagagtgctaagtttatgtaaaacacagattccaaatgtctgagtaggtattacctaacaacccagactgtctggctctgttatgtagtaaatgtgtgaacttggactagatatgcaacctctttgtacctcagcttcctaacctggaaaactgggatagtgatacctacctcgtagaattgttgtgaggagtatatggaatgacaggtttggtgccaagaacagtgcctggcaaatagaaagcattcagccaatattagcccatgatggcagcgttacctttgacttaatgacttggcatgcacttgggaaatttacttaatgcctagcattggtaattcaagagtctccaaagttttaattgcttcaaagtttccagagttgttttcagaaatgtttcatctggcacagacctagactaaaatcagtctaattttttttctaagacaaaaatgtcccagactctgttttgttgttgctgtttatgaaattgacattcatttgtgtaagtcaatggagagctgtgtacgccttgggacagtgacttagagaattttcccctaaaggagttaatgctgcttcctaagaagccaaccgtgattaactcagtcactggaaaaacctggctcattatctcatataaacaacccacggctctgaaaggtcacgctgcctatgatggagtattcaaatggccgactgctgacatcagaccacgatgtctttcattaggcatgaaatcttgaatgatgcagaagtaaatcggataaatgatccactgtcgttaaatcatgcaggcttaatttatgttttaagaagtgaatatcaaacatactaatggaaactttaagataaaatcattgcaccagctaattgatccccttcctaggcaaaatttttaaccctagaattctgagatttttattccaatacataatagttaagttcattgcagttgacagctgggtaaatagacatagaaatgcaggcaacttattttctatgatcatttgaagggaaacatcagtcatgaaaagaaaaattagttcatcaaagaaaaaatttctgtagaggagtttttgcctctattataataaacttctaatttaataagtaatctaatttaatattattttgtctttgtttttagtttaaaatttatgtatttttgtataatttatatcttcacatgcttcagaatttaaacaaaagagtataaagcaaaaagtctccccttcaatgattaagataaaaatcaaaattattattacttctgaaaagacgcaatagaaacagattaacctggggagggacactcaggggacattaaaatactgataactgttctatttcttaaactgttcattttagtattattctttatattttacataattacaagctatattcccttatatatatgaaatacttcaaaataaaaagtgaaaaaaggaatctgtcttccggtctctccttcagacaatcagctgcctggccactagcaatcaacttttaggttttctatcttaaagttgtttttgtacaaacactgttgcaataaataatcttgtagagaaattatttcctaggcatgccagtattagattatttattgtgtgtgtgtgggtttttttttcttttgcagcaggacaaactattttataaattttatgtttggtgttaactattatcttctacagtatgacatgtatgctattggcagaagtgtaaataacatttctagacaaatcttataagggggtgttgtcttgggcctcgctgactgactcttggtgtcgtcatcactgttatcactgtgttagtcttttaagctttcactttgcattgcagggcacaaagagggagcatctgttactgcaggctgtggggagaactataaacagttttactgaagcccctaagttaaagttccattgttctttgcttttgttcagggcagccctcacttcccctgaattcgactctttaagaactgtagtcaaagctttaaggctccttttacagttgtccttactccttaatgcttgctaaccaaaaagatccctgacgtttcttccacagagctcaatggttagaaaattaaggtcatttctttctcttctgccccaccaagcagaagtatagccagtcaatgtcaaaattacattgggaatgatgagaaatatatattccttaggaaggaaatactggtagttttacagaaaaattttagacaaagatggttcatgtattagcccatggggaaggattcaatgttatttacgtacactactctcggatcttcttaggtgcttctaaacatttattaaacaataagaatcactgaaaatagcaggaaaatacggttatcatttaacacttaaacagctgaacatcatagcctaaaaaaaaagaggaaaataaatggtttcgaggattgtttttcataaccatatacacttgttaccactagatggcggtaaaacacagaccatgaggttgaggtgccactggcggcggaggaagcggcgacccgcactgggagagattcattacttcggttttacctccggaaaaagctggagtcaagttatgcttatttacaaaatagaaaggtcatttttatgaaaagaaaacctctttccaggttatgttttgtttaaaccctatgaaattgctggtttgtacaccagaaaaggttgatagacaattttatatggttcgctcttaaaaagaacttagatgtccagaagatagtagttgtaatttaaattaattaaggctaaagaaaagctaaaaatttagcaccgactgaaacgaggtgactatcttctttcatagcctggcagggagggcctagcacagtctgcaagcttgaggatggtgatgaggccacaagatcgttgctgctgggtgaagtggctgagggacaggcaggaatatgagaatattggttatattttattaccaactaaatggtaatattctatagtattaataactactgcatttttatcctagaagtatcccaggtgctgtattttggttagagtaaaggtaaagagatgtagttgttcctaccccgtttttttttttgttttttttgtttttttttttttgagacggagttttgctcttgttgcccaggatggagtgcaatggcgcgatctcggctcactgcaacctctgcctcctgggttcaagttattctcccgcctctgtattttcaaatcagggatatctccttagtctgaatgaagtgagggtttctccagggatccagcataatgcttgggttttcctgttttctctttctttcatcagagtctacttcatttaacattacacacttccacatgaaaattctagtcaacttagagttttactacagggtagttgtgtcacaaatcctgggatcactgagcccggaggcagctgacagcagagaagagtttcctacagtttatcagcattgtgcctccttagtgctccttggcccccaagaactctggccaagaaaaaaaggtcagttgccgcgtgcactccagtgggattcctctctagccttcgtgctaaggaaacacccacaccaaaagatttcaacacaaacacaagagaatactttaacaattgaaataagaaaaatatttaaagctgtcactttttctgaggaccaaagggattctgagcttacaggggaaagcataagaaatcagaggtggaaaagagtttaggttaaacaccagcaagaatttctagccctgacagtgttttagacaatgggataaactatggagagatactataggatcctttctgaaaattactatccaagatgtttcaggctttagcctggccaaaaaagtgcaatctatctttgcacggcttcctaaattctcctctaatttaggattttgctcttttcacgtcaaaggaaaccatgatttggaaaccatgattcgtgttttggagatggactcaggcataaagaaatgagttctcaagaagaggcagaagatgagatggatttgggaggggatctttgaacaccttagacaggggaaggccatttttaggagccatgggacagaaaatatgcacagaaaaataaatctgaagggatataaaataaaatgtcagtagcagttattttggggtttggaattttagaaaattttccttttctttttcttattatttttctaaacttttatgcaaaaagtttttgttttgttttgtctttttgagaagcatagctttttcactggaatttagtgtgaaattccaattttcaaagcatgctgagaaaagagggtaattctttggcctacttggctaaatatttttctgagtgacttttctaaaatccattgttttctgtcctttggtgaaagcaattatggtatatcaggacaaattagattggtatcacttcaagtgacataagtatcttatatttttagttttaaatagttaatgctaaaatagcacttaccattaagtggtaagtgctttactttgtattaaagaaaatttgagaagttagtgattgggtcagcaaaacatgccaatcatgtccaacagggtttaagagaaggccactcaaacatactcactgggacttctctcttaacccctccccacagatgctctatgaagagtggtgaaactcttcagggcttaacagttttttgttttgttttgtttttaattctagtggggctttccaggtcttatactccagtaaaaggccatttgtgaaaaccatgatgaagccccttaaaaaaaatcggcagcctctcaagtaatgaccactctctacaaggtgttatgagtcacttagctaatcataagcaaagacttaatatactatgggattatttttaggcatcagatatgcctataaattatacagctgatttatattccaagttctaatttcaagtatattaagtacacatcttttttatttaaatagcttactaacatggactaaattacatatatgtgtgtatttcccaatatcttgaaattccattagttttttttccttggagattataggtacactacagaaaatatctaatcaggtaaaagactagatttccttggaatttaagagcactgatggcagggttcaagtccaatttactaatctatttgttgcagcttaataaatattacttgatgtaaaagaccatatatcatacacagaccttttttcatttgttattaaatatttatatatattttttcttataataatacctagatcatttggttagaaacaagaatagctacttgaatgaactcaaattggaatgattggttctatgtttgatgatgttacttacattgttatgccatattttgtctgttcacctctctctgaggtcttagatatagaattataagttttctttctttcctttttttttcttgacagagtcttgctctgtcacccaggctggagtgcagtggcatgatcttggctcactgcaacctccacctcccgggttcaagcaattatcctgcctcagcctcccaagtagctgggattacaggcacccgtcaccatgcctggctaatttttttgtatttttagtagagacagggtttcatcaagttggccaggctggtctcgaactcctgacctcaggtgatccacccacctcagcttcccaaagtgctgggattacaggtacgagccaccgcacccggccataagttttcaatagtaatcaattaaaaaccctcagctttataagattttgctatcacatcatattattaaatcatacaagtgtaaattttttggacacagaaatacaggtactagaaagaattcataatctccagcaaaaccttcagcaaacaagatattaaccatctgaaaaggatggtgattgtattttatttttaattgcctgcattaatttaaaaagttactattatacattatgttacttatgaattgattatattataggtctaagttacagtaataaaagtttggaaagttttaaaaagtagaactatacataatcctactatctaaaccctattatccatttaaaaaataatacttatgacattttagaaatgaaagaacattttcagctctatacatttaaaccaatcacaaagtttttataatattatattttcaagcaattgtgcctagcattttataagcgtggtattatttcagtgtcttagcaatcttatgaggtgggtactcttggaactgttatttaacagaggaagagaccaggcttggaaaagttcagtgactcgctcaagtccattgagttggcaagaggcggtgaaagggttttaactagatctgactgtctttcatccagctcagtcccctaactctaccagttgaaaaaaaagaggacccagaaaatttaagtgagttgtccaaggtgcaagagcaccttgatgtatgatataggcctgattataatttttacaacctctcaggattacttgcattttaatatttaacatttcttactcatcagtgttggttttaaacctgcttcatgccccaggttaaatcagttttatctcattccgcccttagttgtctataccagagactctcaacttctcctgcacactagaaaaatactaaggcctttaacaaatacagatgcttgtaacagatctccaaatttttggatttaattgaccagggctgcagcctgggcactgggataagaggtctctaggttaatctaacgtgcaggtagggttgagaagtattggtctatacatagaacatctggtcatcaactctttcatatttatattcccaaacattttagatcatgttatcacctgcttgcacatatgtcatgtggttaaagtattttcatgatttgtatgcctagaaggaagaagtaaacatcaacacatcactcagctaaatctctgcacaaatggcatatgtaaaaaagagataaataaggtattgggttgaattggaatattgaatttcaagcactgatcatgtacctaattatactaaacataacttaagccatgatatagccttctgcttctagtgcttatgtcagtatgagcccaattaagtatatcccttagctaatttattatttgaagcaaagacactctttggtactatgggtttataggaaacagattaatatagccaaagtcactttctctagcattgcttttgaattgcttgaatgaaccaagaatttgtatttgtacttgtgcttgatttaaaattaaattaaattaataacccgaactaattccccaaattaaatttttacatctgtgagaaacctgcccattcaccaagctgtgcttacctgagcaaatggagtcacaatcaagtcatctccgtgtctgaaaaataaaccaaatcccgcattagaaatcatcaataactctgtgctcagtgtcgttcaatattaaacggcaagttccactttcatgagttcccatagagaattacagtgattccatccttatacttcagcacatgttcttcccagcaactgggttaaaaatatgtcttctgggatgttaacaattgtccaactccctgggtaaaaagaggggcttcttgatcatcagccagggtcactgttgctttttaggcacacaggatatgcaatagtagaaatggtgttccagcagtggggcctgagttttacttttggcctcttactgtagatattagtaaggggtgctgtggaaggaaccagcaatgcagtgacttcagtgagagaacccttgaccatctaatatttgaaggtgattagcatggagtgttccacatcatcccgtgtaagtcttggacaggctaggaactgtagatgacatgggactgcatcatacactaataaaaacccagtgaaatgttcaactgactcatcccagccactgtagtcactgggaaatgttactccttgtgtgctgttgctgcagcaaccccagctacaccgtgcctggggtatgggagcaaggtgtcagcatgacgtgtcttggagggacagggaagggcaaggaaagttgtgcaacattccagttagaggaaagtgagaaactggggcccagggttcttttgtggtatttcttagcatgaataatttgagacaaggatttccagagtcaccatcagctatttcttgatctagctagataaaattcttaaatcaaaagtgaatgctgttattcaacacagacagctccctggacatggccctgagaacagtgcaaataaacttttcgctcactcatgaacaatctgaaaacaacctgagtgacccaaaacaacacccatgaaacatgctggggcacagggagcatatggatgatgttactcaataaattgttaccaatagctagaataggtgctgtggtcgtcatcaaaccatgtggagatcttgaaaataaaaatgtgggaaataaaagcagaagaaggaaaaaacaatgtaaaggaagcatgtgttattttacacccccttagttccagaatcatgtttttcaaggggcacctgctctttgtagagattattcatagaactctagaactctaagaaggtaggacattgggttttatgatcattttatagaagaggcaactgaggttcagagagggcataaggtctaaaaactaataagtggtagaggcaggatgtcaattgaaaaaggtattttcccatgttgatgtttaattgccattgcaacagtattaagaggtgggggcctgtgagaagtaattaggtcaggagggcttcacactcatgaatgaattaatgctgttatggtgggagggggttagttatcataagagtgggttgttataaagtgagcccagcccctcatgttttctcttttgcatgtgctcacttgcccttccatttttccattgtttgggatgatgcatcccaaatatcctaatcagatgctgatgccatgtccttgaactacccagcctctagaactgtaagatataaacttcttttctatataaattaccctgtctatgctattctgttatagcaacagaaactggactaagatagtgttcttctgtcatcaataaataatttacataatttaccttgactctcaaaaaaaaaaggtcttctgaggtcaagcccagaaaggctctttcctagaacaatggcccagggtaggagcaggcctggtgcactgaagtggcaaggaggccattgagcccgtgggagccagcagagagggatgaagccaaggaggcagagcagctgcctagatgagaaagaagcagatacagagctgcaacgagaagctcggtgattctagagaatgccatggaaggcaggaaattcagaatcatgggtggtaacgagccaggcagcagatcacagagcccttgtatgaaatgtacaagaacttggattttactctctgatggaagtttgggttggaatttcagctctgccacatactaggtgtgtgaaattgtgcaagttattaaacttcactttcccttggcctcttcatctgtaaaatggagataacagcacatacatagagtgatgttttgggattcaataaattaataatgttaagtgctgaaaaatgtgcttaccacacagtaaatgttcaataaacatttctataataataattagcagcagtagtaaaaccttttaaatcataatgatttttgctttcctatgcagtcaggaaattgcaaagactcagaaaactgatacttcgctaagaaggactcttgagaccctgtgacaggtctataaaagattgagggctttaaaggggcaaaaatggaagcagggagaccagtgtagagaaaagaagagatgaggacctaaactaaatcagtggtagttgagagagagagagagagggacgatgacagcattaaaagctctgggggaaagaaaaagttctggggaaaaaaagatatgaaaatttcaagcatttacaaaagtaaaaagaatgttatcacagcaagtgtattttatatacaatcatcagctgttacaacaatgttgcaaggtaggtgacattactcccatttttcagatgagaaaattgtagctcaaattgattaagagatttaacacaaagacacgcaggtagtaagctgcacagccatacctggaatggtccccttttgtgatatgcattggctgattcctatggaacagcttaaaaagattaaaaataaagctctaggaaaatggcccaataaatgcaaattacaaagtgatgccagggttggccagctacatttcttccttggcccatcattctgactttcccttctggctgtgtcatataggtaaatatagggctgcaatttctcttatgtacttattttgaaacagtagcctaactctcacaaaacaactgagaaatatttacagatacaccagtgtttaaaaagcatgaagacaaaatccagagctaaacacttcagcatttgacaaatttctacacacataaaggcacctttagagttcatttgaagccaaacattcttgggagtggtggacaaatcagtaaactgtgtagtgtgttagaagtccgaagacaaaaaacattttcaataggtgtatatactacatatattgcattcaagatagttcaatggtttctgacattaaaaaatgttattaaaaattccataatgggaggtatattacacaaggagaaaagacatgccacctatgccgacttgatttgccagtctgataaactattcatctgcttcagtgcatggccaagctgaagacattgtattgtaaaatggatgagaggcagttcagataaccaaaattaaaataatatgacatcttcttattgtcccaagctatagtctcttctttcattttattctttataattgacctactataaagtttatttttttcaggactaagtcatcttgacaaggcacatcatcaatctgaaatgaatccatggaaatatgtctcctaattttttatatagattgcagtggatttgaatctttcaaaactcaaaagggttgcatatttattaaaacatttaattttctctttggttgtatctcctttataagtattataagtaatacactttacaatatttatgataatttaccagccttttttccctatgaaagcataaagacagttatcattttagtgaaggaaatatattactttttaataaattgcccagaaattgtttctgccaaatatctcaagatggtctcattttagtaacagtaaaatgatacctagcatttcagtggcagatgtcctcgataaacggcaggttatagcctatccatttattttcaaaagtatgtcatgcttaaattatctttgaatatatacctaacatataattttaaaatctttgtctaagtcctcaactcaatattaaaacagatcttttcagacatactgtcactaggagaataaggcaagtaaaacctatttttatttgtggttagaagaaaataaatataatacaaacatatctttgaattgtgtcttacactttgcttataatcatttaaaaacagatctggtagttaagatcaacagaagattcactttgtgaatatgatttggtttaaagtatgtgtgggttttaatgaactgaataatcacatatgctcaaaaaaatcctatgaaataaaataattctgaaatcttgcacctgaacaactttacccacagaagctttttaaagcgccttgccacgtaaagtggggctgggagggattacaatacaatgtaataaattggggcttcctaggcctacttggctaaatatttttctgagtctcttctgagatgggaagagactattagggtctctataaagtgactgaaaagctagattcaaagtcacacagtgaatatcgcctggacattttgaaattgtaccgcctggtaatgtgaattttgggtgaggatgatgcaatactgtctttcatttaaataaaaacaattataacaacaacaacccttaacaaaaaacagctgtgatctgttttaaggaaaatacagctcttttaaaaaaaagaactggagtgttcatggaggacaggcggagaatgaatgagggataggaaggctcagaaaaaaagtcattttgacactgcgtgtctatatgtatgtatgtatgcacacatgtatacatgtatgtatgtatgcacatatgtatgtatgtgagagatgagattggtaccaaggtaacagtcacagcagaatgcaagtgcagaaacttctagaacagccaggatgagccactgtaggtcactgtgggagtcagtgtcacattggttttaaatttcatgatgtccaaggaggtgccacatgctctgtcaccttccctggttaccaggaagtgaaccagagtcatcttcactagtcctggcgagccttgtctctcccaaagagaaagacttgctgagtcctgagccagcgctgttgaaagcaggagaatacagggctcaacagtatactattgtctttttttttctcacaagagaaatgacagtagagtcaggaacttctattctctattccccctcccatccttcttctacttctgtattatttatcacgttattttctaccctttttctttctgtaataaggaaacagaaacaagcaagaaactaaaagcaagaaatccaaatgcccacactcttatggtgactttgttgagatccatatatggttcaagtacttaaaaatgaaaaagcctgttgtcatcttaaaaaaataagttcaaccaacatcagcacctgaaaatataatttcctatagaagttcatttcatgattggttgaaatcttaaacacactaggtggcaatctttatctgttttactattacgaaatcataaggaaaaggagatacagttaattagaagaaagtttttactttatggagcaaagacccctaatcctactatatttaaagcattagtggccatgtaagacccactgcttttgaatatcacacattgcaaattttagcatgacaaatgaatgcatgaactagcactgtgaaggagtcacaggctggggcttacgtttgaatctaatcctttttttttttttttcaatggcatggaggtttgctatgttgcccagactggccttgaactcctgggctgaagtgatcttcctgtctcagtctatggggtgcctaggattacaggtgtgcaccaccgcgctggccgaatggaatcttgtgcaaacttttttcatcttctgtgcttcactcactcttactagaaagatattctcctctgaagtttgtcaataggattaggaaattgataaacatatagaaaattaaaataatatttttgaaatatattttaaagtccaagattttgataattttgaaatcttagtatctttctttcctcagcctaaaaactatcatccatctatcaattcacccttgacaacttcttttagaattatagagaaacaagtatgttctaattttaaaatgaatataaaaatatttctgggagcctagactatttgacaacacccaaggattagctataggaggaccacgtctactcacaactctctagacccatcttcatagaagtatggacatataaaacaaacatataatgtaacctacttgatctttatgtgtgtgtatgtgtatatgtatatatacatacatgtacatatatacatacatctatatacacatgtacatatatacatatatgcatgtatatatacacacaggcacatatatacatatatacatacatgtatacatacaggcacatacatacatatatacacatgcatacatgcatgcaacatacatacatgcacatatacatacatgcacacacacgtatgtacacacatgcatgtacacacacgtatgcacacatacatgtatgtagacatacatgtatgcacacacatacatgcatgtagacatacatgtatgtacacgtatatgtatatataagtatacacgtgtatgtatatatgtatacatacacgtgtatgtatagatacacgtgtatgtatacatacatatgtgtatgtacagctacacgtatacatacatatgtgtatgtacagctacaagtatacatacatatgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagatacacgtatacatacacgtgtatgtacagatacacgtatacatacatatgtgtatgtatagatacacgtatacatacatatgtgtatgtatagatacacgtatacatacatatgtgtatgtatatatatacatacacacatatgaagtacatgcatacatatacatactttgggagatatagaacaacttaaagaaccattcaaagataactattgataacattttcccactgcatgtatgtgagcacatgtatgcaatatagtatgtgactattatggactacatacttccttatagaattagagtcatagtgtatattcaactgtatatcttgcttttagcattaaacattaatgaaccataaaaattatacatgcctttattcttttaaaatattgttaatgattccaatctatattcggtaatctctaaaatttttcaagttatgtgaatccaaatgtattaaaatgtaagcattgattctatttttaaataaattaaaaaataatcatatgggtttttcagacgaatttcagttcatttatcattcattcatttttaaaaagctacttattaaaggaaacatgcttattttaattaaatatacataagacaaaggtaaatattaaaatgctacatgagaaactgggctgcacaggtaattcatgggaatgttaagtattttatattgctacctgcttaaattaaaatcatgaaactctaatttcagacaacaaaaattctgtaaaatgtgactaccaagaaaattttgcaaaaccaaattattttttccatatagcgtttaaaagagatgatttgtttttccaaaaataatgttcactctgacaaattataaatttaagaatataatgaatgatttaaaattacttataaaggaggcattagatttttttataaactctaagtaatctatatagtaaataaaacaataccaaaaatacataaaaactgtttccttggtattagacatacttgaggatatggatcctctgtattgcttggccttttaatttgaaactagctccatttaagtcaaaataaattaagcagtacatctatttatgaaaccctagggaataaagttcctaatataataaagccaacttcagttacaagtgaatgtgcttttcctctttgaagctattgccacttagaattaaaataatctatttaacacaaaaacttgtattaaaaatcacaactaccaaaactttcaatttggcaagaatgtccagcaaccttttactgagaatcaaagaaaatgtaaattaatatatgagtaacattaaagctgtctagtattgtgtgaggtaacatcttccaaattgaaacttttcaacgccaaactcaggccacctgtttgtatatctgtgtatgcagcttttctggtgttttgatcatttttttttttttttttttttctgagatggagtctcactctgtcgcccaggctggaatgcagtggctgcaatctcggctcactgcaagctccgcctcccgggttcacgccattctcctgcctcagcctctggagtagctgggactacaggcgcctgccaccatgcccagctaatttttttgtatttttagtagagacaggatttcaccgtgttagccaggatggtctcgatctcctgacgtcgtgatccacctgcctcggcctcccaaagtgctgggattacaggcatgatccacagcgcctcgcccgttttgatcattttaaatattttgaaaaaattttaaagagatgtggggtctcactctgttgcccaggctagagtgcagtggcacaattcacagctgactgcagcctcaagctcctggactcaagtgatcctctcacttcagcctcccaagcagttggaattacaagtgcaaaccactatttttatttcttaaagcaggttagaattttttttttttgagatggggttctcatcttgaattttaactccgacaacttccacatgtcctgagaggagcctggtgggagatgactgaattagggggtctggtctttcctgcgttgttctcatagtagtgaatgagtcttatgagatctaattttttaaaaagaggaggtcccctgctcaagctctctctctttgcctgttgccatccacataagatgtgaattgctcctcctcgccttccaccatgattgtgaggcctccccagccacgtggaactctgagtccagttaaacctcttccttttgtaaattgcccagtctcagatatgtctttatcagcagcatgagaacagactagtacagtgaccttcaaagatatttagttttctgaaatttaaactgtttgctcacatcttattaatattttaagaattaagaaacaactcaatggcaaaaaaacaaataacctgattttaaaatgggcaaaaaacctgaataggtctttctcaaaacaatggcctgacacagtggcttacacctgtaatcccagcaccttaggaggctgaggtagcaggatagcttaagcccaggagtttgaaaccagcttgggcaacatcgtgagacaccttctctacaaaaaaattaaaatcaaaacaagacctacaaaaaaaggtcaacaggtatatgtaaaagtgctcaacatcactaatcttaagtgaaatgcaaattaaaaccatgatgagatatcacctgacacctataatagtttttttttaatcaaaaaaaggtaacaaatgttggtgaagacatggagaaaaggaagcctttttacactgttggtgggaatgtaaactagtacagtcactatggaaaacagtatgaagggtcttcaaaaaattaaggataaaactaccatatgatccagcaattctacttctgggtatatatccaaagaaaatgaaatcagtatgtcaaagagatacctgcactcccatgtttggtgcagcattaatcacaatagccaaaatatggaatcaacttaagtgtctaacaacagatgaataaagaaaatgttatatacacacacacacacacacactagaatcctactcaggcttaaaaaggggatatccttccatttatgacaatatggatgttcctagaatacattatgcttagtgaaataagccaggcaagaaagataaataccatgtgatctcacacatatgtggaatctaaaaacaaaatcaaacttatagaagcagagagtagaacagttgttcccagggactggagcagggcctgggggagaatgggaggatgtggaatgggagatgttggtgaaagggtacaaagtttcagttagaaggagaaacaatttcaagagatctactgtacaggctggtgactataattaataatcatgcatagtatacctgaaaattgctgagagtagattttaaatgtactcatcacaaaaaatgataaattgttaggtgatggacctgttaattgcttgatttaatcattccacaatgtatacatatatcaaaatattaccttgtatataataaatgcatataatttgttatttgttgatgaaaaataaatttaaaacaagaattagagcccggccccatctttgaccaaaaaaaaaaaaaaaatctttcaaccaaaaatccttaatttttggctcatgtgtgctcatatcacttgtggaggacaggcactgatgataaagcagatgggactgaagtttacgcaacataagcaaaaaataatctagtctaaaatggaatctctttatttgtcatgagaaaacaatttaggactcattagagaaaatacatgatgccaatgaatgccttcaaatttgttagttatatgatggcacaaagactatctctgttagaaatgatacaccaaaattttccaagttaaataattaaacaaatgtttagcacatgtgtgtagacatattcactaagcatattaggttattttgtttaataaaaaccaatacaatagagagacttttctaggacggctgatgtcccaaattatcaccagaaggtttgagtacaaagctgagagtctgacttccatggagggaagaaagacagcgaaagagttgagtacatgggcagggattcacaagtgctctcactttgtgttctaggaacgggatcttctttcacagtttatcttattggcaggcttgttcttaatgccagtggccctgcccttttggtttttcaccagaatgggatcctagggaaaagatttttggtcaactagtgcaacaattttaaaggtctgcatgtggtgaaaagattcaatagattaaaaggaagcccttgatcaaacagagaggagagcaatgtgttttatgaatgcctactaggcaccagacacggtgttctaccaacatgctgaatttaatcctgacaactctgcattaaatggatgctcatattcccattctaacataaggaactaggccctgacaacttaagttactcattggcagtcatgcccttgacaagctgacagaactcagtggtttccaaatgccactctaagatctggtacttgcccaacagaatgctcagtggtccttgtcaaagtcagagtgtacatggaccatgcagtgagattttttttttaaactatacgtattcctttggaaaattcttttattctgagattatgctctttctttttcactgaagtgaaaatgtctttaaaaaataaaattaacatatatattgatgggtaattccttgttaatgttctttacctggcaaaataaggagttagtaaccctaggtcagtgtcccagaaattttactgggtcataaaatcccaaggcatggaaatgttcagtgtagctggatttgagcccaggccttcaaatactgttttgtttttaccatgccgctttctgtatgctcaaatggatttagactattctgaaggcacatagaagtaaatgttttagactctagaacagcactgtccaatagaatatttctgcaacattctatttctgcaacagaatattctgcaagactctcggtgctgtctaatatgctatccactagctaaacacacacacacacacacacacacacacacacacacacacacacaccaatccacaaaaacaaaactgatcttggtggttataacaaattcaatttgaagttctgtaagcaccaaagaaaaaatgaattttgaaacatggaaatatgagatctgcatgtagctttgttctcccttgggagtgaaacaatgagttaaaaaattttggacttgggatcattcatgacatttattgggagacaacatcatttactgaactggtgaaatgatttcttgtcacatcacaaccttccacatttgttgaggggtgagcagttattctttttctttctgctctgaagttccctgcgtcttaaagagagggttgcaggaattgacacattatatatgtttagatacaactttccagtattcaatgtcagcaaatttttcttgacccaaggttaggaaaaaccataaagtctcaaggcaattaaccgtaggtggacacaaagcctaggagatgctgcagtaggcagacggaataattggggttgtttcctctgtgaacctggtgtgaatcataccacagattaccaggaatctgaaagcaaagcccagtggttgatattccttacttggttttctaaagaaaaaccatgggtctgcttgatgctttctttctgtttatttatagaagcacatctttagatgattcatattgcaagggcttagacagtatgatttagtaatactccctggaatatcttatctcaagaaacacatcacataaatgttccagcagtgtgactgtttttccttatatggctcagaaaacagtaaaggagacattgagaacaattcattaagaagctaagactgacaagcaaaagtaaatatttaaaatgattgatgtgtaagtgaaaacaagtattcatatgggaatctcagtgttggctggaaacatctccttttgtatcaagaatttttaaaaattaaataaagacaagaatgcatgctccaaacaatttttttgtcttactttcatggatctatggtgtcttcaaatgataccctggcatggagtaggtgctactgttattttccaaacgagtaaaacagtgatactcattcaaaaatgcacatcaattaatacacacctttatttagaatgtggtggaaaacacgtattggtcatctccaatagaagtcaactttcttcttcttcccagcctgccaccatatgccccaccgtcaagacttaaagttcaggctgtgcatagtggctcttgcctgtaatttcagcactttgggaagccaaagcaggagtattgcttgagctcaggaattcgagaccaacctgggcaacatagcaagacctcatttctgctaaaaattaaaaaaaattagccgggtgtggtagcatacccctgtgtttgggctactagggagactgaggtgggagaatcacttgagcccaagagctcaaggctgcagtgagctgtgattacactgctgcactccagcctgggcaataatagagtgagactctgtctcaaaagaaaagaaaaaaaaattaaagttcaaaatatttctattttacaatacactggagcatggttttgattttagtcttctttaatatacagagggaagagggttgagataaagtgagagtacactagtgtacctctaggtacaatatccacaactgggtgaaccaatatctctcctgtaatggccatttgcctcttggaatttcaagaggcaggaagaatcagtaattttcaactatgggtccttcatctaggggccgtgtttcattgagagcactatccaggttactggactagtttttttctttcaaaatgttcttcaaactttccttattttagtttatttcacacataatgtgctcttagagattgcattcttttggtatgcactgaaaaataggctaatcttccttgactgaggccaattctgagtttactttcttctggcaggaattcagtgtctcataggattgtggaataattgctcttgttattaaactaccacttctccctgcatttttttttaaagaaagtagatattatcctttgaaatgtattaaatctgatgtataagcataattatataatcattatttataagtttaaataattcaccttcacactctttctcttttatacaggagtgagaaaaactcacatgatttttagagttttttttttcacatttaaaagatttaaaagtgagttcagtctgtaatcccagcactttgggaggccaaggtgggaggatcacttgaggtcaggagttcgagcccagcctggtcaacatggtgaaaccccatctctactaaaagtaaaaaaaaaaacacaatcagccaggcacggtggcaggtacctgtaatcccagctactcaggaggctgaggcaggagaatcgcttgaacctgggaggcggaggatgcagtgagctgagattgtgccactgcactccaacctgcgcaacagagtgagactctatctcaaaacaaacaaacaaaagaagtgagtgcaaatactgaggaacatagtgagtataaaggaaatctagaaaataaaatggtatgctaaatattagcacaaagtcctagagttcgaattgcagcaggcttgtcatagaaacaatgaattacgtatatgtttggtcagttttcacttctttttccctctgctttaacaactttttataactaacatttatccctctatctctcctaagacttcagtatatatctattactttggcagtaatagccaagatatattactacatataactcaattaattcgttattttaaaggttagagcactggcaatgatacttagaggtgctggcaccatctcactgtagcagtgcattaaaatcaatgctttatttttatactgtggcattaaaaacattaccatttaaaatgtctaaacatcaggatttcatttttatgatttttttgaaagtatgagattaggaatataaaatgcctattcagctaatattttaaatcccccagttcaaggattgaagaaacttgtttagctaatttataagacttattttacaattcatgaaactcccatttttttaaatcagaaataaaatgacttaagtgattgaataaatggcaccaaataaagcagaatttttaaacaaaaagatagtaaaaaggtattctagtagcagatgaccttagcatattttgccaataaacttcttgagatttaatagctagtattaatgcctgcatcaacactccgaataatactagtaacagtggccagcacacagcaatggaagaaaaagcctggtctatctaggtcattaccaaaataatatcacattttataaaaaaagattttggctacctgggatcctaacagaattaagaaaaagataaattctctactctagagcacatcagatacttcacagcttggaaactgttatttttttaactcctaacaaaattctctcaaatagtctcacatagagatctgatttatctttaatcatttttttttgtcttgaggcagggtctcactctgtcatccaggctggagtgcagtggctcaatcgtggctcactacaacctcaacatcctgggttcaagtgatcctcctgcttcagcctcccaagtagctgagactacaggcgcccaccaccatgcccagcaaatttttgtattttttgtagagacagggtttcaccatgttgcccaagttggtctcaaactcctcagctcaagccatctgcctgccttggcctcccaaattgccaggattacagatgtgagccaccatgcctagcctgatttagctctaattcttcagatatgaataaacaactaatccaaatattttcagactttctcagtacatggtgcccttaatatctcaattttttaataacagcaacacattggccaaaataaataatagttccaattattaaatagttaagtccaaataacttaataaggttttgttctaacaatttagcacccactgagcactatgtcaatttctcattttggaatgagattggacattgcctcccttattttttgttgcacattgatttctgctcagcacttcatttttatccagcaactgctgaaaacccaattttgcaaagatatggtgtcacagaaaggaatatcatggtcttaattggaaactgggaactattccaagctattagttttccaggtggttgacagatgttttcgtgtttttcttgaacatttaaaataacgcttgcacccatgtacattccctctgttgcctcaggacacattttgagaactctggccctagtcccatcactcctacaccacagggtgaggggtgaggatacctccccagctgggaaaaacccagaactggggaagagatgatttggccatggtagctttctttctgtggttaatggaagaaagctttcaagataacaaattgatatgcttttgaaatgttcattagtgtaatattatcttgcaatctaggtaagagatgactacaaacttttcatgtagatccagtgagaattagaacctttgtaatgcaacgtgtctttttatttatattcttcctagtgagaccagggaagattaataatctggaataaaagatacaaattgacataaagggaattcttcttcctttttcaaactcaggactggaagcaatactactcttatacttagcaggcaaaagtagtagagaggagtggctgtgactgaaaacacacattagaggcccaagaagtggtgagggacttgttaattgctaaagaaaggacagtagtttgacatgggaggtagggagagtattatctactagctgagaaaatgccccaatggggcaccccgaaggcctgatcagtgaggtctgagatatctgtatagtgcctggggataacttagctagattcccaaatatgccccagctttttatggtatatcaaatctactcacttcctcgtcactggccctctgaatgcattcaccccaccccatattctgtgtgtagaagcaatgtatatgaatgtgagtgaagagccgattggatcatctttgcattctatgtgttggtgttaatttaacagaggatggggaatagaggattagttatccaggtgaattgagtatttcttaaaacttaagtagtttgacaggtaacttatacttaataaattcatagttttgtgacttaattctacttatcttgtcattgctaattctcctcttaatctttgcaatgtatcataactttatgtgtttccaaatacagatactatattactggatgatgtgaaaacacagaagtgattgttattcagatgctgaaatattaagatgacaaaaatattgtctatttacgctgtaattttcttcatgttacttcatgacaccacttgggcaaccagccttttgttatctagttgtttctactgttataaaaaatttttactattaatggtaatgcaagtttattttcatgtatttatttactagactcatgctaatacttaacatttttctttttcttacttttcttaagaattaagttgctactgcatcatctatatttaacaaattgtgtgacggtctctgagcagaagtggtcaggaacttctcttctgccttatatgagctaattttttagattctgaatttagcctagtgctatatacttgtatacattctctaagagttggctgcatatttactttgtacctccttgagcttttattttattcttaatcaaattttgatactgctatgtatttcattggtttaatgaatttggtcaacaattacttctgtttctcagcagtttttgctgtagtagtataaagtactttgtttacaatggcattatcaaattatgtgctcctagaaataatcaaaatgcttgcttttttttcaaaagattaagctcattggactttggctttctaacctgtaaaatggcataacaatgtccctatcaaaaggactgtgagtatatcaaataagatagctggtgtgaaaatacttgggaaagttgatgatatacacacaccatgtatgttatgattattattactaccatctttatctgttttgttcttcagctatttcattggtttctatttatagaggataagatgacgatatcctatctactaggaagggattatcttccttcttctcactttcccaatagagtaaatagttatatttaaacttaaagagtatttaaaggttttccaaaacagttcaattaaatagataaccacaaaccttcattttaaatacccttcattaggtacctatcctcattaggtactgtttgtatttgaaatttctaagaaaatttctcaataggaaagcttaactagaactattaataagaaatcatcaagtaattaaatatataacatcattctctataaagcgcagttgaattatacacatcagacagtcttcatagcattattgtgaactaggtaaggtgagaaaattaaagtttacacatggccatatgagaattcaaattaagagaaggcacagtcctttatggtggaagatatgtgtcgtgtcagattaaatgttgaaatagttattatttattctatttccttttccttccacagaaacttaatctccttggtagaaagaatgctttctaggagttggtatcaaaggaatatcttactgctccaatgtaaatatccaaggagaatggaaagctaaacatatcaacacattacttttcagcaaaatatagtgttgactcatggtctgattaaactcatcattcctacctgagtctgatcagataaagaactcttgaggcacacagcaaaatgaggtatccttgcaagtttgattttgaaataaaagcatttcatatttaaatatgaaatgctataagcttttcataaaatatatgtatatatttaatatttactaactggagtagaatgtatgaaagaaacaatctatcccaaactcagtttactacaatttaaaaaggtagaacacataactacataaatggactccactaactcactgtgagttttcctctttcttttgtcaataccaagcctgactcacctttgatgaagttgcattagatgactttcaattctgtcattcgcctatttaacattgtttattgttatctatggggctggtcagtattctactcacctttaccctgttcccttttttgatctgcatagtggcttttttaagcctttccctttcttctcaagctgccccatccctctctcctctggctattgatggctgtaccttctacttttacattcattcatctggagatggaggagtaaaatgtttagagaactcatggctaatatctcttaacattttactcctccatctctaaatttacatttcccttcttttactcttcttctccttctccttcttctcttctctcttattcttctccttctcctccttcttctttttttctttttttccagacacagtcttgtcttcctctgtcacccaggctggactgcagtggcatgatcgtagctcactgcaaccctgaactcccaggctcaaccaatcctcctacctctccagagtagctgggactaaaggcatgtgccaccatgcccagctatttttttggatttttagtaaggacaaggtctcactatgttgccaaggcaggtcttctttgtccttcctaaagaatacagttctggtatttactacttttccaaggatagcctccttactttggctcatgatcatgtttttgtcagcaactacagctccatctttaaaccctctttccccttgaatttttagtctctttctatctcctggagccttccctcagctcaagtaacctgaattcaaaaaaattccgcttgaacctaattctctgtcaggcagccttagttctttcttcctactccacccatcagccttttaaagagatgcctgcatttgctcacatttccactttcaattcactccttaacccaggggctcctaatgctattacctgaatacaacgcaccactcaactgtcattcaaaaacctagtaattatagaaggtaactgttctatttctcctggtcctctggactgttatttctgtttgctgtcccagtactttaactgttgtcttgtttcccctagccttatcatgtacaaaccaattcatcacctgttatctgtcatgttttctactctctgccctttgttcctcatcaccatgtacgtacatcaccatgtacgtactcattcatggacaaaaatcagcactctctttgattctccttctccactggctgtcccccaacatacatacatacttcacacacacacacacacacacacacacacacacacacacacacacaaccattctataagcctcttgcatctaaaccagctctttgctccactgccatcactcccttgacttaggtcttcatcatatttagcctgccttacttctgtgaatttcgacatgaaatacttccctgtagtgacttcgctatgcaatcattcaacaatagagtaatcaagatgcaataaaaacaagaatatgatcatgccaaaactcagctaaaaacctctgtggctctcaggtcccatagactgtatttgaaattttcttctctcttgccaggtttcgctattcacatcaagcagattgtcattccttagttcagccataattttccatgcctcacatttagtaaatgttgttcccttagcccggtattttctgtatctttcccttgggtggaaaactctccatctcctctctctgttcctgcagtacatgataaatgcctcaaggattgtgctcaccatattttattacaatggtctaaaatgccagacctcactgctccacagattcagagctttaaatacaccatatttgctcaagaagcattctcattatgtgtgaatgaataagtaagtgtcatgaatttcaaatctaaggaagtgagataaaaataatgtaaaaatagggccactaggaatagaaagttgtttagagatgaagaagggtagacgtcaataatacaactgctaaaatagcaaccatagtttgtaaaaatgagtgaaatataatttcatttctagaaccccatgtagacctattgcaatacaactgatgctctgttagaatggcaagaataacactagacactcaggggttccatacagactaattcttataagataaattgcagcctgttatgagtttttgagatgggtgtcatgaaaagatggtgaatgttattggacaaatgtatagaccaagagagaaagatgaagatcgattctatacagaggcagatgtgccacgaatgatagtataggtattgagtgagaataaagacctatgtagaaaaacatgcacactaccacaagaatgaaatgcactgagaaaatgagctagtgatggtacaggatctgcaaacctgcttgtcagttttcattgtttttcaagctgtactatatcttaaatgatattcaagtctgtctaatgttttctgtgcttgcctctcatgatccttaaaagttggtttaattttggcaaagtcccacaaagatttcttaaatgatctggcaaaccagtgctaacatctgtacatacattaattgaaatatattcaaaatgctatacagtctattatcacaggacttttcaatggagttgaaagcttttcaaaatattagaaaatatccatgtagttaggtagctaaaactcaggctctacataaatataagctaatgatttaagtgttagtttccattaaaaatttaattctcagttttcctataaagtattttctgggaaaataaatacatgcgtgtgtgtgtgtgtgtgtgtgtgtgtgtgtgtgtgttaatcaagagtgacagtgcactcaggttaaatctaccattcatttctagcttgtataattttattcatattctttctacattggaggagagtgatacagttgaacaaaagtcattagttttattatgtcatcagctctagatataaatttactcggttttctctctctttgcctgcccttgtacttacatatcactggcaatggaggagttccgggacatagactttggagagaggtcataatcgctgtcggatcgatacaggaaggactcccgtcgttgactgtggacaaaatttgcttggagaattagcccggatcctgggctggtcatgggatccaagggactccgtcccgcagatgtgccattgtccacatcaaaactgtaaaggaaggagaaggaattatgttgctgtgaacattcacatgttcatattttcaaaaagcatttagcgtcagctgaggaactgacagtggaattagcaggaatgaaaattacagctaatttctgccataaaaatatgataatattgaaatacataaaagaaaaacacattgacttcacattcttgttctcctggatactgttgttaactgaccagatacaagatacaggtttttccaaactctacttcagttaaaagggaaacactctgcaaaacataatcttctaagtacaaaattcctttcggaaaataacaaatacacagtaattcatcaaatatttgaattcgattcaacaaatacccattttgtgcctaatgctgttctcccaaacctgggcttctccctccacactcctaccctataacatccatccaagcattaatttctattgtacccacttccttccatccctactaccaatattttaaattcaggtctccatcaaatttcacctatattattataacaacctttatattagtgtcttgaatccattttccagtgtcattcttcagtttaaaacccttcagtaacttaccattgctctcaggatgaagtcaaaatttctttgccagactgccagtctaaccatctgctctcaattgcaattagttgcccccagcctcaacttgccatcctcagctattgggtacttcttgctcaactcatattgaggcactatctccttctcacaggccatcaccacctcacctcctgctcccctaaataatcaaatcccctttcccctgcctaactgtcactcatccttgagacttagcctgcacctgaaaggctaccctggtacatcagagctttatgaaaggccctttctctacgctcccaagacactttcccactccctaatgacagaatttacaatgaattgaaaatgtttttcacccggtctccattcctagattgtgagctctctacaaatggagactcagcgtattcttggcacattgaaaactgtgcccaagtgtcttgagtaaatgattaaatgaataaaaggcactgtgctcagcaatacatattttagagctgggaaaaaatctacacacacagttcttaacgtcatagtccttataatctagataaactttccacaaagaacctttctagtgaaacatcaaccagtattaaaataaagtcaactttcatgtgttcttaggagaggagggtgatagcttatgatagcccagcaggtgtgtggttttaaagaaaaacttgttgaaagaataaataaacatgtgaattcaagttttgctgtcattaatattttccccattagaatctttattcaaactattaactagctcattttaaaacattcctttattttctttatcggagtcattaataaatagagttatgactctaagattggaagatgtttcatggatcacttttgaatctgtgatcaaataacagtggctccgaaataatccatcaaataaacagaagagggaaaactcattatcttgagcagctgtaaatatgtttttccaacttaaaattttcttagaattgtgtctctttatagatatatttatttggttcaggaaggacaatgagagattgtcaagtcgaacagactcactttacagacgaggataccaggtcctagaaaagttaattgaccagtcactgagctaactgcattgaatcatcgattgttcctaaagtccttccagctctactgcatgattatataaaccacaaatatatgtggcacccaaacaggggacatctgtttcaccagaataggataggcacatatgtatgtgaaaccttgtcaattcccaggaaggctggaaggggaggatggtctctaatcattcaatagacatacattagggatctttggcaaactctccttggatatgcttaaataggcatttattaagcacttaatatgagtgcattaagatacaaaaataaaggatgaatgactaactcaggctgggatatctgagaagttttcatgaagagtagtatttaagaaggtttttgaaggtatttagtacacaactggaagacattaaaaacttctaaatagtgggggtttggcaaagtagatttctcttctaagaagatagtcatggcagcttttcagcatgaggaggacctagtaatgtgaatgcctgtagaaatgtttatgtttatttccctttaatatcaagatattcttattgctacactttaaaaaagaaaataccccctccttcctgtgcatgaacagaaatgtaagagatacagaagtgtgagttttggtttagtttttttcagttcaactgagtaaacaccaaatttgtataaatcagtaattttttctttaattataatttttccaattaaatcaagcaagtcttaacactccactataagttttgaaacaaatattgctaaataccttaagtcatttagatagttatgatatttttaaatcttacaacttttaagccataatattagcactaaaaccaaaacatttattaataggtcaggaagtgcttgatatgagatattctaggggctttaatatttttctttgtatactgtaatataaaaatttgtccactagatggagatcattttcttaaacaaggaaactattttctactgaagggttaaataaccttaaaggcctaaattatttcttaggaactcatgaaaataaccctttaaatgacatccaaaaaacaaagttcacaatgtatactaagtaattatcaatattgataaaattacattaatctaatattagtattagctttacaaacattgagaatgaagatctaaaaatagtgactgatattttattggactttttcttaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcactgggagatatacctaatgctagatgacgagttagtgggtgcagtgcaccagcatggcacatgtatacatatgtatctaacctgcacaatgtgcacatgtaccctaaaacttaaagtataattaaaaaaaaaaaagaaaagaaaaaaaatacttgagaagacttaattgaatttccgtaacaaatcactgagtacttattgtgttggagtaaagtaacttgagcatcattaatagtctggggtttcactctaaattttggcaccacaagtattctcagaatacggtttgttctgggaagtgaacctagggtctgagttcatttgcataatttatttccatgatattaaatcctcttataatcaaaattaattatcaagaaaaagtaatattaccgagaatctccagtctgaagtatcagccaatgtcagtattagtgaatgactttatacaaagagagactttgtattttgaaatagtcattgaataaacttttacattacatcctatgtccttagatcagcacttgaataagtacagatatactacacattgtccttttctagaaagcactaaagtctagttaaggtaatagaacatcaagcaaccagagaaaataaaagcagcaaaacaggtggcatctgtattaaatagcatataaatactaaaacacgaaattgtattatataggcaatcagactatgtgatgtagacaatgaatgtaaagggaatttaagaagttgcaggatgtacacctttgaaggagagttaaaaaatgtccagccagagtagagctggggttgggggtggaggccatccagcaaaagtgaagccacaaaaacaaaaccaagaaggaatgaataaggcgtgtatataaaacaggacatttagtgtctggctaaatttgaggcttggtattaaagaatagtggggacctataaaaatggcaattttgtacagttcaacctaataggtagggatggatgtgtttatggaaagctgggccaaggagtgtcagcagaagcttgttataaagacttacgtggaaacacacaaatcaacttttaacattgaaatctcaggggagtaagatgaggaagaccagtatttgttaaaataaacatgttgcttttgcaacaaataaaaggtagaaaacagagtagaggctgagcacagtagctcatgcctgtaatcccgacactttagaggcacacgtgggaggatcgcttcagaccaggagttcaaggttacagtgactgatcgtgtcactgcactccaatctaggcgacagagcatgactctgtctcaaaaaaaaaaaaaaaaaaaaaaaaagaaagacaaaaaacagagttaaaaaaaaaaaggagaaaaataaatgttttaactacaagaggacccccaaaaaggcttgttcattaaatacttcaaatattagaactagggggtttgccttgagtagggaggttagttgtggattttaaaaggcagcacatttttactcagtaggtagtaagttaactgagaattagacacttacttaactttctgaaagttagcctaattagtcagtttgggctgaaattatagatggcttcaaataagctagttatctttgaaacataattttatcaatagtccacatcgtggtgttatgaataaaacaagaaggtgatgaaggataaggtagccctaaccttagatgctggtatcaaaatgatcagttgtgaattttccaaagacattctttagaaaacacttggatgtggtgaattctcttttgactcacagccaattagatggagcccaagcaaaaaactagaagtttgaaaaagtaactaaaggattggggagagtaaaaattaccaagtttaatgatgatggtggcaataataataatgttaataacaataaaacttctggagcactttccatgttccaggcgctgtgctttgcatatattatctcatttaatcctcacaataacactttgaagtaggcactgtattttccattcgaccatggggactctgaggcatagacaagtgactctatgttcagtagtatgctcaagctcataagtgggttttaaactcaagctgtctgattctaaggctggggagaatggactctgtttacacctctattatgaagtttcatttaaaaaaatacaagaataccttttagcttcctcacctgcagggaacttttgaaagtaacattctgattaacttacaggtgacgcatgcaaaggctaattctgagactaaattttcgtatggggctgggtgtggtggctcatgcctataatcccagcactttaggaagccaaggctggtgaactgcttgagcccaggagttcagggccagcctgggcaacatggtgaaacaccatctttacaaaaaattttaaaattacctgggtgtggtggtgcttatctgtagtcccagctaccccagaggtggaggcaggaggatcacctgaactaaggaggtcgaggctgaagtgagccatgattacgtcactgcactccagcttgggcgacagagcgagactctgtctcaaaaaaaaaagttttcatatgacccaacattttggaatttgccaaatccccagctttttccaattctgaacataacagtagggtgtaaaaaagtctttgctgtaacccatttggcgggtttctttatagcatttgagatttcatttggaattaaggaagggtcagtgggtctgcaaaagggcttagcaaatggaactaagtgaggtgctttcttgttccatatgtttgcttcccttaatgcaatttaagaatgcacacaattcttaaaagagataacttttgccagaaggcagttttggaggaggaatgatatagctatatttggtctcccatgagggggcagtaacagtaatgaccagctggcctgctgcattcagaagtgttaaagaatgtgtgtggctagcactactcatgaccatttactccacagacccatccttttctatggaaccagccccctacaagaaacaaagagaagtcggacaaactgacgaatgaactaattactcccagttctccacactgttccatttcagtggaattactggatggtaatacagttccaatctacctttcatccacgctctcaactgctcgcatactttgtgtctactgaccttgtaattgtttgtctgctgaaggtcatttctcatctttttggccttttgctagacactgcttccctagtttaaacttttcccaatttatttttgaccatgatatgggccctctcctgagccagagtcctgctactgtgctgagtaaatagctttcctcatctatcctagccatcaggaccttatacttagcactgacccccagtatgaagcccaaagtgggtggggcaatgagggcctcagtggagcagctgctaaggaacctctatcaatagcagcctccattaccgaagcatctatgaaggccactcacagggaagatcttgctgaatgtcgctgggaatcctgggagccatcactgaagccaggaccatctgaaagctgcctttttcactacatagtaagaacaatggcacatagaaaatattgacctaccaaaaatgttcctgttaagatgtttatttaagagttagaaaacacaggttaaatttgaaatcttggttcagccacttcctatttgggtgctctagggcaagttgctgtattttctaggctttcactgctgataaagataattacaatacctagctctagggccattataaggattagaagagaaaatgtttggaaagcattcaccacattgcctggcagctagtacactcccattatttagcagctattgtttttcatttttattactctttttctcccagggagatcttcatctaggtcattctctttaactttatttgaacacatggctttgggaagaacctaaagggagagatgaaagaggaagagaactgagggccaaatcacctgaatcagcccttgcaatcaatgaggtgacagatgctggagccagattgctctaaaagtttcagctgcttttatgtctccacccaactccataattccagtgtgataacatctggggagggtggagactgctgatttttttctagatattactcactgaggagaaagaataatttcctaccaggaagtgtggaaggcttggaggtcccaacaacctaggtggggctccagctgaatataatgagcagaaacagtccttcagacctcaggtctccagacacagggtgtagcttggggacctcaggtcacaattatactgatgtttatattcctgtactccactctcccctgtgtattgtagctcatgctgttagccaacacattggaactcattttgatgctttgccctcaaggggaggggaggcttacccttgagcttaaggggagagtaactgtaactggatgactacatacatttttccctctttataatactaaatattttacccattgttatcaatatcacaaggttatgaagctcgtttctaatcaatgccactgatacttctctattgaaaatttccctgcaggtcaaatagcttctctgaagtaaacaaaataatgatttgcaaaattcaccattttaatatttacttttctctgattatctatggagatgagactgtagaaactagcattttacagtgatatgcacagatggcaatctttcccaatcaatcataaaactgcatattaaatttaagtaggatacccggagaaggcatgatatttagctactttacaagattacacagctaaattatactacacatgttagcttgtataatatatatatttgcacagagttaagatatttaacagacacgttttaccctttgttttcacagatgatttttataaacaaaagcccagggctgggcatggtggctcacacttgtaatcccagaactttgggaggctaaggggagtggattgcttgagctcaggagttcaagaccagcctgggcaacatgatgaaaccctgtttctacaaaaaaaaaaaaaaaaaaaaaaaaaagtcaggcacgatgatggcacaagcctgtggtgctgaggcaggagaatcacttgagcccaggaggctgaggcttcagtgagtctaaatcatgccactgcgctccagtctgggtaacacagtgagatcctgtcatacacacacacatacacacacacacacacacacacacacacacacacactggtacaaagatgaagggtatatgcttacttatgagtaaaacattaggtggtactggaaatatacaacatatgtttctggcttgtcagtgacactcccaagtaacacagggcaataaagagattcaagatggaaatgatagcatgagtttgatgtctggactataaatgaaagaggataagctggacttgcttagcacacttttgacacaatgatatgataaaaggccaatttttctgaaaagtatttattaggccagtgttatggactgaatcttgtttcccctataattcatatgttgaagccttaatcaccaatggttacatgaggttgaggttgaggttaaatctatcttgtttcccctagaattcatatgttaaacgaggccatatggatgaggccctaatccaatagtgctggtgttcttataagaacagagagagacacaagagcattctctcttcaccatgtgaggacagagtgagaaagcagccatctgtatgtaggaagagagccctcaacaggaaccaaatcagccaatcttggtcttggacttctcagcatccagaattgtgagaacatttctgtttaggccaccagtctagggtactttgttatgcggcctgagttgactaaggcaaccagaaagccccaaccaaaaattgttttacttgaagtttatacattactttttaatgactgttaagaaaaattttcttaactgaaactctctctaagaaagcatctcaaattattgccaagaccaatgccatgaaattttccccctaaattttcttctaggtttacagcttcaggtgttataattaagtcttgagtggattttttgtgtatgatttaagataaaggtttagtttcattcttttgcatgtgaatatctagtttccccaataccattttccaataccattcaagacttttcttcattgtatattctggacatccttgtcaaagatcagttgactgtgtatgtgtgagtttatttcttggctctattctgttctattggttttatgtctgtctttatgccagtaccacattgttttgattactgtcacttagtaatatgttttgaaatcaggaagtgtgagatctccagatattttgttctttttcaagattgttttgactattcagccttttgtggtttcttatgaagactgcttttctatttctataaaaaataccattgggattttgatggagattacattggacattgtggacattttaacaatattaagtttcctaatccacagcagcatcaaagcataagcaaaaaaagcaaaaataggcaagtgggactacatcaaaataaaatgtttctgcacagcaagggagaaaacacagtgaaaatacaacctacagattaggagaaaacatttgcaaaccatatatctgatatggtattaatatctacaatacataggagctcctacaactcaatagcaaaacccccccaaaacccaattgaaacccctcaaaattaaaaaaacccaatgaaagaaatggacgtttctccaaagaagacaaaaaatggcaaacagggatatgaaaagatgctcaacctcactaatcattaaggaaatgcaaaggaaaaccacaatgagatattgcttcactcctgttaggatggccattattaaaaaaaaaaacctgttggcaaggacatacagaaattggaatccttatgtactgatggtgggactgtaaagtgatgccactactataaaaaacagtatggaagttcctcaaaaaattaaaaacagaactaccatatgatctaccaattcaacttctgggtatttatccaaaaaattgagatcagcatgtcaaagagatatttatattcccatattcatttatgtatattcacaataccaagatgtggaaacaatctaaatatccatcaatgaacgaatggattaaaaaatgtggtatatacatacaatggaatattatttagccttaaaagaaggatatcctgtcatatgctacaacatggatgaattttgaggacattatgccaagtgaaataagtcagtcacagaaagataaatattgcatgatccctcttatatgagggatttaaagtagttgaactcatagaagcaggaagtagcatggtggttgctgggcctgggtggagggagaaatggagagttgttgttcaatgtgtatcatttaatcatgcaagatgaataaattctagagatatgctgtacaacattgtgctaacagctaataataatgtactatacacttaaaatgtaagagggtagatctcatattatgtgtctttgtttttagcacaataaagcaactttttcaaaaaggatctcaaatggccctaacatgaggccatggtatttggactcttgaggcaaagcctgcagtagcagtatgaggtccatatttgcagtaattacctagaaatcatgagaacttcaagtagtaaacatatacattcaatcagaatacgtgctgacaatgggaagcggaaagtgtctttttttttggtagtcattgggaggccttaatttctctggcaatttcatgcaggtgtcactgtgattgagaataaaacaagtagagatttatttcttcccttacatcctattatcatgtgctgaccactaactaagagtatggagggaagagcagaaaagcacatgctctccaggccaggctggacctgagagtcagctgtagtcccacaggaataactcagttttattttccttgtactgctcacagcaggttactaccaatctttcactttctaagatcacttctaagatgctatatttccaaaatgcactctttctcaaaatgtggcttcatcaagctaaagtccaaagaggaatagcgtcttgttaacaaagtggggctcaagatggattaaagacctaaatgtaaaagctaaaggtataaaaaccctggaagataaccaaataaataccactttgaacataggaactggcaaagatttcatgataaaaatgccaaaagcaattgcaacaaaagcaaaaattgacaaatggaacttaattaaactaaagagcttctgcacaggaaaaaaaaacacaactattaacagagagtaaacagataacctacagaatgggagaaaatgtttgtaaattgtattacctgacaaaagtctaatacccagaatctacaacgaaattaaacgaacattcaagcaaaaaccaaaccgccccattaaaaagtgggcaaaggacatgaacatttttcaaaagaaggcatacatatggccaataagtgtatgaaaaaatgctcaatatcactaatcattaaagaaatacaaatcaaaaccacagtgagataccatttcataccagtcagaatggctattactaaaaagtcaaaaaataacagatgctggcaaggttgcagagaaaaggaaacgcttatatactactggttagaatgtaaattattaatagttcaaccattgtggaaagcagtgtggtgattcctgaaagaactaaaaacagaactaccattcaactcagcaatcaaactacagggtatataccaaaaggaatataaatcattctaccataaagatacgtgcatgcatgtgttaattacagccctattcacaatcacaaagacatggaatcaaactaaatgtccatgaatgatagattggataaagaaaaatctggtacatatataccatggaaaactatgcagccataaaaaggaatgagatcatgttctttgtaggaacatggatggagctacaggctattatttttagcaaactaatgcaggaaaagaaaaccaaatactgcatgttttcacttataagtggtaaccaaataatgagaacacacagacagaaagagaggaacaatagacactggggccaacttgaggatggagggtgggaggagagaagaggatcagaaaaaaaatactaactgtcaggtactatgcttagcacctgggtgacaaaataatatgtataccaaacccccggggtcacaagtttacctatataacaaacctgcacatgtaaccctaaacctaaaataaaagttaaaatattaacaacaacaacaaaaaaaaaaaacaagcaagcaaagaaaaatacccaaggtagtgttgcggggtgtttctgtctttatttattgtttctatgacatagagcaagtaaaattgatttaataagccgactttgaaacattgatattttaatgatgtgccctgctacttctccagccacccacccacatttattctttatattgcagacagagcgatcctcctaaaatgtaagcccattctcggcaagttcctactcattatcccataatggtgtcctattttattcagagaaaatactacgttctcccaatggtttaaggccctcagtgacctggtccctggtgcctctctaatctcatctttacctacatctctccctcttgttcactctgctcagcctcttggtccctagctgtccttgaagcactgtgcatactccctccccagggcctttggatttgcagttctctttgcctggcatattctttctagagatatcagctcaatgttaccttcatgagatattcccatactggcctatttaaaactggcacccctaacctcctaaccttttttttttttgaacaaacaaacaaaaaaccttccttactcttaatttttctccatcgcatttaacagcttctgatgaactttgttttttacttattttatcatcttactcaccccattagaatataagctccacaagtgcagagatttttttttaaaaatctactttgttcgttaatgtgtcccccagcaggtacaacagtgcctcacacgtacgagttgctcaataaatatttgtatcgtgaatacatgggtatctttagacgcagcggtactttttctataccggttatcatttaccatggttatctgtgtagttctactttaaataaacttcataactattttttaatttagctaggagttggtcacttatttaaagaaataggttaatgagattgattagcacatttgaagaaataatctggaacatctctaagaaggcattttaacgggggttattttgaatatccttctgtttgaacagcagtcagccatgcaatcaggggtgggatcaaggttttgtggtacacgaagattatacaattataagggtctgctttcagaaaaataatacaaaaaaatcttagttttttgaattttacaaaacctaaaactacgtgcagctgctagtaccacttcttacaacttgaaagggaaccaggccagtgagaagctcttagcttgatcttcattagtttcacctcagatctgcatctgaggtaattacatatcaggaaagaataagaaaagaaactggatgggtgaaaataaaaatttagcaccttatatcattacttaattaattatgtgttttctgagatggagttttgctcttgttgtgcaggctggagtgcaatggtgcgatctcggctcactgcaacctccgcctcccgcgttcaagtgattctcctgcctcaggcccccgagtagctgggattacaggcaggcgccaccatgcctggctaattttgtatttggggtttctccatgttggtcaggctggtctcgaactcccgacctcaggcgatccgcctgcctcggcctcccaaagtgctgggattataggcgtgagccaccgtacccagctgcaccttctattttcttaagagataaattgttattagttttttcttcattcctttttattctttccctccctccctatcacctccctctctccctccctctctattttcagtacccaaattttcaaagcttactcataattctcaaaatttctcttgttagttgcacgtgtttatttttcccagatcagtgagtgtcacctagtcctggggaatggggagtgattccattaggtcagatattgaactcactttgaagaggggtgatcttcaaaccatacctgtctctcaagatattacaattttctttttgagggatgggttttaaaaatgtgatcctcaatcacattcctggctatttgggtatttaggcttactaaaaattaatctccaaaagattttattgactaaataagaatgattgaatgataaatcctttgtagaaatacttagccttaaaatattatgtgttaagtatgttaaataagtctaggtaagattataacagaaaacaaaaaagtaatagttctactataattgcctttaaaatataaccgaattctgattcttttagactaatggatacgaaaactcatataccatgtttttcctctgggtttgcactctgcatcaaacaggtcaggaaaccattcaccagccctactattaaatctattttggagaagtgatattattcagtttccaacctcaacaatccaaacagatgggttttctgccttaatggggcttgaatgaatggcgaagggcttcagagggttgtgtggcctgaattacagacaattttttcaatcttactgggcaaagcaatgataagaatattatcttacgatggccataaacaatcacttgcctcttcaattcttttaaaatatatagtggagaataaaaaaagatatgtctcattatgtgtctcattgtataataagtacactgagattagctttctctcatgatttcttatattgggtgaattatgtatggttacaaattatcttttaaaagttttaagatgttggatgggctaccacagaggtagcaggatctacttcaacaatgattttatagagtgaagaaacattttcatgtttccttgaaatggaatctggctgaagacaaaatgaccttgggaaagcatagaagtcaataatcaggactgtgagtataggaaattctgcttgttgtctgccatattccattctctgcctgttcctgggcataaaagaagttctcgttcccttgcaattagatttggccaagtgactagatgtgagcagaaatattgcatgccactttcaggactggctcatagctcctcccacatgcctatcttgatgttctttttctgccagctggatgctaaagatgctgatgcgtgaaggatggtagaaacagaaggtgggagaatcctggtccgtgactgagagcaaggagagctgccacatcctcctaaacaccatcctagaacgctacttgatgaagaatgagtttattttttaagtcatttaatttgggggcttatttgtcagcacaataacattcaacacagtgcgttccatcaaagtaaactggaaagtacgtactgaaagtacattagactttcaaatgtctcacattcaatctatctctggcccaagtgaaaccatctatgtctttacttctaccaccttcacacttcatttaggttttttgttttgttcccttgatcttcctcggttaacagatattttcattatgacatttctcattacctaagtgcttaagagatgttagagaataagtctataatcattacacacagttgtgattgttgtgtaaagtgaaagccagtctggttctgttctgtcttaacaacaatcagcaaagttacagaggatcagctcaagtgtgaacctgacacatgaatttgtctctggattacagaagacacacagaaccgagattaacaaacactcaggatttacacccgtgcttcacttgagccaatgagatttcagaagtaccagatcgaaataggcttcccttaagacgtcaaagcattgcaacaaaaacaaaaacaggcaaatgggactatattaaaaccaaaaatctctacatagcaaagaaaataatcaacagagtgaaaagacaacatgttaaatgggagaaaatatttgcaaaatatatatctgacaacggactaatatccagaatatgccaagaactcaagttaacagcaaaaacaaaaccaaaccaaacccaaataatcccatcaaaaagtggacaaaggacatgaagacatttctcaaaagaagatgtaaaatgaccaacaggtatgtaaaaagtactcaacattactaatcatcagggaactataaatcaaaaccacagtgaggtatcttaccttagaatggctattattaaaagaccaaaaaaaaaaaaaatagatgctggtgaggaagtggagaaaagggaattcttagttggtgggaatataaattaatatggccattatggaaaacagcatagagatttcccagaaaactaaaagtagaactattatacaatccagcaatccccctactgggtgtttatctaaaggaaaggaaaggaaatctgtatatcaaagggatacctgaacccctatgtttattgcagtactatctacaatagctaagatatggaatcaaccaaagtatccaccaacaaacaaaccgatagagaaaatacatatatatatatatatacacacacacatacacatacaatggaatactatgcagtcataaaaagagcaaaatcctgccatttgcagcaacatgaattgacctgaatgttaagtgaaataagccaggcatagaaacacaaatatggcatgttctcactcataagtgggtgctaaaaaaagttgatatcatgaaggtaatagaatgatagctaccaggaggaggggaatgaagagaggttggctaacgtatgcaaacatacagctggatagaagaaataagttacaatgtgtgatagcagaatagggagattatagttaagaataatgtatcatatatttcaaaatagccagaagaaagaaattgaaattattccactacatagaaatgataaatgcccaaggtgctggataccctaaataatttgtctcggtcattatacatcctatttatgtaacaaaatatcccattatcctatgtacaaatattgtgaattaattattttaaaattctgttaaaaaacaaaaattaggcttgccttattcaaaatgttattctgaagcaaaatgacattttgaatgtgcacacttctggggaaatggttcagagtctatagaaaaattctagaaatatttcacaatttatccaaacccagactagaaccactcttcactgttgcctagctcatttgcagtgggatcaggatgagttggttcagactggcaatgtcgtaggttgaatcagatgcctaagaccattcctgttctgaactcataggctaaatgcctttctagagccaaatgttcctctctagaagaaggaaaggatattacctggggcatcctcttgccagtatagcactctcctcaaatttgagccctctttctctgagtttcagtgtatttctggtgtaagaaatatttcattgccaccttagagatcaaactcaaaggattaatagatcctgagggtgatagagtaggtcatagaaaagagatacctatccattccacaaatgctcatcaactacctactctagccactctgggaggaataatgaagctcattgagaagacgtaaggatggtagtagttacactgatcttctgctccaaaattaatttggggttttccttcccctcaggatgaccaaattcatggtgaggctattcataaatcctgttgacttgccaggtccacagccaagataaatgcacagctgttttctaaaggcatttgacctcttctctaatcacctcaagttgagaagcaatgttcattgctgactttctttgttttgacattaactatgttctcaaataaaaaatcaagttttacttctccagccattaaaatttctctcatttttatgaagtaatatttctcaaacatttgaatatattcatccatttttgtgccacttcatctattttctagatagattatgatattcaattatgtgtattttgtctttcttttttctttttttgtagaatttattcgatataatcttggctcccattttatttcccacttatcctcttttaaaaaatgacttatgcttttttaatgaggagtccaaaatggcacacagaactctaagtacagtgtaaacaaggccatctgtaatgagaaagccattcaattcagcaaagatttttctaaccagctatacatagtcatgacagaatcctcagatttagtgtttcctagtagcaattgtaattcttttgattgctggcctgtaaaatacttagtactatactgtaccatgacagtggaaatatgtaaatagaacctccatctccagcctgcttatataaaatgaataccactggtaaataatttaatgttaaatgtagttacttttacagaaaaatatatgctgtaaaataacttctactcttttttcatacattcagatagcctaaaaaaaggatagatgtcagttttttaaacttgggggaaaaaagaacccaaacatgattatatactttgctgacctttgaaatttaatttgaccaaattttgaaaatagtctttgagaattacagagtgagcaaatgccagtacttcatgaaactcaaatcgagtttttttttaaataagcagtgtaggtatcgtctttgctttttccatgtctttaagacttttaaaaatcttaaaatatgactgtttcaccactctttttctttttttatagaattcagaacttaagttaaatttgacaagaggaaaaataaaatccaaaccacatctatgcttattctgctcttggcttcttcctacagagctgtcctttaaatttgcaatgtaattatgagtttccataccacatatgccactaatcccacgaaagtatgtggcccttcagaccacatgaaaaaaatctctcagggcaccttgggtgctttacccacttgccatgtccaaaaagagttccatctgtgcccctgatggtcagataacctgtcctgggtgagacaaaagaattattcccaaaggccttttcctcctgtgcttcttatgccctcacaagcaggttgtttctgagcaccttcacaggcattgttcagtggaattcacacagtgaccctgggcaataagtgatgggattgggagtgtagatttttatccttatttgctgaagaaaaatctgaggctcaggaaggagggcaatgatgtgcctagagtctcatagatttaaatggctggattacgactcaatcccaaatcttctgttctttggactaaagatttaaatgaaggattgaacaattggattacttttaatccttcataaagcttgaatgaaagacaaatgcttattttaatgtctcttatgagcactcactagaaatattctctagccgagcacaatgttcaaaacctttgtgtggaatgttacattttgctgaaatgaatggatgtgcttacatgtctgtaaatagtagaatgaaaaagctggaaaaggattttagcaagagtccttcattttggtactcttgttaatcatcctaacaatattgtaatgctttatagtgtatggtaaatgtttgttaatacttagagggagatacagaaaacaactatctggttaaatttacttaaacatatcagaccagctttgcaaaacaaagggattcccacttgatattctgaagaatatttcagaaaaatatgaatgtatttcttttgtattatttattgatttttaaattttagatccaggggtccatgcacagttttgttacatggctatattgcaggaagctgaggtttgggcttctaattatcttgtcacccaagtagagaacataggacctgatagctattttttgacccttgccaccctctcttcctccctgcttttgcaatccactgttgatgggcaggaatgtatttataacgcaaagataagaactgatgctgggcaatactactgggttgagaattgggagccttgagtttgagttctgaccccgctactacctcgttgtgattttggcaagcctcttgacttctctgggacttagctatttcatcaatgaagtaaagagattgtccttttcaattactgctacatatcactttggagaggcttttaaaaatacagattcttaggcctccttttggatactctgagtcggtaaagctgaagctggatccaggaatctctattttcaaaaggctgtcatagctatttgatgtgttgtcaggttgagaacaccggacttgctgaccttctagctttaacattcccaattccaactggacagcactgaactcagctcatattcctctatgctgtgcttactcgggagcgggagtggtgagaagagccaaagctgtcgtcaccaggctatattacaccaccttccttggtggtgtccctgcccacatgcccagctcttcaacaccactttctacgctgctgttgggattttgtgtgtggttaaacgggatggagaaagaagggaaaaaaggagagagggagagaaggaaggaaggaaagaaaggcaggaagaaaggaagaaggaatgaaggaagaaaaggaaggaaaaagagatagcttgcagtggctagaaaatgtaattattttacttccttgaataactacttttgcctataaaagtggattctttatcacggcacttaggttactttaaaatcttgtcctaattcccttcaaatcttgtctctagcccctccaaagatacttctggtcatactgttctcactctctggagtatgtgttacagataatgaagttttagacccaaccaatttctgcctcatgaaatcattctcacttttcaaagctcaacatgtagtaagaaatgtgtaatatgacctccagttcttccttccacaattccaaacatcttattcacactgtcaataaagcattatctcagggttaaaataataaagcaactggctttaaacacatttctccccttatcaactaccccttcccagctatttgaggttgggggtctccataccatttactttaatcatcataaaattaacattcatgttttgcttgaccatttgccaatttctttacatccattattttatttgcatttcataacatttctgttaaataaattttttgtcaacccattttattgataatgaaactgcaaacagggaggtttactggtttgctggttaatgatgaagctgagatatgaacctagatgctgtgatttcaaatcttatgattttcctgcactgatttacaagacatcgacaggtgctcagcaaatgcatattaagtgattaatattaagtgaatgaataactggtgagaaaaggcctcatggtctcaaataatggtctctggtctatgcttgcatcttgaatctgcttcttgctatctgaacaatgtcagacaatatatctaatctgtctgagcttccctttccttctttatcacatggggaaatcatactgccctcatataggtgtgtgtgtgtgtgtgtgtgtgtgtgtgtgtgtgtgtgaactcagtgatatgaaatgtgtaacgtgtcctcaccagtgtgtgcacagagtaagtcctcattatatgtttgcttcttaattttgtgggaggcagtcattttgttattcattgcatctgaattttatgcataagcctacctgtggaggttacatttattcctgagattttaatcctctctcatcttcagtgagaaacagtaagagagacactatatgatgatagttaagaacacagggtctaggcagccctgagttcaaaacctgattctctgcctttgtagccttgtgagtttggccaagttactcactctctccatgcctcagtctcttcttccataacatggagaacatgccatttagaattatgcctggtgtgtgataagtgccatgtatttggggctattacttatgttatgggggcacaaaactaataataggcatggttagcacaataatgagatatttgtcctttgtgtttctcaaccaaaattgatgactcttgtaatataggatcaacagtaaactgggaccttgtcatttgcatttggaatagtaggtaacagtaattagatgagcatttgaagaatacatgagaactcacatataggaaaacaaagtaggagtgtgcattttgtatttaaacataatgaagcatcagctcttatgtatttatgaatggagaaggaaaaaaggtcattcgacttttgttgagcaccgtggattactatctttgatgctgtcatttgaaataacaaaaactgcctctgcctttccccagccctactattgaacagaaagaactggaaggagaaagagtgccatcttttagaaatggttcctctgagtcatagttatcccttttgagtaccacatcaaaggctctatttcacctgagaaatctcatacgcatttcaaaagtcaaactgtaataacaaaacctacactacctataatgtcaaaacatcaagcaagatgtaacaatctctctcatatcctagtctcatacatattggtgtgagttaaggacaaaggtacttttgactttaagacagtaagaaatgtgaggtcagtgtccttgggaataactagaaaccagagatatttattgcctagagacaacgttaagatgatctcagaaaggttttctttggaatggtggagattaagtggcaaggccaggtattcttgttaccaaaataaatactgcttaagcaacagcaaacatgggagagggatgacagaagaagggtttctctatccctttgctggagctaaagtaaaacaggcaaatgattttgaaggctcagcatttaaatctaccatatagggtttaactattggtgctgtactgctgtctgttgatagaactatgccttctcctgaagcttcaaactttagttgatatctcaggtagaaagtgtgttcttcaacatctttcatagctttggcaacactgatcacgttgctgaaatgcctcctcaccggagatcttaccacctgtgaaattctcctcaaccctgctctctgcctctgaattcctggacagaattagagctgatatacaagaactcccaaaggcaagcctgcccagacagtttttaggttggtagttcactgtccaggggacccagctgccactattctacaggcctttttccaagggtaacacaataatcacaatagataataacaacagagaatgtactatttttagcatttcatatccattgtctcatttgatttttattactatgccggataaagcaatggtgctaagagaagtaacttgcctgaaatttgtatttttatccattataattcgttgcctctctaggatccaatggccccttagtaaaaaatactgatgctttaactctaggttcccaaatgccatttagctccccaagcatcgtactgtggcaaaaactacatgcactttgaaatcagatctgaatttgaataggttctgttacttgccagctaggggaccttaagcaaagcttcttaccctctctgagcctgcaacactcaaaaaggattacaaagcactcacatattaaaatgagttaatgaatgtgaaagcacctagaacagagttttgaaaatagtacatgctccgtaaatatgaaattcctttttcttctttcccctttgaatacatgggagtttcctatacaatgctttggtattttaataagatggtcttaattttactcattgcatgcatcttgaggccagtgaagcactaacgcaattatctctgtcaagccttccagttattaaaactaacagccatgacacaaccttctcagttcaggcagcccacctatatttttaatgggagtattggtatatttacagtctccatcagaacaaagttctgttattattttgactctaggaccattattttatgtgacagtgactttgtcagaggagagaaaggatgtgactttaaccctggtttttaaaaaagagcaattttcctattataaactagttaaaaactcttgttgaatagcatattgcaattgatgtttggggtaatatgccagttttagcaagaaataacacgaaatagaatgctccaaatttattatttatttgcacctgtgctcacccacttattttccttcagccttcatagttcttcagatatttgatgagtggtgtaggtgatgaatgaatggcacatgtctgtaaaacactaagctcagctcaagacctgcagatcttcctagtgaactaaccaagtggttcagttgataacacaagtatagtatcccaataggtttagaccctgctctggactctggagaacattgtatctgtttatgtcattctaaaacatagccaccctgttgcaaagagtttcaaattttggagaccagagacccctttgagaacgacatgacttataaatctttggaaatgtgagtcttcggaaaaattcacaaacacacacacacacacacacacacacacatcccttttggatgtaattccataaagttcagtatagcctagtgattaagctaagggctttggagttagataacctggcctaaaataatgaccctactgctatttagttttgtgaccttcttcaagtcatttagtctctttaaatttcattttaaaaatgggaatgaaaacagtacctatgtgatgagtctttatgagatttaaaggagataaagcatgtgaagtgctcagcacactgtatgacacttactaaatgctttgtacatttttgttattttaagggagttacagatctccaaagcttatttgtgggcagcagattaagaatttctgctatgaaaagaggacaaagttcaaaccaattaaggaccatctgcctaccataaaaacaagatcctattgaagttaaataactatcaataaaagggcattcaacaactaggtctgctaccctgcctggccctgagcaagtaggacaatgggtccagccatgtccctgttctttctgaggagtggcaactgtgcctcctactgcacccgcctgtaccagccatggctgagaacttggcagtcatggatgctctctacacttgactgaaaaagaaaacagcttcttggctgtctgagccttaaaaggtgattgtcctattcctgacatattctttacaaagttctaggtgtaagaaaaggctgtttcaggttttaatgagagaatatttgttagagagaatatttgttaagcgcccagcttaaggacacacacaaaactatcaacaaatgccatctctttccaaaggtcaagagagagggtaactttacttgacgaagtcacagctctgggagaaattccactgacactcaggggactaagttatgtagtttaactaaatttgacttgaaataagtaggcatttaagagggcttttctctggggattttacacatattttgctgatgttgtattttaaggtatcctattttggtcaaagtagattctttagccaaatcagtacattttgaaatgactaaaatatctagcagccagcaagttcagatacactgatctttaggaggaaatagccacaaattgaatagtacttaaagaattctgtatcattttgctttgtttcagaaagattatcacagggaaaagcttagttaagtgactttaatattaatatattcatttctgtatttccaatatctagcataattctcacaccaggtataggaaagtgataactatttattgaatgaattttctatatatgtatgtcaatatccatttttaagaactccatggtcaggcatggtggcccacacatgtagtcccagctactcaagaagctgacattggaggatcacttgagcccaggagtttgagtctgtagtgtgctatgatcagacctatgaataaactaggtgaggggaaatttactgtgcaaatacctgctatggctgatacaaggtgcagattatagctctatggtggcctggagaacctcacacttcttaatgggttctctaagcaggtgaccaggagaatcactattctatttttgataaagtttcactgatcttttttcaactagtcttaccaaattctctgagcaacacctgctgcatttgatctcaactcaatttcaactccactggggtgcatgggtgggaacaagagaaaaataagggaaatatttaagtaaatgaaatttagcaatgtcagaagagacagcaggacaaattgcaatcaataatccaccagcaatgctaatcacttaaaattgtacatttacattttccaatgcaggaataatgatatcaatatgaataccaatgacaacagtaacgataatgagttcacatttattgagtatttactgtgtgctgtagactgtgttaaatcatttgcatggcttatttcatttaatctcacaagaatcccaggtggaagagactggcatttcctttcctcctttatagataaggaaactgaggcagagaggagttaaataaattatggacagatgtagagccagtgtcagagcatcaacataagaattctccatcgttatactggcttttctcacaatatggccttagaattacctgggatgcttgctaaaaatgattagctctcagtgttatctaaagcaaatgaatcagggtcttagggatgaagatcaggactctacatttaagagacagcaggcacagtatttcttacgtacatcacagttggagaaccagtgtctgagcagtatgaatttcacagcctgatactgctacatgaaccagattgagtaaaatgattctcgtttttactatagagtcgtataagagagaaaatatatcacaacattaaagagaaacagtaaaatcacctcaactattgaaatcatttcaacagaggactcaacttctgaattgatcatagagatataactgcttttgaccagctttagaaggcagatttttgtatttgtctctcatatggaactggggcctcaatttcccatttgtaaaacaagagtgtcggactagacaaaattttataaaactgcaggtttaaatattaataaatatataaatgttttcccttttttaaaaaagagaattcactatacaatttcttaaaataaccttttttttttttttttttttttttttttgagacggagtttctctcttgttgcccaggctggagtgcagtggagtgatcttggctcactgcaacctctgcttcccaggttcaagtgattctcctgcctcagtctcctgagtagctgggattacaggtgcccaccgccatgcccagctgatttttgtatttttagtagagatggggtttctccatattggccaggctggtctcgaactcctgacctcaggtgatctgcctgcctcagcctcccaaagtgctggaattacaggcgtgagccaccggaactgtttttttatatgtaggcttaaaatttgttgtaaaaactatctggaagtatatttagtatgtcttgacaagtttagacaccatttaaactctttgacccagtaatagcatttccaaaaattttgccaaagtaattaaccagagatacagattaacatttcttctacaaagatgcttagtgaaccactacaataaagaaaaaagaggaaaatttaaaatgcccaacaatgaaagaatggctaaatattgaataaatcattttattacatgtaaaatggattcctatgtcaccattagaatatcagatttttctagaatcctaaatgacacgagaaaatacttcttaaaaatgtcaagcgaagaatgcagaataaaaaattatatatatatacaggctgggcatgttggctcatgcttgtaatcccagcacttcaggagttcaagaccaccctgggcaacatggtgacaccctgtctccactaaaaattcaaaaattagttgggtgtggtggggcaaaactaaaatcccagctactcaggaggctgaggtacaagaatcacttgaacccaggagacgtaggtttcagtgagccaagattgtgccactgcactccagcctgggcgatagggcgacttcatctcaaaaaataataaataaaaattttcaaaatttggaaataatatatgtatacacacacatatatatatatacatatacatacattttaatggtcatatatatcctattatgtgccagatgaatatcaggtaggtctctctctctatatacacacatatatgtatacgtgtacacacatatgtatacacatatatatatacatatatacacatatatacacatacatgtatgtacatttacatatatacatatatatgtatagatatatgtatgtatgtgtgtgtgtctgtgtgtgtgtgtgtgtgtgtgtgtgtgtgtgtgtgtgtgtgtatagagagaccgacctgatttcatctggcacataataggatatatatgaccataaaaatgtatatatatatatatatgtgtgtgtgtgagcatgtttgtggggtatgtgtgtatatgctttaaaggtttattcaggaaataaaccaacacgttttaatgatggctatccctggaagctgcaatgacaggttatgtgtattttataaaatattaataaatattggaatatttattgggaattttctgaagttcccaatttgtccacaatgaacatgtgtttattttgtagttagaaaaacatgttattacaaaataattcaataggaaactacttttagaaatgcatttatgatgcaaggtgaagcatatctgcaacatgcttcttgctgacaaagaggcctctgaagcaggcctcaccaatgttcccaacgatggtaaatttggcaataattgtgttgttaggggagctccaagcttaaatgctgcaattatgagctagggtacacaaggacatgttggaagtgacaggcaatatcagcttcctccaaaataatggtcaagcgaatatgtgcttttgcccaaaaaggaaagtagcacagctgtaactggatattgtaaataagtggtcaaaggttccctaaataagcaatatcatataagcctccttgaggcatattttttccttctgggagccgtgttaggctcacagacatgaaggcagccaggaaactgttatctgtttacttctaatttatttttataactgtccatgccagcaacaacaacaacaaaaatgtttctaggagaaaaataaatttggcaataaactctctgagttttcgaaaaatcttaccaaatcaaaaacttctacttatcatgttgctgtcaaacccagcctcataaaaactttacttataattgagtgtatgtatgtctatctgtactgtaaccttgatacttggcctcaaatcctggttctgccaggagcttcgtgcctttgggaagatttcctagcctctccacatcttgcttttctcatcttaaatgtagacaatattataccatgcagggctctgtgaggttgaatcagaaaatgccactaaactgcaaagcacaatcccaggcacattgtaaaaatggaaaaatcagcttgattccattcccctcttgccatacaaggatatttcaggtctctcaaaagcgtttcaaggaatagaggaagtagtcaaacaagtgtgtgtgtgtgtctgtggatgttggtgtgtgatgaaatatacatataaatattatatataaatgtatatattatatataaaatatttgtaaggatggaataactagtatctgcttaaacaacaactacacttcgaaaatcctttatttttcctgatgagttttgttcaggtgaagatgttcactggtaaaaagacaaggcaatccatttcttttctacagtgtcagctttgtttgaaggacacaatgacatctattcagaaaggtaccaaccattttgcttttaaaatactgaggcaaacctctctgaggtttcttcaaagccaatggcaacaaacatatttcagcatctgttttgcttcactgtaggtctgtgtgtgggtaggttataaaataaaaatgagcttgccattacagatactacttaaaaaccaaaaaaactatgatcatgatgttgataattctgtattcattatcctaataaaaacacataaatgtctagaaagaaatagacaattatgtattaggccttccgtctcttatttaataatagcagtgtcattgctctagttaaaacccgctctgatcttaataaatctgatgtaaaaacatatcaccagatggggactctgttaatcttatgcgatactttcaactatgatgactaatagttctataatttttatatggttgctcttattgaggaaagagtaaccatttaagggaatcttccaccactgttctttgttgaaaggaaggctggatctacatgcatgccaacatactactgaaaagtaaatatgcaatccaactattcaacaatttggaatcattgcaatttttatagttccagatggtgatctttatccagatgaagtgagactattttactactttgtcagaactctacaactaaatatttataaccctcaaatacacagatacattatcacagtgtgtgtgtgtatatgcacatgtgtgtacacacttttatagaatgagaatgaactaggttttgtaaaagtttcagttacaagccacatgcctatgttacacattctgtctgtaaactacctacacccacacacatatacattcatgcaccaatataatatggttttcaaaatcatgtcacatagttgatctcattttatctcaacaggaaccacagtctaattgaaataaatgcctctgccatgaaactaagtcagttagtaactgtaaaggagttgatttacaggaatatctattccatggcctagctaactgaactcattaatgacacatgttatgtaatgcttgttaaattagtgaatgctcttacattgaaagacacatagtaaagtgctgaatttcaggaggtgagctagtagtttcaatgtttgtgggcaccatttaatgcataggaagcctgcatttattgagtaaaatttagagaaaaaaagaggccctgcccattgtaactcaagattaagggcaacttcaatttcccagagcctccgtaatgggcactttaggagaggtgaatatggtttgactggatagagtacaatggctttttacattgataaaatttgctgtacaattgtttactggtgaactttttaaaaatggaaatagaatgtaggcttcatatgttactaaggatacccttgattatgtaataggcacttgcattacaaaaaatgaaaatggctgaataggtagcctgagccatagtttctgcaacctgttctcctttccagtgttattaatcacttgaacctcacctgctgctctggctcctcctccttgatctttacagatatgactttaggcagaaacagattcaggagcccagcaccacaccatcctgctgcagttaacttgaacatacgtcttatctctgattactactggcttctgctttaattccctgtgcttatcttccgtccctgagactccagtccacctggccttccaacataggcttaagatactctcttcctgtcccatccatgaactgcaagctggtgtatagagcttcctgaagtcacatgatccagacaagtgattaccaattttattggataccgtatctattagtaaaaaaaaaaaaaaaaaaaaaaaaaaaagtgcaagcacctccattacgtatatttattttcaataagttatgttcttgcactattatgtcaaaatattatctattttacaaaatacaagaaaaagaaaatttgtgagcggataagaaaaaatataagattttatttccatacctcaataagttgtcctgttcacgcctgggcatatgtctaggaattacctgttctgagccactttttaggagactgttatgttttgcccccaaagactagtcagggcacactattgccaatatgcctggctagatggagcttttcctagtgcctggtgagtggttcctgctcttgcatctatctgccaccttacccacctaccacccagtcccatcagcctctgcttcatcccagtgaaagggctcattgcggattccaatccttatcattttgtcttatgctactgtaattaaataatcaactccctgggacaagaaaaggtaaaagtttcttcaggagttagcaaatggctacaagcaataaaaaggtttagaaggcaaatagaaatttagttacatcattgttatagttgtaatgtagtatgtttctctcaatgggttgcaccagagttcttttttttctacttgtttctattgagatgttatttgtaaaatgtaatttatatctgaggtgtctacacatgatagatgatacataaaattttatctgtgacacaaagcaataagcaaagtagggcacatgtaacaaatggtcctgagacgtatagtgggaaaaaataaacttgtatccctaccttatattaagataaattccaaacagattaagagctaggttaaaaaatcacaaatacggaaaatgtagctaaacatttatctactcttaagataaaagccctcaaattattaaagcaaagaaagaagttacaaaagaaaaaaaatcaataaatttgactgtataaaacaccatgaacaaaagtaaaaaggggactaaaaattggaatatataattacaataaatgtgagctggagaaggttcatctatctaatacataaagaactcttgcaaaaagtaaaaaactatgcaaccccaatagaaaataagcgaagagacaaacagaaaattaacagaagataaatggctaataaaaatattaaaaccatttttattcacaccagtagtccaaaagtgttaagtaaaacaacactgaaataccactttaacctaatatgtggataaagattttttttaatgaaaaacatttcctgcagcagcacagtaagatgagaactctcaagcagtgtggcttggagtgtaacctggtataacctttagagaagtattttttgcaacatatattaatagtcttaaaatagtcatattctttgacatagttattttactaaggaaatattcagagataagccaatgtttcagttcaaagatgttccttgctgataattttaataattgggaaaagctagaaacagcctgaatatccaataattggcaaatacataagttacaaaatctttttagggtgaaacattttgtatccatataagtaatgtttgaaataatgttaagtgatatggaaaaatgctcatgataaaatgctaaattaaaaaaagaaattaaaactgtacaatccaggtaattgctattagtatcatacttgcttggaaaaagaatagaagaaaataactaagaattagcagtgattatttgggagtgtgttgaggttatgagaaatttatatttgtatttttattttttctatacgtgtgtcgtattgtgtgtgtgtgtatatgtgtgtgtgtatgtttaagagtcttgttccatcacccagggtggagtgcagtggtgcaatcatggctcactgcaccctgaacacaatcctcccacctcagcctcttgagagctggtactacagggacacaccataaaaaaataatttttattttttattttttgtagagacagggccttgctttgttgccaggctggtctctatttctaggcttcaagcagtcctctcactttggcctcccaaagtgctgggatttctggcattccaccatgcctggcctcttgctaggtttttaaagaaacctagaatgcacataaattgcctttataataaaaactattttaagggctgggcatggtggttcatacctgtaatccaagcactttgggaggctgaggcaggcagattgtttgaatccagcttgggcaacatagggagacactgtctctacaaaaaaaaaaacaaaaaaaattaaaaaaaacaagccaggagtggtggggcacgcctgttgttgcagctactcatgaggttgaggtgggagtatcgcttaagcatgggaggtcaaagctgcaatgagctgtgattgagctactgcactccagcttgggtaacagagcaagatcctgcctcgaaaaaaaaaaaaagaaagaaagaaaagaaaaaaagaatatgtaagggtcattgtgccttgaatataaatattttgtagattatatgacaagaattttaaattaatgttttcctatttggataaaatataaagatgtccaacaatagaatgtagttagaagctgtgaaatacagaactagaaaaaactttttaaaattcatatggaaccaaaaagagcccgaatagccaaggcaattctaataaaaaataacaaagctggaggcatcaccttgcccaacttcaaactataatacaaggatacagtaaccataacagcatggtactggtacaagaacagccagatagaccaatggatcagaatagagagctcagaaataaaactgcacacctaggaccatctgatcttcgacaaagctaaagaaaagcaatggagaaaacactccctattcaataaatggtgctgggataactggctacccatatgcagaagattgaagctggaccccttcctttcaccatacacacaaaaaaattcaagatggattaaagacttaaatataaaacccaaaactatagaaaccctggaagatgacctaggcaatcccatcctgaacatagcagcaggcaaagattcatgacaaagacaccaaaagcaatcacaataaaagcaaaaattgacaagtgggatctaaataaacttaaaagcttctgcacagccaaagaaactatcaacagagttaaacagacaacctacagaatgggagaaaatatttgcaaactatatatctggcaaaggtcaaatatcctgcatctataaggaacttaaacaaatttagaagaggaaaacaaacaaccccattaaaaggtgggcaaaagacatgaacagacacttttcaaaagaagacatacatgcggccaacaagcatatgaaaaaacccttaataacactgattattagagaaatgcaaatcaaaaccacaagataccatctcataccagtcataatggctattattaaaaagacaaaaaataacagatgctagcaaggttgtagagaaaagggaacacttacaaacttttggtgggagtgtaaattagttcaaccattgtggaaagcagtgtggcaattcctcaaagagctaagagcagaactaccgtttgaccatgcaatcctattactgggcatattcccagaggaatataaatcattctaccataaagatacaggcaaacgaatgttcattccagcactattaacaatagtaacgacatggaatcaacctagatacccatcagtcacagattagacaaagagaatgaggtaaatttacaccaaggaataccatgcagccataaaaaagaatgagatcatgtcttttaacatggatagacctggaggctattatccttagcaaattaacacagaaacagaaaaccaaatactgcatgttctcacttataagtgggagctaaatgatgagaactcaggcacacaaagaaggaaacaacagacattggggtctacttgatcagggagggtgggaagaaggagaggagcagaaaagataactattaggctttgggcttaatacccgggtgatgaaataatatgtacaaccaacccctgtgacatgagtctacccatataacaaaccttcacatgtacccccaaacctaaaataaaaattaaaaaaagaacctgtgaaatgtttacatatttcatatttgactgtggacaaactgctactctgctatactttatttttaaagttgtattgtaaagttgtactacgttccccataaagcaaactatccaagatacagtccagcagagtgcttaatggccataggctttggtgtccggaagtctaggttggagcactggctctgcaacagtgtgcaggtgattttatctctgcaagcctcagcccaactaaccaggtgtgtaattgttttcccctccatggatgccttgtaaatcttattttctaataactgaataatgactgaatatggttaaccatatcatctgggttttttttttccccgagatggggtcttgctgtcacccaggctggagtgtagtggcacaatcacagctcactgcagccttgacctcccagtctcaagcaatcctcccacctcagcctctcgagtaggtgggactacaggtgtgtgcaaccacgcctggagaatttttaaaaatatttttttgtagagacagggtcttcctatgttgcccaggctggtcttacattcctggactcaagtgatcctcccacctcggcctcccagagtgttaggattataggtgtgagctactgcacccacccagccatcatctagattttaaatgccaaagtgataatatggagcagatagaataagatccagaaataaacaaatacccaagtgatactttcattattgctttctttcctaggtacccttgctccccagcataacaacgtgcacacacagtcgtagcccagccatggttcttagcattgcaattagatcatcatcatcactgaagtcacattctctagtcacattatacataaaaatgtcaaagaatcttgccccctctttttttgatgagggagtaaactaggcaactgtgaggtttttacaacataaaattctttgttaactctgttgacatttggaaaaatggctttatgctggctttacagcagcataatctctatttgtttctttaaaaatgctgtgattagttactgtcttttcctttaaaataaacaatagtgctgccaaaggaaaaatgtataactgtttgaaaggaatacattttatgattaacatatctttatatataaacaaaataaaatatgacttctctctagttaaaatcatcttcataaacaaatacttcaggaatagattgttaattggcaagctaattggatgcggtacttgttctgggagcatctttattacttccattactcaaactccctccacctgcaaacacagtcactacacacagcgtactcctcattatcacgatgggatatagatgatgattgaagaaaatgtatgcatttttttcattaatgattttactcctctcaaagggacttttaactctaagtaaagtctgtttatgaatttctgataaaaccaaattattttacattattaaatttcattttcatagaatctcttttctatatctttcttaatgtacttttaggcaaagtcaagttatttttcaaaattgggtttggttagaattttgatcattaaaaaggatattaaattattcttcctccagctggaaatcaagccctctatggcaccctagaaggaatcatcactcagtgaggagtgatgtcataggagtgttgaataaataaatgcttaatgaatacatgagtgaatataagaatgaacaaatctataaggcaaacgaattttgattctttcctatcatttaataaggcaaactaatttaaccaaaggcagaaatcaaatctactggtgtgtttcatgtataaccactataggtaggttttgtcttaaaaaatagaaaagcccaaaataagacagctgattctcaagcaaagatgagaacaaacacaaagcccttccagagctacatgatggaaactgtgcggaaagtaaagactccctcttccagtcaccaacacatgatacttggagaagaatgtacaaaaaactgggaagcacttcagacagactgcccagctctatttgctaataccattaatgattagttcacataccaccctcctatttctcaatcccaaggttcactcagatgtctaccctagttttccctcctattttgcttttgatgtggattgatttgaataaaacatttaagaaacactaatttagagtaagagctaaatgtctgttttttaaatggtgtcttggcttaaagatagaaaagcagtcattaattttttgtcctaataactaaaaatgatgtcaagcagagcagatggcaagaagagtgcttgtacagcactaagcacctcatggtgccggatgactcaaacaaagcacaggtcaagaagcccctggcctgaccaacattggtcagaggagtccaggaaaatacatttcttcttcttcttcttttttattttttacatttcttcttctttacattaatgaatcaaattttcaattgaaaaattaattagcacacatagtaaaatttccccaagtttaaaatggtgagtactcagcccccttctacctcagattccaaacgtgtagccacctcttcctcaaagctagcaacttctaccatcaccttaagtgcatacgcagaaagatgcttttgagtgaaacatatttatgtatgtacagtcttagcatatttttccataactgggaacattgtgccttaacttttccacttaaaaatacaccttgactacatcaataatgatgcagccattcaagagaataactttctgctgtaagaaacatgagaatgcagatacactggaaaataaccaaaaggttaaacttagagctaccatttgtcccagcaattccactactaggaatatacccagaagaaaggaaaatatatgcacacacaaaatcttttgcataaatgttcattgcagcacatttcaaaatagccaaaaagtgaaacaacgcaagtgtctatcaactgatgaataaataagcaaaatgtggtatattcatataatggaatattattcggtcctaaaaaatgaaatctgatatatgctacaacatgaatgagacttgaaaacattatgctaagtgaaagaagcaagtcacaaaagacctcatattatataattccatttatatgaaacattcagagtaggcaaattatagaggaaaaaaacgtagattagccgttgcctagagctgtggggtggaagggaggcaggtgatatggagcaggtaatgggggagatggagggtgataactataaggtaaggggtttcttatagtggtagtaaaatgttctacattgattttggtgacggttgcaaaagtgtgtgaatatactaaaaatcacgaaattatacaccctgtattgatgaagagtagggtatgtgagttatatctcaacaaaggtcttccagaacaacacaagaagcttctctatgtattgacacactgtcaagtgcaaaatacaaactgcagaacaatgaatgtgcagattatacttctttttgtttaaaaagggaggaagagaatagaatttatgttttcattgcacttacataaactctaagagtatatacaaagaaaactagtgaaaatggatacatgggagtgtgcatatcttcttttcaaagtataaaaataatacaatagtaaatgtcatctggagatagtgtcatactagagaggtcttcctcatagatgcacagtattgtcttatagttgtgcatcagttgttcaatcagccatataccgattgacatttaggctttctccagtgttctgttacaaaaactccagcagaacatttttgtacatatattttttgcacctttacacaagtacatagagtaaatgttaaaaaatgaagttgctagataaaagatagacaagaaatccttaaagtaatgcagctaaagaatatcccttaaatttgttgacaagtatagtagctgtaaccccagtagtattttattgcaattactgagcaaaatacactttctttctgataagaataaatgaaaacaggatttccccattctctgtagttagagcattaaaaaggaagcacaataacttccttttaaaagaaagtcagacaaaaaccaaatggtttattctatgtaagctctggaagttgagaaagagaagcctccttttaataggcatgaatttgtttgaattcattatgtggcttctcgagtgctctgcagatttaaaatgacctttcagcctcaaagtgggagtctcagagcaaaaggatgaagagaatctgtttcaattaagataaacatcaactaccaagccccaattataccatttgaatttgaaaaaggcaaaactgttgtcaaaaaaaattggaaagcatcaggacagcagtaaacctggtaaaatttaattgcatcacgttttgatgatgttactgagtgttcatggaacgtagggctatgtttggatgcattcctccttttccttccctccactctccctggctcattttggagttgtttttgagtgattctatttagctgcattggcatctttacttaaatggacatatctgtgcagagaaaaccctgttattcattatggtcaaagaatggtagatattaactaacaactacgtaaatatactaaaaatcaatacattatataacctctatagatgaaaagtatggcatacgagttatatctcaataaagttcttccagagcaacacaagtagcttctctttgtatcaacatactgtcaagtgcaaaatacaaactgcagaacaatgaatgtgcagattatgctccattttgtataaagaggggggatgagcatagaataataaagtgatacatacatctttaataaatgttatgatgttgaaataattacaatgcaatacatttcatactaaataaaaatcgtatttagttacttttggttgttattgttgcttttgtcatgattttgctgttttgtgaccaaaaatatacttgagaacttgcatacatgaggaaaatgatcgtggcaatgatgtgtgatgggtttcagttcatacaggccaaactgtgtttgctgtttgaagctgatggaacccattcataaactccttaagggtggccaggaaaaagaacaccacatacatcctgagcagtctttccagtaagaatatcagtacctggcctttgatatgtgtggctgtcatgctcatccctactgcagtttggggaaccacggcttacatctgtcttttgcatcaaccatgtcattcatccagcaggcacatcctattaccagctgaaggccaatattacattctttgggaaaactattccaaccatttggtagaatttttttttactcacatatatctactatccaattacatttagaactcagatcagaggcaaatttagctcagagaggcattagaacactgaaatctatgcacttatggcaagagagaattcagcgagggttgcctggtgtgtcacttgctacttaaagtcaaagtgagatcttacacctaataaaaatgctcttgtagtttagcaagtcaaactcttgggagggtcttaaactttgtgtaaagagaagggatttacagcagcagaacattttcaagggcacttttatgtcagaagcctttccttttttcctaggtgaagtccactctctctgacctcggctcaccaaggcccctgggaagacaggctagcaacagaaatcaggtcagatatgtacagaaaacaccccagtcaaagacaaacactggagacttgtaggtaggaaacccatcatttcacgttgtccaacttttcactggaaatctatacatgagtgccatataaatttaagttcttaagacagcaatctttcacttcttttcctttttaagtgattgaaaaagatagcctttctgctcctcatatctgctggatattcaagacctttgtacctgctataatccccttctccccaatgtttgtttgactggttctttcagttctcaacttccctgaccactccaactaaagtacatctctaggacacacagccacaaagagacacacagacacagacacacacccatacacagacatacacaaacacactgtttaactcggtccctcctgtgttctcttcactggacttaaaacacaattaggaataattttatttagtgaatttgttttgcttggtaagctccaggaagggagggaggcaccattgcatctccagagcctagcacagaaaggagataaaatatgtattttttctgtatagaaactaccctaaataaaactgtagaaaattattctaaataagaatcttgctgttgaactattttatatataaaagtatatttatttcttatcttcttgtatcatctttgtaggctactattaaaatataatttacatatctctaagaactgagatacattgttatatcagttagaaatatatatcatatattatatatcatatagataacatatatataatcatatatcatatcatatatagatatatatatcagttagaaatatcagacatttcagtttagaaatagcatatttctaaataatatacaatttagaatataagatatatatattttaagaagactatgtcaaagaagtttcaaggccagatttagttagaagtgatactgatttttttccacattcatgtgactttaacagaataataaatttagattaaatctaattcatacttttattaattttcaaattaaggaaaaattaagttttacctagaactgttaagacattttcagtaaactttccattatcatttcacttgtgagagatcatatacatgtcatatcatacaccattttgtaaatggttaaaattctcacattctcaaacagtaacttgttttaagactaacatgaaaacacaaacataaacaagaaaatattaataggagtttttcccttctaataataaactggctagcattttttttggtttgctgtgtccctaccattacttcaagcactttccatgtattatttcacttaacattcacagaaaccctatgggtagcttttcccccttgtccaaaatcacccagcatgtaaaagaagatgagttccaaattcatttgacttcagaatccacccccatctctccagtacatattgttggcaattccaaactgccctggaattttaatagctcagctctatgttttcctacagcctaacaaaatagaaatactttgaatgaagttaagcacataaggtctgacttcgaaatgataccaaggtttaaaactagccattaacttttacatggaacaaaaaggaatatttataaagccatacagaacatggccatctggcctactcctgatgcaagaagctgaaacatgcttctgaaaactaagtgctttttatttctttctttagaattgttaaaagtttcttggataactgagaaaaaaaagaacctactttctcttgaggatgccagagtaagtatctttcatgtagcattaatgttctatttacccatcaaaaacaagggttaaaagcaacggttacacagagtccctccccaagcctctcatatataatcagaaatatcctaagggaccaattattttctattactcctattagtcagaaattcacatattgcaaataataatttcttctctccgtcggtctgaatgaatttattcaggatgttatactaaattagaaactgtgaggattatgaccaaacaagtttccatgaatttaacatttttttctacaaaactttataggatttcacaaattccagcatcagttgatacacaagggactcccctttctattatctgactacctgaatctaccctgtcttagccaaaatagattatctgttactcctttaaaaagattgtcctgagagtctttttttctttttctccccaagttggttcccattctgaatttggacactaacgaacatagaaatcaaagactgtaaagcaactatttattcagaaacatttcagaagacactaaggtttttatttagtattcaattaagacttgcctcgaaggctgggacttctttatgtgaatttgaaatttacagggtatgtcacacctacgctatatttaggatgcaactgagtgaagatgaaatgcctaaagcaattggcaccaagggaatttggtactttaaacattttggaaagcccaagattgcatgtgtagttacatttcctatattctttctctatctcttttatacacttaacacacaaatggcatgaattacgaaagcaaatgtgtttggcactttgaacaaattatccatcttattgaagtaagttagctaaaacttttctttgtgtattggaaatttagacaattgtttgactattaagaaatgatccatgggaaatttgaaagataaacttctgtactttattcaggaaattactaacaatttataagaaagtcaaatcgtcaatataacagaaacagtgaaaaaccaaaaaaaacaaagcttcaaaaaagctaattacttaaggagggatgaccaagcatataaagctaagagaagggagaggttcaaattagaaattaatttagaattcaattaaaatcttataagtaacgtttataaagcttacaaacaaaatcttacagtttttcccgattactggctaaagtttataaaaatcatttatggaatttcccacaatatacaccaaaaaaaaaaaaaaagcagaggatagtaaatgggatgggttttaaagtcagactaagttcaaaactagccatatagaactggagctgctgtaactgcacacaaatggtatagtagtccagatgtatgactggcagtcatagaataatgtggttcattgtgaaagtcagataataatttgatattttgttgtaaacaggttttccattcttgcatggtgcccttttatggcagttgtaatccttaagggcaggccttttaactgaactacactaggacataaatgccatttccttctgatttcctgcattgaatctggtctttgatagtccattcgaaagtttttgttagatccctatttgatgtaatggccttacttattaatgcagttatagccagggattatgcacagtaacaaaggaatatataacagcactcaagcatagtaatagtaaaatgagtttatttagagagctgacaaacaagctagtagcagttatttatagaaagaaaaagtttatttctcttattagtgaaatagagcctcaagcattcaaaaaatattttaactagggcctataaaaataaaggtctcccgaagattatctgtaaagacagattttggcaataagtgaaataatgccttatattcattttatgagttaattttgtataaaattcacttttttccaactattttttcctgatgtgccctttttgtgttccctctctacagatacattaaaatgttctactctgtatattttatctttgaaaactcaaaggctaaattcattaaaatgagaaagaaatctgttggttttaaaatttatttaaataaaaataaatttaaatatttaacttggctgacacagccttgttaggaggtgattaagtaaacaatttacctagaataaaaatatctcttattaaaatggcatggatttccaggccagtaagaaaagaaaatatctctctaacccagggaaagtattttggtctaaaaaatcaaatattccagatttattttatattactccaccccaaattcaagtagggaggttttaaaattatgttgtttaccactggatttctggaagcaactgaaacacttatataaatgcacactcctaccaggaaagtaaaaactattccaaggatatagtagaaggtgaaatagaagtctcctgccctatagaaatacttcagaaagtcactagaccataaattttatgaagccgagtgctgtatatttcaccattgtctctctaacagccagcagggtacctgtggcagaacaagcttaataaacacttaaataaagcaataaaaaatgcacctttacttttgtaactaatagacccacagaaataaaacttttctttaaggactatatattttaagctatagaactagactaaatgatcaggtagctagaaaatgtttctgtacaatactaaaacaaattacttcctcattattaaggattaagccttaatttccttctttttttttaagcctaatttcttgccattccaaatatttaagtctgggagtgtggtaaagctaaaagctggcttcacaatcggaaaagttcacaatacaagaaggtaagccaaccctaagttgttccctgactttgaaggtcgggggtcaatccctgtgttagggctccaggacaagcttgtcactttggttcagcatccctcctgtggaatctgctcatatgtgacaactgtgtggggtttcaagatgcacacaatgaggttagagtgagcctgaagtggtggtcttagtacttaccaccaacagatttcttggcttcatataaaaatcacccattgatagagtcagaaggtcagcatgtcagtcgggtgataaccatgtgcaacacatttatcagcatttctatatgcactactctttactagtttatgacacgagaagagtcattcgagcagtcagaaaatatagaggaaaacttggaagtatatattttagaatgggaaacacaggaggcaatggaaggtgtgcctagattagaattgccagtggtggtggcaaactaagggtgaaagaaagccacagggaagaggcaaaaatcctcccggatactatacaactcttgccataaagagtaactactgtgtctacaactcacccagtacaatctcctgaaaagtgccatctactaaaagaaaattaaaaataaaaattgactgtaatattctttgtaatatggaagaactcactgttctactttccatgcaaaggacagatgttgaatgcccatgatggagcaggcatggtgctgggaacaggggttcattgctctacaaagatgagcaaacccagtctactccaaaacatgctcacaggagaggtacgtgagacagaagacaataattgtaatccttcaagagttagagaaatgtacaaggtttcatgacagcacagagaagagagttttaattctaattggggaagtctaggaaggcccttcagaagaaatgtccactgagggtgaatctaagcaacagaatttggatattaaatcatactaaaataattattgtaaaatgacaacagtttaaaatgctcaaatagtcatatataccaaattattatttaaatagaaaatctgatttttaccctgaatttgtatctcaaacaaaagtttgcttaattacctatacttaagtgagaatgaatgaaccatatccgcatcaacaagggatcatctttcaaacataattttgcaagggggtgagggaaacagccaaacacaaaagagtacatgctatattattccttttatataaaattcaaaagcaggaaatttaaaaagtttgtgattttcaaaatcaggatcactattatttttagtaggtgggggcaggggcttaaaggggcataaaggtgacttttggctgctggtactatttttaatctgggtggtgattacaggggtgacctttgaaaattagaattacttatttttcttctttgcatttgcaacatccaaaaagagtttttctgtttacaatatttatatgttcttcataggtgacaaatagacaaaacatatcaaaaaatacacatgtatttgtatgtatgcataaaacctgtttctgctacaatgactttatttgcatgcaaatttaatggtgagattagatatatagagttatgatgagatcatcaaggccatttaaatggcaagcagccacactatgtccctcttctgtctggcagagatcaccaatggatcacagcacattttctctgagaccaacgcagctctcagtacattattccaggcagctactgctattcgtaattacaagttgcccatagattaaaaagactagctatcttggttttaaacaatgcagactgtctaattcttttgatatttacatgaaaaagatcttgcaataatggagggatttcacatatatttctaggtaaacataaaatttcattcctatgtacgtaaaatgattttttcagttacacgaatacctttaaaaagttgtctgctaacatcaaatttgcttttttgtgtgtgttttatattaccctagaagctcttactgattcatatactagtagactcttaacgaaacacagaaaagtaattgggctatctctttttaaagcaaaacactcagggaatctttaatggttaattttttttcccaagctggtgaactccaccctcaatcacacttaatccaatgtgcagttgttaattataacaaaataatgcttttacagtttgttttgttttgttttggtaactactcataataaaatagtagatatcagagacaggaatgctaaatgcctgctctaacgtattgcattcttgacatttctagcccctgtggctgttcagctcatcctaacacttcacgccacaagaacagacctaaccagatctctatttttgtctgttgttctttagaaatgatggagaaagcatcttaagccttctgcactgagctgggatggcgggacaaaggaaaaaggagtccttctcagtctggtctgatagagatgatgaggctcagctccagggagataataatctgtgaattacacaaccaggaatgcaccttaggactagaagagtaagggatttgtagaggtagagaatgcctggcagtgtgattaccgtaggaccaagccacagggtggcacccagtaggaaagatacatggagaaagtctttacaaaggtgcacctagagataatgctcaggtagctgaccattcctttcagatgaaacccctgcctagttgtgcttccttagagggttctcattgagttttaaataactaaatcagaggtggtttagcttcccactgaccacttcttattttgccacctccactaagtagtttacttctttgacccacctagatagcagtgtgtcttctttgaatcacactattaacgtgatttatctggaatacctagctctatataaatgcttaattctgactgtgttaaaaaagactaccttatggaaaagaaacccttacaaaatgaatcagctttcacatttagagttcttgattatttagaaagtcataccaatgtgtaaacttcaaaaatgcataatataagctaacagttcctggtcactcacaaggagccagccatgtgctaagcacttcaggtagatcaactcattgaacatattaacatatacatcattgctaaaggtaacattttataattaagaaaatatgcgaatcatgaaattatcttatttgccactcaaatttaggcaagccactttacttcattaggcctcagtctgaggaataagactaatgagtactgtctaggattcatcatgaggatctaatgagataattaggtcaagtgaacagcacagtgcctggcacatagttaagtacacaataaatacaaattgccacaatttttaattcagatgaagactatattgagaggaaagaagtaaatttaaaatttcaagatgcgaattacagctacttacttagctatatgacataagtttaggaattacattatagctcaatacaaattataatagaactgctttcacacatttgcctgacagactaatttttagctctctttttcagctcaaacttcatttttgaagttaaaaaaatatttctccagccaggcatggtggtgtatgcctgtagtcccagttactgggaaggctaaggcaggaggattgagactaggagttcaaggctgtagtgcatatgatcacacctgtaaatagccactgtacctcagcctgggaaacacagtgagaccctgtctctaaatatatatatatatatatattcttcaacaaatctttttaccacttaagcattgacattgtttttaacagtttttcttgaccctacttgactggaaatgttaaagactagcaaaatgtttccagctccacattggggttaggggtggggaaaatcagattataggttattctctgtggtctcttttatttcaaaggttttatggtgctactaactggtcaaatgccagagagaaggaaaactgcaatttatagtctgaccagaggaagagagtcaataagctgaacgagtcaggaactagctagatctccaaggaatggagccgtgtcaaagtccatgttctatttctcaatatatctctagggctcacggttggaggcttgtatacaaatcttggggggaaaggcagacaaataccataggcaaacatgttcttgatatacataagattaaaagaagaaacttgaacagtctaggacaggaaggaaaagtataagtagcagcttgttgactacttttctaataccatgaaacagaactatgtgtagccaaagcagtttagatagtgaggaaaagcaaacaaaacaataagaacaacaacaacaaatatgggatgtagtttcgacagaccaagatttttctgcagcactgtaattttataagctgtgcgacttcaagttttattcatacagtttattcatacagttgcttcaactgtatatagtactaagttcattgtctgtcaaagagtagatgcccaatacattgtagctatcattaatgaggttatgactccaactatgactatagacctagaagctgctttctccagctagctggtgatctagctgccaatcagttacttgctattctataacaaagttgcagtatcagagcaaaaatcacagcccgctgttgcctatcccatgttagaatgccattggttaaaagtggacacattttacagtaatttatcctgactaaaatagtatcagtcatataaattccttgatgcaaagaaaaaactctgtgccacattgcaatggaatgacatcctgaatgttaggaattattattttctgtattccatatgaatgtctcaagcaagttcactaaaaagagctcaatttctcatctttgatgtattttaaacaagaaagagaattagatacaacgggagcacttttctctaggaagtctgaaaacaattacatactgaaattatgtttaatgaaacatttattttaacaagtcacactggtgccatctattttacaatttagaatgaatattttgcaatatgaaatgaaaaaagaccaagaagtcactcactagcagttttcaaaggccataaagaagaattggtttatctattgattcactctcattatatctactgacaactaagaggaaatgggttagaatttaagcaaagaagatttgtattagatataaagaaaacttcctaactctgtgggtttaaaacaacaggactgcttcctataagggtactttggaagatgcaatccttggtgtgcatacattctacacctagtttctagttttctaatttcttattcttcctcatgtgtagtagggaaatggaagggcttgcaggtgaccccctttaccctatggcagaaattcttagggctgagatggggggcaaatgtcctctacactgagtttcattaatggcagcttttgcccagaggttgccagtgttattaaacagggtagggtgctagatggtggatgcttagttcaaactgggctggaattcttccatattggtctctgtataatctcttttttcttgccacacttccccagctcttctcttgaaatattcccttgtgtttttctaactcttattctgaagagcagttcacccttctgttagcttctctaattcgcatcctcagccatcacccaggatgctcattagggagccaatccccttagaaggcttaggacagataataaatacttacaatattgcccctgtcatgctaaaaaactgcatccataggttctggcattcttcctactttccatacttttgaaatgctttctaatttaggtcaaacttgacaaagaactaggcaatttgagagctgagacatatcactggcacgggctctcattagttagttacctgtacacagttatatttaacagtgtctcacccaggcttgctgtcattgtgccccatgtggtaccccagcccttcccataggcaccaatccctggagagatttggtgcttgtggctgaagtataccttacttctgtccattttctaatataccttcaacccctgtattatattttgagatattggatcacctctggaaaggcttccaagaaaatctatattgattttttattaagactgtgctttctttgtgactatcttccttaccaacctagctaatatccctcaggccctattctctatacctttatctaaactttgacaattctatatgtttagtattagtattattgggaatatttatacatatcgctcagcatctttccctaaaaagcttaaaaactccttaaaggcctcattaatattcttccccttcagtttcatcttagaatctacttttctcaatcttgctagtaatggttgggtggatccatgactaaccattcgtatactcatggttaccttcatgtcatcatcccttctgattcaatagaattcactacatgattggaatgattgacagaggaactactaagtgagctattcctttacctctcctaaaaggcaagttttaatgataaggccaaaaccatggtgtgcctcagatccgtggggaagaaaaaaaaaagagttgcagtcaggactaagtattattgcacacataaccacagccagttgacatgatagaaaaagagggtggagaaccccattttgaaataccaaaagaagcgtcttgcttctgaagaatttcataccaattcagcatttctttaccaacaaccatactcacttcctgaattatcagctatgcatcatacagtgtttagtgcatgattttctcattccagatgagcctaaaataaacttgtaaaaaataagatgctaaataaaatgaatagatcttaactattatagtgataactcttctgtgatatctcagaagtgggaaaagttacataacttcaaggtcttataaggcagaggtatttgaactgctacattacctacgagtttatcccaatccatatagagatacagaatacacaaatgactctcccgcggtaaggcagcactgcagagagtaaaactgtaagtgatcttaacagtcattagcttagtggttttcaaacaatattccttggaatcctaaagtctttagaggtattttaaggagagggtttgaatttggggtggggggtaaatgtacaaactcagtggctgttttattgttttatgtgtgcttatactttttacttatatatttcacacatatctatgtttttaaaaattatatctatatattgaatttatatatgattttatatctaaaaattacagtataaatattcatttatattaacttcaactcacatttcattaataaaaaatgtcccattgaaataaacgtgtttaaaatccattgacctgccttgccccttttattttacaggacagtagacttggcttcagagggactaggtgactcctccagggacacagagcatgttagaagtacagtggacaaatggctttttccagggaatctcatacttcatgactttaaagagtaaacctatctgtgatccactctgtgtctttctagttatgttttaaatacatcaaatatttcaaggtatcttaatcatttctaaaagctgtatatctttaagtatatttcataacagatacatcactaacttgggtaataggaccaaaaaaagtttacctcatgctcaaaaccctgaaccaactttgacagtagtcacatacctaaaccaaatcataatatatattgcacaggcagaaaatatgagaattccatttgtttgcgtatttacaagtttctaagatagaagaaataggaaggaagattgcatatttttttcaaagctgatcttagatgtcatacaaaatctgatatgtactacttgtttccaacctgaagccttacagagcttgcagagaacagaaaaacttggtaatagaattggaaagataatctattcaaaattgtgaggcattggccttttgttctttattgtctgttataaagaccagaggaccttatttgctaccagtagagaatataatggtctacaagctgcaagagcctttcacaaagctatttttcaacaaccaacagtctttcacaaagctatttttcaacaaccaacaacgtcaaccctgaatttcataggctaccatacttccgaaaagaaaactgccaaatactgtaatgcatctagaaatattcacaacatgaacacttttatggccattaaaaagataattatatccacagtagaggaaggcaacaagctgaagaaccagagcacgttctttgaggtagacagacttgggttaccccagcctatgaccttgctcaagttatttcatctcacggaatcattttctcacctgtaaaattaggattaacaactccttcttttcaatattgtaataagaactaaataatatatatgtaaaattcttgatagagctctttcataagacactcaataaaatgaaagctataagtattagaaaaatggattttttttttttttaaattgagacagagtcttgctctgtcacccaggctggagtgcagtggcacgatcttggctcactgtaacctccacctcctgggttgaagcaattctcatgcctcagcctcccaagaagctgagattacaggcatgttccaccactctggctaatttttggatttttagtagagacagggttgcgccattttggccaggctggtcttgaactcctggcctcaggcgatctgcctgcctcagcctcctaaattgcaggtattacaggagcaagctacgccgcctggccaaaaatagaaaaatattgatatgttaaatgaagaagcagagtacagaaatagtatttacagctatttaagatatgtaaggtaagttgaaaatgagaataactgaggatggaataatggggttaatgggttattttccttccaacatattaatgttattccatctttttgattctcaattataaaattggacattttagcttatatgaatgctttccactgtgatcatgaggccaaaataagaatgctaagccagtctagatttttacaaccttaagagaaaagagctaataaaaaaattataatcctccattggtcagagttgcaagaaaattcagaaaattgtatccaaccagtactgaaatactcatttgcatattatataacctgagcaaattgtggtttaatgtctaagtagatattggcatatataaagatgagcttgctaatacatatagtaggtatatttttaatattttaaactttcatatataatactttattgataaaaactacatacaatatgcaaatacagtgaagaaaagagaggcagtcccccttaccttcactcctaccatttttttttttactcctaaaaaataaccactaccaaaagcttggacagagtcttccagaattttttctgcatctacaaacctaagtattacatgtatacttattacataataatacttataatgaaaagtataagtactattacatatacaataaccaattttaaaatttgctttaaaaacaaccacagtcatattttgaacagtagcatctcttttattttcagattacataatgaatgatcttacatgtaacacataaatcctaaacactgttctgtcagcaggaaagaaaaaagtccacttccattgactaaacttctctttatatttatatttgtaagactaataatgttttacttacttaaactaaatcacaagtcttaattacattaatgagaagtatccctgggaaatgtttataaatgtttataaaagtgttaaagagatatcaaggaatatgtaaggtaatattttcatagtatataacaactgactaaatctgaatttaagatatgcaagaaaggcaaacaattctgcaatcaatgaatctgctaattttattagctttatgagcataagaaaatatataaagtttttctcaatttcatgcaggcacatttttttaaaataatgcttaagaataaatactataatcactttctgctagaacgtggcatataaataactgttccttaaataaaagcaacctagtatacacctttattaaataaaccctaaatttggacacctatgttacaaagagacaaatagattaattttaaggttatttgtattttgtcttgaaattaataaaattttaattataacaggctgacctttaataagaggaagggtataaaatacaagtttgccatgaaatcccatttaaaatgtgaatatctcatagcaatttaattaaggctgtaaggacaagttagtgtggactgctttttatgatacttggagagaaacaaatagaaaaaggtaaagaagtaatccaaaacattggattcttgcacaatacaacaaacttccaaacgtaatgtttggctttagggaatcccggaggacagtagacagatttggagaaagtagaccaatggaacacaaaatagatttatgtaatcagagtgaagatggtaaagccagaaagatgtgtcccaagaacaaagtattttggagatcaacctggaaacaaataaacatctgaaaaagagataaatggcaaagttttaggtctctctcatgggaagtcaactgaaaaggaatgagggtagggtggtggtggagaaatgcagacagcaacactggtgagaaaacattgtccctctgagcaatttgaggcctgtggcctttatgtgcagaggcacaagaagagaggccgtttgggtttttttaatgctcaagtaaacatgtgtgtgtgtatgtatgtgtatacatatatatacacacaaacatatattttctctatataccaaatctataatctatattgattttatacatgtaattaaataaataaatataatagatgtgtctaatatttgactgatagacggataataaaatggcaaaactgttactacagctgattataccctcaggccaaattttttggcagctgcagtgatatacccaagcggttatattattaagtcagatgtaagattaataactggagaggtttctatagtgtgtagttaaatctaagaatcatgcatatatagagagagatttatttcttacacagaaatcattctatccccaagtctatggagaatatttttagttaaatggaaaaatacacacattaacaaatcaaaatatttaaaaatgcattttaaattgtggcttgacttatgaaaatatcccatacaatttaaaacaaaaaatataataattgtggataaaaatagactatgataatctcagagaggtaaagggtgtcaatgttactcatctcctgaaatgaacaaattatttccaattgaaacctgaatttgaaaatacatctcctggcagtttagacaaaaagagaaatagtttggttaaacactatttttaaagtagtaacatcttttcacataggaatggtataaattataaatgagttaaattcatgtatattataaattctgtttactcatgttggtgatttatattagctatggtaattcatacaaggattttaaggattttccagtatttattgtttgaggaaaaaaaggacaggactctccaaatttgtttgcagatgcaatcttttctttaaataaactcaaggaataatttattgcacgtgttattttgtaagaaatggcaagtaacgttaagagacaaaatcttcatctataatttattaaaactcacagaaatactgcggatggggcaattcttgtttctggttgactgtaaaacactacaataacagcaaaggctaacctatccacaaaaacacaagctaaattcctgacgcaaataatttgagtatttacatgtgtgtttgcctgctcacatgataatgcatattttgctggcctgttttcctcccattctcaaccacctcacttcaatcattgcttttatttccccagtgtgaggtatgattatttccatttcaaagaggtgagcttagttatttataatcaatcactaagaaaaacaaaataagactaacccctaaaatagccataaaagtattttgtaaatacctattgtagaaaaaaaagttactttgttggaaaatactccttaagggccatgccatatgctgattagcatatcaaatcaccattggggaaataatagaacattagaatacattgaaactgacatattttttcatcagagtaaaagcattaaaataaccaaaaatataattactaggaatcatttctaataaaataaaacataagagatgaatgaatgataagcaacttgatatacatttagccacatagttaaattcaagtttgtttcatgtgtatgattaaatataaataacattattaatttctaacacatctgtgctaaaagtgagggtattgcttttaaagacaagggcaaagcctgtcaaccaccagcctgcttgcagcaagcaaagaagataagaaaacaagcaactgaatcaaacactgaaaaatgacaagttttcattttcaaaactcccaacatatctgcaagtttctttcctcctttaaaaattatcatcagataaattgttacagtccaagaggaattaaaaaaaaaatcagcacccatttggttaaagcacatgagtttgggaacaaaataaagaataaaagagccgccaatactgccttctttcacaaagcctcgacatcacacaacttactaaatactcaaggagtacgtcaatcttaaaagagaaaaggggaaaagcatgagagaaaagaacgttaccaaactgcctctgcagtccttagggaacttgtagatcgggatcttggcttcataataatgctcattttgaaaaaaaataaaaaggaaaataagtcttcaactattctgattaatacattctaactgtctttctgcaaagaagattttaaagatattccatttccaagggaggctgcttgaagaaatccaattttcctggagtccatctcctgtcctcggtccagctcatgggcaaggttctaacacgcaggagcgctttcttccttcatactgaatttactccagtactaggctgttaggaagtgacagtttcttctgtgtcttgcaatgccaagggaggaactgaattctgaattgattcttcatctgggtcacaagggaaaccagcatagtgaaagagtcacttgatctcttttttgcaattccatagtaacagctttaaaggtttctgacactcgaagagcgcaggtagagagagagaaaaagaaaatgaccgggaggtactgtaacacgggagagctgtcaaggaagttccatttcagggcaagcacaggaaaacactcctctccgtggagcaaagaagtcagccaaggaacaaatctctccacactttggctgggtgggctgatttacctgcgaaagtaatttctgtgtgtccctgcttagaatccagggttttgtgaatgagaactatcattcaatctcaccaggcagaaactattcctcaagggctgtatgacgtctgtaagaaggcagttcaaaacaccgcagggcagtgagaaaggaaaaaaaaaaaaaaaaaaaaagaaaagcccagcgcccagcctagcctcgtcaattgctgagacttacaaagcaaaggggcggatcagctccagagaccagcactgtaaaccggccaagcagacaagagacctcacaaaacttataaaaccatttccttctctgggaaatgagatgtctgtgttattctgggtaacattccgtgatcacctttacaaggaacacaccccttgccattaagttgtttatttaccataataaacaaatgaattttataaaagtcattctttcaaaaaagtatttcactgaagcactaaaactaaacttttctctttagaagcaaagttgagagaacttgatgacttagcagctgttcattttgagcggatgtaatgaaatgtcatgctttggagttggttgtagagatgtaaattacctcttaaaaattcagcagagtgtaacaggcacccttggatcagaacatactggaattttaaactgaaaaattgaatgtattattcctggacaagtggctgcacgtattaaggctgttcccttgcacaatgttttctaaaccttatttttttttaaaaaaaatgcaaatttcattcatctctacacacaaagacttgggtttgctaatccttaacagctcttcagtaaggaatgaagctttatatcttgtcaatatctcttattatttcgaaggccaaaacctttcccacctcctaaatataaaatattttctattacagtagatataatctaagctgattccaattgctcccaacagaaggaacagttgaccagcctgcctatctctctgaacatctacacagaggatatatactcctctgggtgtgccaacttcaattattttggatgtgaattaccaagtgaaaataatgtaagcattctgattgcttaaatggcattagctagtacgttggttctctagtctgacgtgaacttggtgtttatttagcatttgcagacaggatgttggagtgcagttgtgacccacccaaacaacttggaaaatgtagtacggcatccgccagaggctctggctgcttcttacaacaaacccttcatctgctcccctggtcacacttcaaggtgcatttgtgacttagtcttctttcaatgactctcaggcctcttacggtaaatgccaataaattgctttccacatagttatccccttaagcttttcagtttccttatgactgccaggggacattcacactttcttagcactgtcccatgtctagtatattgctggcattttaaagcaggttaattaatcatgtatttttttggaaacttaaaagttttgtgagactaattatttttaggggagaggggatttagaggaagaggtttaatttttttcttattggaatttaaatgtgggaaaagaaagaacaaaagcaaaccaagtaaaattaggcaactactatttatttgaaacactgttccctccatgtaaggtctaccaaatagcttccagttgccatttcagaaagcaaatgacaatgatcagagaatgtaatgtctgactgttgagttttcaactctccagaaataattagcctgtgttctaccgtcccccagatccatgttacaatgagcttatttagcctgatgctactcccttctctgtcacacacacacaagtttagtgcagccccatgtgctgttccttgcttacttgcccaacattctacatcttccaagaatctttctctgaaaacctaacacacttattgggcatctactaaagactgtataatagtaccataatgactaagaaatcgtccctctcccctggcaaaaacaaacttaagtggggaatctgacaatgtatggaactaaccagaatactcaaagtttttggattggtacatcaaggttgccattacagagaaagaaagatgcgctatgttgtaagaccattgagatttaaatttaagttttgcttctactcctaatatttaaggtagtgacagaataaaaaaaaagtatgtatttgatgttacagagttttatccacttgtaagaccatttctcacatgaacatttctgaaagaatgttttgttatctaagcatcctgtagttttccctctgaaaagcttccccaaatggaaaagatatggcatttccctcgaaattcctgttagcatgcaagcatatgatggcatgcaggctgatgaggaggcctgaatatggggagactggatttaggaaccatgtggcccatgcttttgatccagaagctgcgattatttctcagtatttccctgttgtactgaattgtataatgtatggaccttttactttctggttgttaccacatttcaatagactgtaccatagatgtatacatccattgggtcatccatctgtagatgttttgttgaatcaaatgactatgtcatttgatgtttctgaaacttcagtcataacaccaccttcataattctttccatattagcattccatctataccatgatttgatatttttcttaattgactcactttttaaaaaaacttaaactgaatataaaaggtaactttatatttattctgtaaatagatttaatatactggtataatttgcccccaaaatataagatatattaatagaaaaaaaggagtccaaaataactcctaaagtctgtctcataccactaatggtgccccgatacaacttggcaacacttacatggaaagcgtcaattgcatacaggtagattgtgcgcacctaaaatgtgatctccctttctcttatcatccaatggtgagcgtgacttgtgagacttatgacatttatccatggattaaacattaaacattaaatgaagccaactgaatgaggtgttacggagtaattttactatacaactcaggttttctcaagtattactattttcaaatactctgcctactatcaaatcttctgttctctaaattcctattttcagattacaatagatattctatactttccaatctatcatgagcatatttcttagagccatattatatatcaactaaatattcaggcctctcaaatatgctgaaattcagtactccagatatgtcaaactaactttttagaaaaaaagaccaggggactgcagtttttacagtttcctgctattctctattgtactctaacgttaatgagaataagacactgaactcctgtagcagttcctcattattgagaaatattgtgttattttccttatctggaggggaattttgaggcaatttctagaggtttcttttattttattacacttactaggaatacagttggattcaaggactttcctactggcatgaaccttgcttggagctacatttcttaattcccaaaggagaagtccggagtattatattttgaaggctttcctatcttcagatttcctacctctttcataaactgtcaggttaggataataataataactactaattattaattacctacatgctaagtagactatactttcttaattatacatcacaacatccctccaaagtagatgtgataataataatttcatacataaagaaagtcaacaatttgttcaaaatttttggacccaggtatatttcattccaaagcttgctcttcatgatgtgtatgtgtgcatgtatgtatgtgtatgtgtgtgtttgtgtgtgtgtgtgtgtgtggaagacagaaagaaaagaggaagagaaagagattaaaaaatgctaccaagtttttggaagtttttaaaattcatccatcctctttagttgtacagtggcaatgaattaatataataaaaatggtgcacgtacattactagtataatgataaacatatttaacagctagaaaatgttagatctttaagatatgcaggattaaacaatctaacttcactgtccttgtttctaatttttaggcactaacttttaggtatcataaacactgtgatgagggcatatatgacaacatcatgagtttgttagccataaaatatgataaggtctttgaccatctcacaacatgagtaatggtagtttcctgttacctatgcaacagatgacattttgattgcctcattaggcaatactggttaataaatgatcattttaaaaggtaacaatacgtgagacctctggtaacgtataaatttcaatatttgtcaacaaattacattggctattaaaaggtacagaatactagtttttaaaactagaataaacatttgtgcatggagtcagtaatgttgacataaaatgaattttgtaattgactttcagaattttgcactaattcaatactggatttcagaagaaaaactatctaatttaaaattttctaagtgctgctgtatttcctttgcattctgcctctcctcttgtccctctttcacatttcttgttcttctttattctaaacttaaatgaatctctgcaaatttaacattattttgaattaaatatttaaattttattaaagaaatacatgtaaataatgtaaacaaagagcaatgagtgtaatatcctcaaactccagcattgattcctgatcccaattcatacacaagaatgagaccctagaaaggtgacagtaagttctaagtgcatgggtgaggcttgtgtactgggagttttactgcagtatcatcaagtgcccagtggggattttttttgcctcttccaaatgttactatttgtaagagattttttcctctggggtatctctatttttctagagaaggatataaatatgcttcctagcattctggtgtgggtaggagaaggacgctgaaggtcttactgacacattgcagacattcatttaattgtcctaaataaagttaaacatacagccatccttctcctactctttgcttagtatcccaaagtctctgtcttccatggagagggatgcaaaatatgttgactacactgaaaaagagtgagggcttatggagaagtgtatataatatacatgttcatacacctgctatatttagaactcttccatcttccaaagtatgttttgggcgactggggcagctcagtttgcttcactttagtattgttctctgatttggttaagtcattgaccttttctcttcctacttctatctttatgtattgtggcttagagtcacagacatctcccagtttcctcaaagatgaaatgtacctttctgttttttgtactaattattggtttgagtgactttttaaagaaaaaaatggcataggaagattgtttctccacagttttaaagctagaaatctataagttctactttaaaacaattttctatgtttatctaagcatacgcatttacaaattttatttatcaaatgactatatgtcaactctctctaagcataggtaaatattaagtattttttattatggtaaaatacacatcacgtaaaattgacattttaaccctttctaagtatactgatcagtggtgtaatgtatattccccctgttgcacaacgattatctccatccatctccagaactttttcatccttccaaatcgacaaccctgtactcattaatagtaacttcctattctcctcttctcccagcccctgacaagcaccatttggctttctgtccgtatgaatttgactactctagatatcttatataggggaatcacaaagattaagttgtaaaggtagattcagaatcacatagccagttatggtctagatgtctcattattaaagaaaaaacaattatggaagcacaaagtttgaagataacaattcacaccttgagaaatcaatgtacttgccttatccatcatcaattctttcaaagtattcacttgactttcatagacaaagtcaagagcaaaaatatctttgcctttaccaacatctggtgtgtgtttttaaaaattattcttctaactattttttttctgtttaaatatatacaaatgttatcagtgcttacccagtctggtcacattataactttagttcttatttcaaatttatagtagcttcctgtatttaatcaagtagttcctaactctatataccaatctcaagggataaagcaaaaatttaaaattaacttacttcaataattcttaaaagacttttgaaagagatgaaacaactggaaagaccacattgccaaatgaagccctagtttctaacactgagataaattgagattttcattaaaataagattggaggctgcgcgcggtggctcatgcctataatcccagcactttgggaggccgagacgggtggatcacctgaggtcaggagtttgagaccagcctggcaaacatggtgaaaccccgtctctactaaaaaaatacaaaacttagctgggtgtggtggcgagcacctgtaatcccagctacttgggaggctgaggcaggagaattgcttcaacttgggaggaggaggttgcagtgagccgagatcgtgtcattggactccaacctgggcgacaagagtgaaactccagctcaaaaaaaaaaaaaaaaaaaaaaaaagatgtgaaaagcagcctgtcaaaaataaatgaacacaagatgtgttttaataataatttagtttctgatgtaatgggaaatgttgaaaattgttttattagaaagtaaactctcatcaggacctttaaatttacatttatttgataacatttttcttgtacatattaaaaatgccaaaataatccaggcaactcaggcagtttctccttgatcacagattacaaataagttttctctaatgtaaaacagctgctctgagaaaaacgcctactatttaggaagggtatgtaggatcaagttaagaagaggcctttggagtcagactgcctggttgcaaatccaaattccaccaatcactagttgtttgattgcaaacaaattatttaaccttccctggcttcagtttcctcagctataaaatggagatagaagagaattttctgaggactaaaaaagacatgtaaaaccttagcaaagtatctagaaaatggtaaggaatcaataaataatatctgctattaaaaataagttttaaaagagtaatcaataagctatggagaaaagcagctttaaaacttaaaaatatatgttactgcactagtatttgatttaaaataattggtttgtgcttttgtcttcctttggatcctgtccccttgactccctttacacatagcttgtgtagttttcctgacttctattttacacatctaaggtttttttctcttatctttggattatctttcaaagatacaaaccttaaaatgtcaaagcctgtgatgaaaaaccttctatagcttcatattccttacaggatcaatttcagccttttttgtgtgttaaataaaaacttctaccatttgggttcaatctgctattcagctttgcccttgataactaatttttcccaccctatattgccaaccacacaatctcacacaccttgccccaaatctgctcactttgtttcccctgcctggggaacctctcacctttctcccacttccctgctaagtatatttcctactctgccttcaagatctagcataagtagcagtaaagcccaactaactccaagacaaactcagaagttcagtctccttggattgattcaatctgggaatatctcaggttaattttgtttattataattattattttataacacatttgcagtatatggcaacacacagtgaacatcacagggggattcaaatcccacagacactgtttagctatcgatttggactctgtaagctttgaaaacacattatctctttaagattcagtaccttcttctacaaaataaggacaatatgcacacctagaatcctcccagggttcctctgggattaaatgagaaaacatgctgtccaatctgcaatcccttgctcttgatcactttcagatctttgcacacgcatttctggcaggattatctttcttttcttttacccctctttttgatcaagagttaaatcaggactacgcctcccatcctgctgctctgcaatctgaattaggtgtctggccatgcaaatctctagatgttcatcctaatttctttcaatttatcagcaccatatggtcatcctctcttcatttggttaactataagccactaactaggaactcctactggaaaggattgttttaccattcttggtagagcacaaggcattatggaggcccaaatagaaacctgggcctccataatgctgtgagtttctttgaaaacagggaatgatgatgagcattttttcatgtgttttttggctgcataaatgtcttcttttgagaagtgtctgttcatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacatgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgcgttagtgggtgcagtgcaccagcatggcacatgtatacatatgtaactaacctgcacaatgtgcacatgtaccctaaaacttaaagtataataaaaaaaaaaaaaaagaaaacagggaatgaggcttctgcatctttgtattcagaatacctagcacaatatctggcttacaaggtatttgcttaacagcagaataaatctttggtcaacggtggtagataagccctttacagattttcttcctgtgcccttttgtggcatttgcttcatggctggaattagatttcaaaaactgagtcttgcctctttcttgtttttcataagcctctatctctaaaagttactttagatgccttctgtgccaaaaaggagttcctacaatagtgttataattaaaaaaaaaattctcccaaagaaaaaggaactggttgccagggtaaagaaatacactggaagaagtcttatgcaggcactgaaccaacgccagcatcattgataagaagcgaaaaattttttgttaaatatttaggaaaaatggccttaatctggagaaactattatgcaatgtgatattcaacccagacagagtatttgaattctaataggaaccttttggaagctcaattcaaagaaataacttttccaggaagagtttccccacattttggcaggacaatggggagggtgtttgtgtcatcttataaaatctgccaatcagtcaccactgtctatgaatgagatggctgtttctctggatgaaaaggctgcatcctggccagtctttaagaaccttatctggagccactactaagtgttgtccaatctgcaacccctcactctcgattactttcagatctttgcatatgtatctctggcaggattatccttcctttcttttacctctctttttggtaaagatgcattagcacattcgtatttgtatcaaccacatgaagactgtatatccatgtactggatgagaggaccgaagggcactaagtgcttcccctacaagttcagtggatgaaccaggtcagaactcaagcctggctggctccagaagagaaatctgaagatgacaggatgaactcccatttattgattgctcaccatgtgccaggcactgggtaagatgttccacatgttctctcatttaacatttaaaacaaactcacaagctaggtactattatttcttccaccacacagtcaagaaaactgaggtctacaggaagttaagtaccatgccctaggtcttacattaggacttaaacttagattacccaaatgaagcataacctggggaaagcataaccttgagaactaaacaaatcgtattttaagtaacatctcaataggaaattttttaaaacttatttaagcaattctttgaaaagaatggtagaatgggtaaacttattactctggacatggtttttttgtgcacatgacattgaaatcattaaaagttagtcactgtttttattctaggaatcacgactttcaaatatttcaattatttagataccagactgcaagtgtactcaaaagtaactcttgaaaacagtgccattaagcaatgactcctcattctgcacactcacattccctggcaactactaacctgttttgtattctctatggacttacctattctagatatttcattaaaataaaatacaatatgtgatcaaacaagtaacttttggaaaaaatgcatttttactttactatgttggttctttccttggaattaagaccatttattttttatttcaaaaacactttctttggatgtatattttcatttaaagttttctttttggatggagagggaggtggagccatatggctaaatagcagcctcccaaaggaacaacaaattgaacaactctccacacaaaaaagcaccttcatgcaccttcataagaaccaaaaatcagcttaggtaccagcttagccacagcagggtaaagcaccaaaggggttctaggggttcctgattccagggcttggctttagatggtatttctggaccttccctggcttacaggtgggcccactgccccaaaatagattcctaggcctggcagcattcaccacaagctgattgaagagcccctgggccttgaatgaacatcagcagtagccagacagtacttgtcgcaggcctggggcagtggtggccacagggagagactcctctgcttgtggaaaggagaaggaagagtgggaaggactttgtcttgtgacttgggtgccagctcacccaccgtagaatagagtaccggtagattcctaagatttctgactccaggccctggctcctggacgtcatctctagacctgcccaggactaggaggaactagttgtcttgaagggaaggatacaagcctggctggctttaccacctgctgattatagagccctagtgccttgagcaaacataggcaggagccaagcagtggttactgcaggctttgggcaagacccagtgctatgctggcttcaggtctgaccctatgcagtcccagtggtggtggccacaggggtatttgtgttacccctcccccagatccaggaaacagagacacacacagagagagagagagagagacagacagacagacagacagactgagactgaatctgtttgtttgggagaaagtaagagaagagaaaaaagagtctctgcctggtaatccagagaatgactctggatattatccaagactactaaggtggtacctctgcaagagccacagtgttactgggcttggagtgctccctaatgcagatattcctgcagtgacccaaaactcagaccacaacacccaagtttcttcaagcatctggaaagcctcaccaagaaggacaggtacaaacaagcccagactgcaaggctacaataaatacccaactcttcaatgcccagacaacaacgaacatccacaagcataaagcctatccaggaaaacatgacatcaccaaacaaactaaataaggcatcagtgaccagtcctggagagacagagatatgtgaccttttagacagaggaaactcaatggaattcaagataacacacagaaggaattcagaatcctatcagataaattcaacaaagagattaaaataatttaaaagaatcaagcggaaattctggagttaaaacacgcaactgacatactgaaaaatgtctcagagtctcttaacagcacaaaacaatcaagcagaagaaagaactgtgagcttgaagacagcctacttgaaaatacaaagagaagacaaaagaaaaaataataaaaaagaaagaggcattcctagaagacttagaaaatagtctcaaaagggcaaatctaagagttattgaccttaaaaaaaagttagaaagagagatgggggtagaaaatttattcaaagggaaaataacagagaccttcctaaacctagagaaatataacaatattcaagtataataaggttatagaacaccaagcagatataacccaaagaagactagctcaaggcattcaatactcaaactcacaaaggtcaaagataagaaagaatctgaaaagcggcaagaaaaaataaagaaaaaacatacactggagttccaatatatctggcagcagacttctcagtggaaaccttatagggcaggagacatattcacagtgctaaagggaaaaaaacttttatctcaggctagtatatcctgtaaaaatattctccaaacatggagaaatcaagactttcccaaacaaacaaaagctgagggatgtcatcaacaccagacctatcctgtaagaaatgctaaagaattctcttcaatctgaaagaaaagcatattaatgagcaataagaaatcatctggaggaacaaagctcactagcattagtaaatacacagaaaaacacagaatattataacactgttattatagtatgtaaacaactcatatcttaaatagaaagaataaaagataaactgatcaaaaataataactacaactattttttgaaatacagacaatacaataagatataaagacaacagaaagttttaaagcgggggacaaagttaaaatgtagagtttttattggttttccctttgcttgttagtttgtttatgcaatcagtgttaagttgttatcagtttaaaataatgagttacaatatattatttacaagcctcctggtaatcgcaaatcaaaaaatatacaacaggttctcaaaaaataaaaagcaaaaaattaaaacacgccaccagagaaaatcacttttactaaaaggaagacaggaaggacaaaaaccatatgaccatttcaacagatgctgaataagcatttgataaaattcaacatcccttcatgataaaaatcctcaaaaaatcgggtataaaaggaaatacctcaacacaataaaagtcatatataacagactcacagctggtatcatactgaatagggtataactgaagactcttcttccaagaggtgggacaagataaggatgcccactttcaccactagtattcaatatattaataatactggaagtccttgctagaacaatcagaccaaagaaagaaatttgaaaggaagaaggcaaattatcccatttgcagaaaatatgatcttaaatttggaaaaacctgaagattccaccaaaacactattagaactgataaataaattcagcaaagttgtaggatacaaaacaaacatacaaaaattagtagcatttctacatgccaacagtgaacaatctgaaaaagaaatggagaaagtaatcccatttgcaataggtacaaataaaattaagtacctagggttaactaaaccaaaaaagtctacaatgatctatcaactatcaaatactaatggaaaaaaagagaacacaaaaaaatggaaagatattccacattcatgaattggaaggatcaatattgttaaaacgttcatactacccaaagcaatctacagattcaatgtagtccctataaaaataccaaggacattcttcccagaaatagaaaaaaaatcctaaaatttatatgaaactataaaagactcaaaatagccaaaggtatcccgagcaaaaagaacaaaactggaataccagttttgaacccagaaatgaatccatacatctacagcgaactcattttcaacaaaggcgccaagtatatactttgggaaaagacagtctccttaataaatggtgctgggaaaactggatatccacatgcagaagaaggaaactagacttctatcttttgccatatacaaaaatcaagtcaaaatggatgaaagacttaagtctaagactctgaactatgaaactactaaaagaaaacattgaagaaagtctctagaacattggactgggtaacaatttcttaagtaataccctacaagcataggcaaccaaagcaaaaatggacaaatgggacaaataggatcacatcaaattaaaaagcttctgcacagcaaaggaacaattgacaaagtgaagagacaacccacataatgggaggaaatatttgcaaactatccatctgacaagggattaataatcagaatatataagaagctcaaacaactctacaggaaaaaattaatctgatttaaaaataggcaaaacatctgaacacacatttctcaaaagaagacataaaaatggtaaacaagtatatgaaaaggtgctcaacatcattgatcgtcagagaaatgcaaatcaaaactattgtgagatgtcatctcactccagctaaaatggcttttatgcaaaagacaaataataagaaatgctggtgaggatgtaaagaaaagggaaccctggtacacttttgatgggaatgtaaattagtacaaccactatggagaacagtttgaagactcctcaaaagactaaaaatagagctaccatatgatctagcaatcccactgctaagtacatacccaaaagaaagaaagtcaaaatatcaaagagttatctatactcccatgtttattgcagcactattaacaatagccaggatttggaagcaatctaaatttctatcaacaggcaaatagataaagaaaatatggtgcatatatataatgtagtactatttagccataaaaaagaatgaggtcctgtcatctgcaacaatacggatggaagtggagataattatgttaggtgaaataagttactcacagaaacacaaacttcacatgttctccctttttgtgggagctaaaaattaaaacaaacgaaggagatagagagcagaagacagtttccggaggttaggtagggtagcgtggagggaagggtgggatacttagcgggtataaaaaaatgtaattagatagaatcaataagagctaatatttgatagtacaacagggtgactatagttaacaatttattgtatgttttttaagcaattatagggtaaaattggattgtttgtaacataaaaaaaggataaatgcttgaggtgatgcatacccatttaccatgatgtgattattatgcattgtatgtttgtatgtattccacaaatatatacacctactatgtatgcaccaaaattaaaaattaaaaaaagtaaaaagaagttttttttttttttttttgaatggatagcttctgtataagggataggaaagcagacttaactatttaacctgaccttgtatattaatttgtgctcttttggggagaaacacagcctattcattccaggcatgcagtgaatgctaaaaaaatatccacaaacaacatagaacagtgattttcagaagaagggatctagtgtgttctctgtgttcttaaagacagtgctttgtctgatatttttgcaaaaaagttgagtcttaagtatggtgcttggcaaaagttgctttatggaaaatggaaggcaaataagcaaaaagagatcatgccaaaatactccctgttttcagggcagattgttattccatatggggaaagaatatgaaaaagttctcccacccaagaccatgaaatttaagccttcattcagttgacagtcttcagtgagtcagattcctgcaggatttaagttactccctggctgactctcaggcatctctgcagatagttaacctttttcttgttatcttacagcaactataaattcttattagagtgataaaaagcaataacaatttaaaacataagctatttttaaaataacaatcttgcaaataggtagtaccttaagcaaagatgttttaatacctttttaggcctcactacttatatctaacatattaacatggacccactttccacaacgtagattatttttgctatcaacagtctgggaagggtctttataattttgcttttgaaattatgtggctactattaaactcatttaaccaatgactggccttgattttctttgcaatcatccagcatacttggagatacttgtaaaataaaaaactcagcacataagtttttttaatttagtaaaatgttaagaatactcatttgacaattattgaagtcgacataatcttatgctttgaacatttaattaaatgttagtcctcattttgcagttttctgtttgtattcaattacttcattttccaggtctcaaatggtttcatagccccatgagacgctcataggctgtagcccctgaggaatgtagtgcctggtatggaccacagaaccctggaggtgggatctggaaagaaagggaattctggtaagaagtgattcatgcaaggagatgtatttagcatttccagatagtgccctatttcctgtagtaccttgataattatgagttaccttcccttgctaatgagatgaagtaagtcatcaagcatttattgttacaagggttttattcatgatccagctcatacttagtatcatagatgatttttagaaagcataaattgtggttgccagctttgaggacctaaaatttagctgggaagaagaatacaattctccttaatgttttctctggaataactgaacacatgagattgcaagatgatgagtccaaggtttggatatatgaatgaccaaactaaagcaataatatggctttcttaaaaaatacagttatttaaatgattctagttgtgttaaatcattcttttaaatacctggtgagtggcttaggaactaagatagagtctgagaagaatagcattgctggtggccccaccaggatgagagtcattattatgatccaacaaaataggaggatcattaatttttcactcattcccagagatgtagttttgaacagggttaggttcttatttcaattagagaaactagaaccatgaaaagaagatttcagccctaaggaaaacagatatatcagagtttaaaactccgattcccattctgctcaattgctcagtggatatggtcattatttttgttctttgaaatggactttgttttttaagattatgtagaatgcattgtttggcaaaaagcacaggatattcaaacagaggcccaataaccaaatgcattttttctccattgcgttcttacctaaataggaactataataataacaaggcctcagtaatgcagagttcttgcccttctgtaagtgggcagggtgcgtgtgcaggtaggtaggccattaggtcaaatttcaatgtctgagatactctcctgaccccatgggagtcacataccactgaaggcaaaatctggctgcagggtcacctgtgttgcattggaggactgtgagtcatctcttcatactcagctctgcaacagtatgaaaaggtcaccacgaccacgctcacctattctggtgaattagacgtataagcagcctgctcccaactccttggagatcatttctgagaacatttgtcttctcaacctgttgctgggcatgactggaagcagaataaatgactacagaatgtttagtttacccagataaactgcttggcagtctttggattatgtaaaattaattgtggaaacttaatgttgaccagtgatcatagtatgcggacagacctacttagaaactgttttgtgtgtgtgtcagccagtgttactaagaatcatttaagggaatgaagagtaaaactcttttatgtaaggcattagtttagcagggccactgcatctctgtgtgagctgtccattgcccaactctagggagtaccatttttacaaaccacagcatgaattgtgctttcagaattgtgcaaaatggtggccctgtctttctgcatctcaaatggtgacataatgtaactatattttccatctttaaatagatcctgaaagctcaagttgaagcactgaggctgacactctgggctacacagagaaagcagtgtcagatggtggtgaggaacaccttgtaggcagaccgccaaggtataagtcccaacctggcccttactccagccaaattgctttagttttctatgcctcagtctcctcaattgtaaaatgagtgaaatcagagtggctgggagaattacattaaatagtgcaggtaaaatacttgaaagaacaatgcacgcagtcacggactcaatagatgttaactcttaagactgtctctcttttgttcaatcattaggattctggaatgaataaaacattatcacagctgttttactatgattctgctttaggaatatttgtggctgtagaggaaacattttctgtgtgcctttatgaaagctaataactaggaacagtttaatagaatgctcttagagaaaatgaaaaatagaattttgtgacagccattaagagtttaaaagagactgtggtaaggattgtctcttctggatgctttcaaatgtaattattggtgaaggctaatagaaatccatggagtttcagatactgatagaaaatgataggcatttcaaaaataaacattaagcaaaggctacaaaattaacattatacctccccatttatctttttttctctcaggtggcacaaaagcttgacaaagcgtccatgaaccatttgaagatttttgttgggataatcagatatctataaatgccattgtttaagaaagctaaccaaataacgttttactattgactaataaacttttctaataatcttcaattttattttaataaaatattagatgtagttcagtttctcaactctggaatagtgacccaggaaaaatatgagggaaacttgaagtctatggaagttgtatttggtgttaactgaggcctttgtgtcagcccagcacaaactgtaaagtcaaaagtgtgactttctctttctggtcttgacaggcttttgttttgatagacttgtcctcatctttaacctcctactgttcttctaggttatccaggtagctcttcaggtgcccaggttgcctgttgcctctgctagcctgcctagttcgtaacatcaggcagagatgaggcaggaacttcggccctcaggcttgattagtggttataaggccaaggatcataggaaaaaggtatcaccttcagattaccttccctgtgtattctgtttttgtagttttcatcagagagtaagcaaccgtcatgtgaatatcgtgtctttaatgatctgttaaaatggcggctctcagagaaagtgctctccattctcctcctcctacctcaggccccctcagaaatcaggctggtggtgttagggagtgaagtaggctaagtgtaagaaaaaaaaaacaaaaaaaaaaacagctttggaatgctgatggacagcaactcatatttgtcctcagtgtcaggataataaggactcatgggggtgggaaatattgtaaatacaaaccttgaaaggaggtagctgctattcagagagccaacatagccaacgtttctcaattgtacagagaaatgtgaagttatatgtgagatctttccactttcaatcgtgatgctaattcaaaatgaaaaaaaaaaatctgactggcctaacaaaacaagtttggggtcggggtggttactaggtttccttttagccattgtttgggacatactgatgtactgctttattaatctccaagaaactcatttatgttgagtggctaatgcatcagtagggtaatatttactttatattttaatattttataagttaatagatataataaataatagtaaccatacagtgggattagtttccaatggtaaacatttcaggccttcaggccttcaggaggaattttgaattgtgatgaaatggcaagtgcctattccatccaggcataaaaccaatcctagccaatttattaaaaaaaaaatcctgcattgttactctttagctaatgattaactaaagtctgagtgactagtagaatgagtaattttgttacataagccagagaaggtggaaggaaactaacatttattcaatacctactgtccactgggtacttcatctatatattctcttctaatcttcaaaacaacactgtaaggtagttgttacaaataaggaataattacaacttattccttattttgcagctgtaagttgatgtttagagaggtcacatccaagtctcttggaccatgcttcttcattatacaaggaatattgatgttgccaaatattaattcaggagctggtacagttagaaattagtaacacacacacacacacacacacacacgcgtgcatgcacgtaaaaagcaaggttaaactcgcaaggttaggcaaggttagctaccatatgatagcttaaagggaagaattctgtgctgataaatggagtatttttctccttaactgagtcatcctgtgtcattgttaggcactgtagacagtacataagttaactgagatctgatacttccttttatcccttaaaaatccaacacagggctcactgtaattaggtataaataggtgacttaacccttcagatctttctggaggagagataagtgtcttatgagattgaaataggagggatcaacaaagattgcagaagaattaagggctagcaaaatctgtcatgattccaaaaggatcaagttgaaagtgaaactagttcacacattttcacgacagcttcagagttaacatcctataaaggaatctatcaacattgtgacatttgtttaggcttctataagtgagaaaatgtgtccttccatgcaatactaaatgtaattatcatgttatctatttaatccaacttcacataaatcccaatgattaaatctactatctatttagaatattatcacatacttaggaagatatatcaataaatacttatgggtccttgtggtaaataaatactaatgtatagatgaggttatacttgccttagagagtttacaacaaaaagagggacgggtagtgaaagacataatgtccatgaaaaccaccacattattgctttatttgcttcacaggcctcatatgtgaatttttttttaaactatagattcttacctactaaagtaaagtttcagtgagtgcaaaatttgactggcttctatcctcctatgtccccagtacctagaacagtgcctgaacttaggaagcactcaagaaatattgggcaaatgaatgaatgaatgaatgacacagatcatgaatgttataatgagaaagcagagaaaaaaaattatctgggctggatagtcagagaatgtttccaggagaggggatcccaaatatggacttttaaagctgataaaggaaggcaatttccttgagaagaatggcatagacacaaaggctaggtaagggcaaagagacacctggagtaatgtggatttactgttattctatcagtaaatcttgatgaaaagacttgaggccatgtaaagaagaactctctaataaaaatggaatgggttcccttggggttggtaggagaggtgatttctgtgaggggaggtactggagcttggggtagaagaacacaacaaaaatatgatagcaggcagccaaccccaaggcacaagtgaaactttttttttttttttttttttgagacagagtgtcactctgttgtctaggttggagtgcagtgggatgatctcactcactgcagcctctgtctcctgggtgcaagtgattctcatgtctcagcctgccaagtggctgggattacaggtatgcaccaccacaccaggctaatttttgtatttttagtagagatggggtttcaccatgttgaccaggctggtcctgaactcctggcctcaagtgatccacccatttcagtctcccaaagtgctggaattacggtgtgagccaccgtgcctggccataagtgtaacttttaaagtttcctctcaccttgggattccaggcctctcttttggcctggttgctgaaacaatttaggagaatttctgaaaattttcaaagtattcataaatggaactttgctttcctcctcctaaatcaagacaaagctcacactgaccacagattatcttaaatttggtgaaaacatatttcagttggtggaaacacaattgttttgcaagttagctccagaagtggtaattgaaagtgacatttaagaaacattttctatggatctcagaagatgattactcattttgttttgaaggtttatgatatgctaaagtgtttttaaagcacattataattaaacaacttgtaaaaaaaatttaaatttccccctatggaagctcctatttcaaatgtagtctagagagaatttcaagtaaacatgtaactgcacatctgattttgtgataatttgctttatactttttaatatcatctttgatgttacatattcagatgtttaaataccaatacaaaaacaataataattttgtttaaattttccaaacacacaaaacaaagagaagcattcattcaaaatacttgtatacacatgcaaacaaaattaactttgtgtttatgactcacataagggaagttattggtgcccatagcctctgaatacccgcctctcaaagcttattattacaaagaccagtagctccttgcctgaaggtttttaattcctgtgagtcttggcaagggctattttctggctgcagttacatgcctggcctgagcataaataacctgggagtggtggattgttaatgacccccggaagcaggtgatggatgaagagttggtgaaaagcaccccagcttcctcatctcacagttgggataactctggggtctgttccacactgtcttccagaacccaacaatggggactgagctcctgtttccctctgtgggaacggacttgatgatgtgtattttttcagagatccttccatttcctgtctcacttccctactcctttacttaggtttcttgaatttcctaaataaacaactaatattccttatattggggtctactgctgcaggagcctaaaccaatacatgtctcttccattattttgtgacaccaaagaagattttgattaggcctagaaaatatacatgaaagctgatcaaaatgagaggaatgattaggtttgtttgtctgtttttggtaaatatggaaacaatgccatttcattttagtaaattgccaagttttctcaagtccctcctatctttctccatatacttgctcttctgtcatttgccttttttcatctctggcatacatacaacctgaaataaaacgccatggggtagattaacgagaaacactggaataaaaaaaaatgctcgcccaggcgcagtggctcacgcctttaatcccagcactttgggaggccgaggtgggcagatcacctgaggtcaggagtttcagaccagtctggccaacatggcgaaaccctgtctctacaaaaaatacaaaaaaattagccaggcgtggtgtcccgtgcctgtagtcccggctacttgggaggctgaggcaggagaatcgcttgaactcaggaggtggaggttgcagtgagcagagatcacaccactgcactccagcctgggcgacagaaaaagggtctgtctcaaaaaaaaaaaaaaaaaaaaaaaaaaggcttacagtgtcacgtgaatcacatgcttattaaatgaatgaaaaatacactttattatttcatgtgtgtattaagaggtcatatggatagatcagatgttggcaaatgaatgtgttatttctagaagaaatagaaatgtttccttatttgccagggcctaaatcagtgtttctttgaaatgagtatattttctgacagtatacttcatgcagacactcccacacactccccatacatgtgtgtgtgtacctgacttatatcacttaataatatgaacagactgaagataatgtcaattaatcaataataaatcctaaattccgagttaatgtctgtgctgttttgaacaaggtttgaccgtcttaaataaaaagatttttgtgtttgtttgtttttcacaaggtttgaatgtcttaaataaaaagcatctaggagctatagggtgtagagaaaactctccctgatggcatttttcctctactctcacaccacaaaaatcatcaacacagatgaagccttctacgaacaaacatgtgaggtttcccccccacaccaagcagccaacactagctgggtgtcctgtaattcagttccaacgctgtctacctggagataatgtcagatcccaccggttgaaggttcagttcccaagactgccccccaccacaccagtcacaagtgtgggcctctggagcttctaaccggccacctccaagttggcatactcataatcctctctttgggttcaattaatttgctggagtggctcacagaacccaggggaacacttacttatgtttgctagtttattataaaggatattgcaaatgttaccgattaagagatgcatatagggtgaggtatgggggaaggggtgtggagcttccatgccttacctggctgtgccaacctccatgaaagtccaagtgttcagctatgtggaagctcactgaaccctgtccttctgggattttatggaggcttcatgacatcagcattccttcccccagggtatagggcagtactctctctggggaaggtcttaaaagccacaatcagaaaggcaggaacaggtgaaaggagagaaggagaaggtcaggggcctgcccctgaggcctaacacacccaacattataacaaaagactgtaacaagggctgtgggagttatgagctagacctcagatgaaaactaatatatatcataacaccacacatagattcaaagatctaagttaagttggtcattagtcaacactatttaaaagccagatatgtccaaatggctcttgaatctacacttattatagcaaatattttaacgtgtagagatgaaaaggacagattttctttaagtgtctgaagccggtaaagagaatttctgccttttttcctctgtaaatctaaatctgtttgaagaaagaagtgcgctgtgaaatgggaaggcaggggtgggcaaagacacattttagtgaggttttaatctccattttgctgagtagaaatagaaaggagttttgaggtggtttgaagggaaagtgggggagagagagagagaagaaatgggagaaccactgagaaggtttaaaatgtcttcatgttacttaggcagataggcagatatgagcagggtaggagagtgccccaaggaatgtcaggcaacagtcaggtgactgtcatgcaattgtcaggggcctccttgggaatgacagatggtcatggctggcaccaagaaggggaaaatttcctcccaaacaggaaacatcttgagcttatgagcaacaacttcctcataagatcccaggaactaagcaaacatgaccaggcatctgcagtaaggggcaaaatggcggagtttggccttccttcggggatatgtccaggcatgctcaagaaggggcaaaacgtcagagtttgcctgatatgtgaccttcctttgggggcactagaccagtaacgaaaaattgtcatggagagcatacacacaacttcagccaccaaacggcacatgcagcccctgacagatattagcaagttactgcgcatgcaaggattagccaacagttcccccaagaaggatgaggggaggagatcaggaagaatcaggatacagtaactctataaaagccttgaaccaatgatcaagcggggcactcaatcttttaaattttccacttggtcccttccgaatgtactttactttgcttcaataaacttctgacttaaatctattactttttataaaatttttttccataagttattagggtacaggtggtatatttagttatataagtaagttctttagtggtgatttgtgagattttggtgcacccatcacccaagcagtatacactgcaccatatttgtaatcttttatccctcacccccctcccactcttccccccaagtccccaaagtccattgtatcattcttatatctttgtgtcctcatagcttagatcccacatatcagtgagaacatatgatgtttgcttttctattcctgagttacttcacttagaataatagtctccaatctcatccaggtcactgcaaatgctgttaattcattccttttcatagctgtgtagtatttcattgtatatatatctgtacaccacagtttctttatccacttattgactgatggacatttgggttagttccacagttttgcaattgtgaattgtgctgctataaacatacgtgtacaagtgtctttttcaaataatgacttcttttcctctgggtagatacctagtagtgggactgctggatcaagtggtagttctacttttagttctttaaggaatccccacactgtttcccataatggctgtactagtttgcattcccaccagcagtgtagaagtgtttcctgatcaccccttccatgccaacatctactgttttttaaaatttttttattatggccattcttgcagaagtacggtggtatcacattttgtgtttttgatttgcatttccttgatcattagtgatgttgagcattttttcatatgtttgcttgccatttgtatatcttcttttgtgaattgcctactcatgcccttagcctactttttgatgggattgtttgtttttttcttactgatttgtttggggtccttgtagattctggatactaccctttgtcagaggtatagattgtgaagatttttctcccactctgtgggttgtctgtttactctgctgactgttccttttgccctgcaaaagctcgtaaagtttaatgaggtcccagctatttatctttgtttttattgcatttgcttttgggttcttggtcatgaaatccttgcctaagccaatgtctagaagggtttttccaaagttatcttctaaaatttcatagtttcacgtcttaggtttaagcccttaatccatcttgagttgatttttgtatacggtgagagataggatctagtttcattctcctatgtgtggctagccaattatctcagcaccatttgttgaaaaggttatccttttccccactttatgtttttgtttgctttgttgaagatcagttggctgtaagtatttgggtttatctccgggttctctattctgttccattggtctatatgtctatttttataccagtaccatgccattttggtgactatggccttatagtataatttgaaatcaggtagtgtgatgcctccagatttgtactttttgcttggtcttgctttggctatgcaggctcttttttggttccatctgagttttagaattgttttttctaattctgtgaagaatgatggtgttattttgatggggattgtgttgaatttgtaggttgcttttggcagtatgggcattttcacaatattgattctacccatccatgatcacgggatgtgttcccatttgtttgtattgtctatgattcctttcagcagtgttttgtagttttccttgtagaagtctctcgactcctttgttaggtatattcttaagtattttattttattttttttacagctattgtaaaatgggttgagttcttgatttgattctccccttggtcactgttggtatatagaagagctactgatttgtgtacattaatcttgtatccagaaactttcttgaattcatttatcagttctaggagcttgctggaggagttcttagagttttcaaggtaaataatcatatcatcagcaaacagtgacagtttgacttcctctttaccgatttggatgccctttatttctccctcttgtctgattgctcttgctaggacttccattactatgttgaagaagagtggtgagagtgggcatcattgtcttgttccagttctcagagggaattctttcaacttttccccattcagtattacgttggctgtgggtttgtcatagatagtttttattacattaatgtatgtcccttgtatgctgattttgctgagagctttaatcataaagggatgctggattttgttgaatgctttttctgcatctattgagatgatcatggaatttttgtttttaattctgtttatgtggtgtatcacatttattgacttgtgtacattaaaccatctctgcacccctggtatgaaacccacttgatcatggtggattatctttttgatatgttgttggattcagtcagctagtattttgttaaggattttaccatctatgtttatcaaggatattgatctgtagttttcttttttggttatgtcctttcctggttttggtactagggtgatgctggcttcatagaacgaattagggaaggttccttctttctctatcttgtggaatagtgtcaaaaggattggtaccaattctttgaatgtctggtagaatgctgctgtgaatctgtcgggtcttggacttctttttgttgataattttttaagtaccatttcaatctctctgcttgttattgatctgttcagtgtatctaattcttcctgatttaagctaggagtgttgtatttttccaggaatttatccatctcttctaggttttctagtttatgtgcataaaggtgttcatagtagccttgaatatcttttgtatttcagtggtgtcagttgtaatatctcctgtttcatttcttagtgaagttatttggattttctctcttcttttcttggttaatcttgctaatggtctatcaattttatttattttctcaaagaaccaggttttgtttcatttatttatttatttttttgtatggtttttttttgtttcaatttcatttagttctgctctgatcttgattatttcctttcttctgctgggtttgggtttggtttgttcttgtttctagatccctgaggtgtgactgtagattgtcttttttgctctttcagtctttttgatgtaggcatttagggctatgaactttcctcttagcaccacctttgctgtatcccagaggttttgataagttgtgtcattattgttgttcagttcaaataattgtataatttccatcttgatttcatttttgacacaatgctcattcaggagcaggttatttaatttccatgtatttgcatggttttgaagattccatttggagttgatttccagttttattccactgtggtctgacagagtgcttgatataattcaattttcttaaattcactaaggctcattttatggcctatcatatggtctatcttggagaaagttccatgcactgttgaatagaatgtatattttgcagttgttctgtatatatctgttaagtccatttgttccaaggtacagtttaaatccattgtttctttgttgactttttgtcttgatgacctgtctagtgctgtcagtgaagtactgaagtcccccactattgttgtgttgctgtctatctcatttcttaggtctgttagtaattgttttataaatttgggggctccattgttaagtgaatatatgtttagcattgtgacatattcctgttggagaaggccttttaccattatataatatccctctttgtctcttttaactgctattgctttaaagtttgttttgtgtgacacaagaatagctacctctgctggcttttggtgtccatttgcatggaaagtcttttccacccctttactttaagtttatgttggtccttatgtgttaggtgagtctcctgaaggcagcagatagttggttggtgagttcttatccattctgcagttctgcatcttttaagtggagcatttaggccatttacattcaatgtcagtatcgaaatgtgaggtaccattgcattcatcatgctctttgttgcctgtatacttttgttttgttttgttttcgctttttagcttgtatttttgttttacaggtcctttgtgatttacgctttaaagaggttctgtgcaaaaatcacaagcattcttatacaccaataacagacaaacagagagccaaatcatcagtaaactcccattcacaattgcttcaaagagaataaaatacctatgaatccaacttacaagcaacatgaaggacttcttcaaggagaactgcaaaccactgctcaatgaaataaaagaggatacaaacaaatggaagaacattccatgctcatgggtaggaagaatcaatatcgtgaaaatggccgtattgcccaaggtaatttaaagattcaatgccatccccatcaagctacccatgactttcttcacagaattggaaaaaactactttaaagttcatatggaaccaaaaaagagcctgcatcaccaagtcaaacctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaacggttctgggaaaactggctagccatatttagaaagctgaaactggatcccttccttacaccttatacaaaaattaattcaagatggattaaagacttacatgttagacctaaaaccataaaaaccctagaagaaaacccaggcattaccattcaggacacaggcatgggcaaggacttcacgtctaaaacaccaaaagcaatggcaacaaaagccaaaattgataaatgggatctaattaaactaaagagcttctgcacagcaaaagaaactaccatcagagtgaacaggcaacctacaaaatgggagaaaattttcgcaacctactcatctgacaaagggctaacatccagaatctacaatgaactcaaacaaattcacaagaaaaaaacaaacaaccccatcagaaagtgggcgaaggatatgaacagacacttctcaaaagaagacatttatgcagccaaaaaacacatgaaaaaatgctcaccatcactggccatcagagaaatgcaaatcaaaaccacaatgagataccatctcacatcagttagaatggcaatcattcaaaagtcaggaaacaacaggtgctggagaggatgtggagaaataggaatacttttacactgttggtgggactgtcaactagttcaaccattgtggaagtcagtgtggcgattcctcagggatctagaactagaaataccatttgacccagccatcccattaccgggtatatacccaaaggactataaatcatgctgctataaagacacatgcacacgtatgtttattgcggcactattcacaatagcaaagacttggaaccaatccaaatgtccaacaatgatagactggattaagaaaatgtggcacatatacaccatggaaagctatgcagccataaaaaatgatgagttcatgtcctttgtagggacatggatgaaattggaaatcatcattctcagtaaactatcgcaagaacaaaaaaccaaacaccgcatgttctcactcataggtgggaattgaacaatgagaacacatggacacaggaaggggaacatcacactctggggactgttgtggggtggggggaagggggagggatagcattaggagatatacctaatgctaaatgacgagttaatgggtgcagcacaccggcatggcacatgtaccctaaaacttaaagtataataataataatttaaaaaaaaaagaggttctgttttgttgtgtttccaggatttgtttcaagatttagagctccttctagcagttcttgtagtggtggcttggtaatggcaaattttctcagcatttgtttttctgaaaaagactgtatctttccttcatatatgatgcttaatttcactgggtacaaaattcttggctgataattgttttgtttgaggaggctgaagatagggccccagtcccttctagcttgtaggctttctgctgagaaatctgctgttaatctcacagattttcctttataggttaccagtgcctgttctggtgcagggggtaggggttggggggcgcaatgggctctgtgggggttcttagctttcgtggtttaatgctctatttttgtgctggctggtctcctgccaggaggtgttgccttccagagagcatcagctgtggtagtatggggaggaaccctagaactcccaagattatatgccctttgtcttccactcccagggtagatagggaaggaccatcaggtgggggcaaggctaggtgtgtctgagctcagactctccttgggtgagtcttgctagggctgctatgggggatgggggtgagattcccaggtcactggagttgtgcacctaggaggattatggcttcctctgctgagtcatgcaggttgtcagggaagtgggggaaagccagcagtcacaggcctcactctgcttccacgcaaacccaaaccaaatggctagtctcactctcactgtgtctcccaccctctaacagcctgagtccattttcagttggagggcaagatgagcttgaaaatctgccccaggctacccacctcccagctgtgaatgaaagggattggttctactccacctgtggagtctgcacgccagatgtgtgccctcccctgagttctggccaggaggcttctcaccccattcaaattgttacaaacttcagctagagattttcttctccctgtagagttttaccccttgcacctctggctctggctgccctctggatggatccctgtgatgccaggcatggatggcctgctaggggactcagagagcttccagggcctttctgctactttctttgcctctgtatttcactcagctctccacattgactcagctccaggtaaagtcagaaacttctcttgcaaacagaccttcagcttctccagtgggggtgtgtgttcaggagaggagggtctccctttcccacttccacagttggggtactcacagtatttggggtgtttcccaggtcctgcaagagcagtctgcttccttcagagggtgtgtgggtcctctcaaggttgctggtttgttcttgcagtcaatctggagctataattcacaatgcgagcctccacatgctgctctgtccagagctgcaatctagtcctgcctcctgtctgccatcttaaatctacttctgtctcttggatgtattttttcttctcagacaataagaaccaaagactgtgtatcctgcccaaacccgctgccagtaacattttggtgtcatgaatcagattgcagcttctcggtaagaccctctgtgccttgccatctttggctggaggcacccaactctgcttacgtgaggtcttctttctcttgctgtctcactcaccagcccatctccagaaaaattctctttggtcactcttccctctagcagattcctcagttcatcctggtgggcgacagcagaggtggaggacttcagagtctgtactgagtagacctaagtcactgtggcccttttggacaggtggctcacaagggtgatagggcttgagcctaggccattcaaagactggagaccttcatttccttaaccaaagtggacttttccccaataagtctacaccctattatgcttcctttttttctgtggactttgagatggccttatatgctggccacactgtctgtcttgggggcaagtcaacctcttccctgcttctattctgcatatcatgcaacttctttctctgcttaatattgggaagactctgtctccaccaattctttatttcctatcatgaatttttaaatcctgctacacattgagaccaggttttccagtggctcttgaggtcatttgtttgtctccatagggcatctgtatgtggtccattaagagcaactcctacttcctttctagagctatctgcactttggggagaggacaattctttctctgccttttgtggtctctcatcccaaactccctggccctgacagttcttcctctacactgagaagactgataggcaatgtcctcttaggtctaagggctgctgtttgtgagactgtacaaaagcagccttccatgaatatcccttattttctaccattcccacgggtggcagatggattgtcctgtcattttaaatacttgttttccatgcttccccaggaatccacaggagggatgacaaggggactcagatgcaggttttcctctgttcctctgaccatctacattcttaacatatactgggacctacagtgctatgtccagagaaaggaaggcccagttcccttacagctgctggctagggataagatcctcacctacctaaagggatatggagaatgggaatttgagagaaaggaaaaccatttcattgctggaatgctccaaacaaaggtcactgtaagatcacagtgtcaaaggtacaggtcagccagaggccacaggtgcaggacagattaccattagcagagagatgaaggctggtcctggagggaaatgtgggaccagggttagtggtacctggtaatcactggtttattccagaactccaggatgaatgggggatgccctactcactactctgatccaaggtataaggggatcaggaaggaatgctttcagctgggcgtggtggctcatgcttataattccagcactttatgaggccaaggcgggtggatcacctgagttcaggacaaaaccccgtctctactaaaaatacaaaaattagctgggcttggtggtatgcatctgtagtcccagctcctcggaaggctgaggcacaagcatcacttgaacccaggaagtagaggttgcaatgagctgagattgcaccactgcactccagctgagcaacagagagagactctgtctcaaaaaaaaaaaaaaaaaaaaaaaaaaacagaaaaagaaaaaagatgaagaagaagggactctttcctcttccttactcttccctgttctgtcttgcagatagataacggtgtctccatactctgggactgaccccttggatgcatccttaaaatctgcgataaatccaaccaccaaaccctaaaatgaaaaaactaatttttcattgcagaggaagtctggctagagaatggaagtacaaattttaataccattctccggctagaccttttctgccattatcagggcaaaaagccagaggtcccctatttacaaacctttatggcctaaagggaagaccctaatcctcgtaaagcttgtaaggcaaacctcacatcctagctatgcttagccatctcctccagggccctgcatcggccctggagactcctctgctgattcctctccaacatttcttcctccagaagccaaaaggaaaaactacctcctcctttggaggtgaaagagggagaaacagccacccctggatcctccccctatttatcccactcccagacctttggaattggccccactttacaccgggctccttagttctcctctccaagcttgtaggaggtaagtgagccaactgaactcgtccaggtccagatccccttttccatgtacgacttttgacaacttaggaaaaacctaaaaaagttctcagatgaccccaaaaggctcatagagggcttccccaaattggctcttacatttagattaatttggaaggacataaatgtactcctgggacaagcccttttacaagaggaaagacagaccatctgcggagcagcaatccactgtcgaaatgacttacacctggaaaatgccaactaccctggaggggctacagctgttccccagctggaccccaatcaggactacaatgccaaagcgggaatatgggccaggaaccataggctcttgtgtctaatagaggtaataaaatgaagtaagatcaagcctctaaactacaataattagccaccataaaccaggggccaaatggaaatcctatagcctttctgaaaagtctacaggaaacttattaagcacaccaaacttaaacccagaatctcctgagggactagtcctaaaggacaatttacccaagctgctccagacattaggaaaatttacaaaagtcagccttagaacccagtgcccctatgccacaaatcctcaaattagcctcctcagtcttttataactgagatctggacaaggaggacagggctaaggaaaaggagaaatgcagggacaagatgcaggctcaactattggctgctttacaagcccaccagccccctccagggtctcctaaggaccctcctccaggtaactgccactgatgcagaagaccaggctactggagaaggaattttccaaatgggccaaatgggaggaagccccacacagcctgccctctttgtgataagctggagataagtcccactggaagagggactgccctgggatccaaaaggtcccccagttgaacccccatccaataatggccttgagctgaaggggccctccactctggccagcttccaaatcagacatcatcattaaaggaacagagccaagggaaactctggaaatgacaggtagtgctataaatatccttttaaatacaagaactgcctactttgtgctaacctttttctctaggcaacttacccccaaattctgttgggtaacaggagcaagtagcaaccccttcctctaaagattcacatcccctttatttatattgcttatgggactaattactattctcccactagtccctggcaatgtctaaatgcctcacactgcttttgagtaggaatatactttccaaaatgggtatccacttaatatttacccaacatctggactgatatttccccctaatatcccagtttctcccaggaaagccagcagtcctacctcagggttttagagatgccccacacttatttggacaagacccagcaaagaaatctaaccaagctatatcttgagtggggacaacttctgctgtatgtagatggcttactcatctgctccccctccataaagcttgcacaacaatatgcagtacaaaccttaaccttcctagcaaaatgtaaggtacaaagtatccaaatccaagacagagaatttcatacctagaaccaaatatatatacagagagtactgctggctccagaccctctaacaaccaacttgtgtacccacccaggtccttattaaaacctaaagtgatggatctacaaaatctcaactaatcccctcatggaaaggcccttttactgttttcctttccactgcaacagctatcaaagttcctggcacctctagttggatacatcattcctaaataaaaccttgagaggcttctgaacaatcaacaataggaccagcacctgagtattcctgtgagtcattggaagatctataatatctctttcaatgaaattataagtaatgccttcttttctttcaaactaatgctagctcagcataaggtagccccagtactctggatcttattcatggtgggattgcttatgcttacacttggttcaaaaccaacattcccgagtgggcctacacccctccaggctatgtatttttatatggacctaaacaaaataaactgccctgtgagggaagttctaaaagaacttattcaaccccctcacttgtaaacctttttatctgcatagataacacccaacatacaggggatgtgccctaggactcctggggccacaaggaacaggtgtaaccatctataacattacaaattcttaaaaaaggagagctcttggccttataatggtagggctaggggctgccataggattagctgccccatacagaggattcagttatcataaagtcaccctccaaaacctctctacacaaattggagacctaggtcagagaactgggaacagaatctctaaactcaaggcttcactgaattcagtagctaatgcagtcatggacaacagactagctctagattacctccttgcagaacagagtcgtctgtgctgtcatcaataaaccctattgcacttgtgtcaacaatagtgggcaagtagaggaacatataaagagaatctgtgaccacgctaagtggcttcatgactctgggaaagaaaatccctcagcagattccatctggaactctgtaaaatctgctctcccattgctcacatggttcctcccctgctcgaaccagctgtctccatacgtctacttctttttggcccctgccttttaacctactagataaatttgtcttctccaggatataacaatttcaaaccaagttcccaataatgcaggtgatagatgcaggaggcagataagagggaggatccctggagaatctcccgcccgcctgtgcactgcgacgatggggtaaagctaccaggaagttcatgccttgttggggggaaagagcctgggaactttagctcgtgtgtgggggcttggaatccaatctgtgagatgggagcctgctggcagaaacccctctcactttgctgaaagtttttcttttcttgttttccttttcgcccaataaataataaattccattcccctcacccttccacgtgtctgcatgcctaacttttcctggtcgtgacacagaacctggatttagctgaactgaggagcagaaattctgcaatacaggaatatctacctccctacccaaatgtgaagaaaacatacacctgtttcccctggacctggctggacaccaattctacctaccgatgggaccattctgttctgacaattagcaagagattgagacccagaggacaaatacagcccttatttcagcaggaagcagccacagaggactgaccttcatccactagccccaaataattgagtctcacactcttgaggggggaatatgttagggtaggtagataggtggatatgagcagggcaggatagggccccaaggaatgtcaggagacagtcaaatgactgtcattgtgactgtcaggtggcctcttcaggaatgatagatggtcatggctggcaccagggagggggaaatttcctaacaggaaacatcttaagcttgtaggcaacaactttgcgataaaaccctaggaattgagcaggcatgcacagtaaggggcaaaatggcaaagtttgactggtatatgaccttcctctgggggcactagaccagtaaaggaaaattgcccaaagagtacatgtgcataactacaaccaccaaatggcgcatgcagcccctcccagattactggcaagtcactgagcacgcggcgattagccaacagctggcccaaaaggaagtatgatgggaggagatcaggaagaatcaggaaatagtaactttataagagtcctgagccaataatcaggcgggacactcaatctttccagttgcccacttggtcccttccaaatgtactttgcttcaataaacttttgcttctgtctgaaatctacatctgtctctcagctgaatttttttcttccaggaagacaaaaactgagggccgtagaccctgcctggactcacctcccgtaacatttagactctttatttcacttaaatacttgatcaagaggtacatgaagataacaagctatggggctttgcaataataaaggcagattgccagtctgagtttggaattggaatcggtatagacataagattcatgaaatttcaaaaatgacatatttctttacatgtttatgatcatgaaaactagtctttctgtttaaaagaaactacctgggttcctttagtctttgaacatagaactttttttttaatgttacattgatagctgaaacagttgataatcatgttctagagcaggtgagtgttgctatatactggggttgagatggggaaaatgaaataaatgtataaaggatcagaactacagcatcttaaagtgaaaacatcacaaagctcagagtaaatttccatcttgctgttgatttatatataaactgtactcacatgttcagaaggagaagtggaaatattatcttggcttacatggaagaggaaaagactatatctagttatttaaaactacctgttaacttacccacagacacagctctatgtaatgaactctagaatgtggttagtgtcaatgttccagttgtggacggaggaaacagttttcaccaaatgtagttgacaatggctgtgaaacatggcacagtgactagaatgaggtaaacagatgtcataataaccacgggacacctgccttcttcacctctatgaaaatattgctgccttacacatgggcagaggtggagaaatgagaaattctgtccttagacacttcactccaaaacctgccaggttcaagtgctgccttcctgtctcaatggagaatttccagttctactctagggatgaggctgtggtctctccagaggtgggtcatggcctcagtactataggcaggcactacatcctgcagctgtcaatccaggctgataatttgagacctagcagctgatgacattccttctctgcatggcagttgtctctaacaggccagtgcacatctgagccaaagatgacatttttggcatttgcctagacgttgagagcatccactggcttggtgggcaccagttggcaagaagggaaaaccccagccaaggaaagttttaagaaggccacgtgctggcccttcagaagcagctgcattcatagtacacactaggggaggcaaacgtgtgcctgtgtaatctgccttcttcactcagtgggagggaggccagttaacaatgatttcaactctttattaaaatcaactaacacattgctgcacttagatagtagtaaccaggcaggacaccagcaggcttccctaactgcctttttattacaagacctatttcaggcccatcccactttacatctctgcagcatgacttcccaaattacaggcataataaactaacaaaggccacaacccctgcaggcatacagagtcagattacgtctgactgaatctgctttctctattcataaacaacttaaaacagctctttccctcgcgtaagaacctgacttgccaggcacacagtgaaccagcagaagactacatgaggacaatggagatatgggtgagacaagggcaggagatgccttgttcataggaaatgaaaagctctaaagcccaaagaatttcccttaattttttccacgcagttcccttgaggttatgcagctggatgttctcagagctgagagtggactggcttactataaactattcattctaccttcagatactttcaggccctctgttacgatggttgactcaattgttcctcaaaccaaagcttatgcatgtctaagttctctgatcttaaccttttgaaaggcagtaaaatgaaagaccttatgaacttttgtttgtccgtgatcttacttcctccttttaagatagttttccttatgtaaaagaagcatggagtaattgactttggacaagtgacagagaaagggatggatttctaacttaactgttggcatataccttgagaatgaatacataatacacgttttagtataagccacagattcctctggtctgggtacactggaggcatttttataaatgtaacatggtttattgacaaattcagggaattgtttcacattggtcttttctgtcataccagaggaagttttagactaaaaataatattatccatgttttacagataagcaaattgaggtggagtacagttaaagagcttgcttaggtcacatagctagggacaaatccctattaaatggaaaggatatgagactgaattagtttgccatgcagtaattaaaatcacaaagttctgtacaatctccttgatttttaaaagaaaaagttgtctgtttcatgaaggacagctacttacagaatatatgcaatagggttaagttgaaattgtttcaaatacacaaaagaagccattttttaaaaaaagggttctgaaaggggtgaaaatattctgttagtcaacgaagcagaccacaatagtacatttatagacagattagaatttatggaaagagaaaataaattaaaaatatgaaaaatgttaaacataattgtgttacggtggtagaataataggcaagattttttttaacttcttttttcacaatctctggatgcatgctgtttttgtaattagcaactgtgtgttaaagaaataaactacgtaagcagcccctttctgcacaagatggctgctatgttatagaagtctagttcaatttatacacaggtgaatttttctaatcttttattttataaacaacgatttggaaaattcttttatcttaataaaaaaaagaccatagcccttctgttcattgcaggcagtctttagttaagacaatacacacaggaaaaggaacaggttatcaaacatgaaaggtatttagttaaaaaatcaagtccctgctttcaaaatgctcataatctaaggagattcaagttaagctcatcatagagctgtgtgcagtatccttaaactacatgctaatttcaaatatgagagagtacatatatatgtgtgtgtgtgtgtgtgtgtgtgtgtgtgtgtgttttcccaagacctttctccttccctatttaaaacaataacattttgtcaagggaaaataaacaaaataaaatagtttgaggttgacccaaaactctgaatatttgaattctaatttgattctaaagtcagaaaaaaagtctactctcctggtataatacttttaaagcaaatggaatccatcatgcatgaaaaactaatctctgacctttaatggtaattttactgattgaaaaaagtttcaaacactcagttgtgggaaggaaacagacatttgctcacagtctgcagactttggctcagctgacagtaattttccattgattgggagaaaatcatggaaattacatagctatggctggctttagactggtcttatgtaaatttcaaccttaattctgtgtttattcttttgtgtgagtgaaataacaacagagtctctataaaaagatgttactaatatatctgaggtgacctataactactatgcatgatatagttatgtcttttggattaactatatattttatgcatttataatacttatacatgcacagttaaaattcttttaggaaaagcaataaggtactctgttctgaaattgtttctacaaatgctgcagtatgagtttttcaatgacttaaaaatttccatatgaggagaagtgttagaaatgtatttttccaaatgcaggtgggaggacatcttctaagcctcaagccagttctacaggaaccaagacaaacaccgaaaagtgaaataagattaagtctctgcaccatttctaaagcagtgaagcaaaactaccttcaagggtcagtggagaagacacccagtccacagccatagatgctaggatagtcttggtcacatccccagccataccttattgagtcttggtggttgaccctgagctctcatgttctagagttccataatagccaggcttccaaatgcaaaaagtgtgtgtgtgtgcacgcgcatgcatgtgcgtgtgcaggtgtgtttaggcaaattcacttaataaaaatgggatgctgataaggtgagaaaaacactagccagacagcctaaatgaacagtaaaacacttagaatcgtgcctaacttagaatagtgcctggcacttagtctggaaacacaggctatacataatatcaggaaggacatcttcggtccgttaagatatataataactatgttttcagactttatagaaccctgtattttcataggtataagttaccatttatgagaaacccatacacaggaggaaaataaagtgaacaattttaatcataacaacttactgagttttaacttcaaagcgtgtacttatatttatacttatttgatgtaattcattacccatattttgtcagcagcaacttgtaaaaactttaaatgaactactatattgtcaatcattgctttaaaatctcaaaatcatttcatgaatacagcacattaatatatgacaagattgaaaaaagttatataaaatctgattgagggcataatttgttaataactctaggcttttaaaaattgtgaacttagagcaccgctatttccctttcaaatctccctctctcacctcctttcctcctctactccttcttttcttttcttccttctttccttctcattattcaccaacgaacccaccaaccaatcagcaacaattatttgttgaagctttttgttgttttctcattaagataaaccaattaagtaatctattttttctattgataaatttgtttatagaaaataattttaaagtattcaatttctaaagtcggttgctctaaagacccatccttggagaaatccaatgatttcctgcacttaacactgggatgaaacacagggcccagggacattcatattaaacttgaactgactccatctgtactttgttcagtctgtttattgtgcttctattgagttttcattctctcagtctgatttcctttctgctcctgttccaccaacatggcaccctgagggcttttctccatacatcagacatgttacctggcctatgtctttccctcgctccctgagatggcattcttggaacctggcattgaacagggccttcctcctataatgtgtaatgataatcctccaatctactgccctgcctagacaagatttttatgcttagggttggaatcaagtttttcaagcacaacccctgtgacagctaatatttaagggtctcagcagaatttaatttgtaaagaactaaatataaatatacttcttaaatctggcatcttgctcatcttcttgcctttgtgttctccctgttcttttttcctttctttcaaattatctcctgcaacattaagaaaagtgtggaatggaaaagtagtcataaaaagaaagctagagtttggctctgaaatgtctatgagatggtgtgaaaaggcgcctcaggactgaactgtgcctggaaaggcaactttttcttcactatatgcagccttcctgagtcactggtcactgctagcagcacagaagccacagaatgaaaggagagcaagtgctgagtgtaatatgggaattatagagaaacagggagtgagttcttctgttgtactgtatgaccatgtcaccggtccctcttaaaagataatctaaaaatagagtacacgcatgcgcacttgtgcacacacactataaggtctgctcaagtactaggattatttgggcttgaggatttttggattgattgaatacaactttatttatgtatccttgattcaggaataaaaaaatggctaaaatcttttgctacatagcaattagagatttagggataacataatctgaggatgtcttcaagtctcagatatgtaacttagctgtgcaatcttaggaaaattatgcctctttcatgggccacataaattctcaggactaattaagacacactattggcacaataaccagcaaaatgccttagtttggtttttataagtgtgctggatttttggaagaagtccaataactacatactaaggaaaatagttcaatcattttttattgctttagttcttatcattcactcagtattgctggtgattgagggaacataaacctctagaggaatgaactgataccactgcatgagaccaaaggcaactaatcatgaaatgagacagtcctgaagtaactggttctgattctgaccaagcaacccaatgagtagtttatgggctcatgtcatccctttgaaaagcacaaataaagagcaaagaaaggaggtcacacaaatggaggttactctcctgagtttgtcaagaagctcattgggcactccatagttgggaacactggtattctagaatctttatggcttatgggtcaaatccaatgctatctatatttacattatgttttaggcattgcagcatatattcaccatccttttcttcctcatgctctcctccctcagtgatattgggtttagtcacattatgtgctgtggctaacagaatgtgggcacaaatgatactgctttataaactgaggccttacaaagtattgaacatttctacttgccacattgggagttgtaaactgtgccacaaggacacgccctgggagatcactggtccaagaaggagaaacatgaagaacaagcatgaaggcaacctgcagcctgaagcagcactattctgacccattagtaggactatgagcaagaagcaaatgtcattggtattttgtagttgattgttcggtagcattactgtagcaatagctgactaatgcaccttgcaataatagatcaacacagaaaatgtgaattttgtttttctcttggaatctcaacagttctgactaattcaactaatccctaacctttctattttattttgcctattcaagcttgctagcaatctagactgttatcattccttaaatatgcttcatgtagtgtacagtgcctccaccctcgacaattcccatctgtctaatctttttatgcaagattcaactaaaatttttttctttcatgaagaacatcagattctcccactaattctttctgagagagaggcaatttcttctttaagctcttttatctctctctcttgctttattgatgaccatctgtgataaattatagtacccctagtattgttctataccacttattggttaatatatcccttggcatttgaaaatgctttaaggactggaatacttctcttgaatttcatacagaataagcccttcattagttacaatttaaattaattcactccccttgcccccagtctgcttcttctttggatatcctaactcagtaaatgtcattcccatcctcctagttgtccaagccagaaatgtgagtgattattaatccctatttctcttacctattaaccaagtcctgtttagtcaaaacccctaaacatcaatcaaacctattcacctctctccagccccactgacattatcttaaagcccttcaccactctttcctggaatattgtaattgattctcacatgttctacctacttttggtcttgaagatttgcaatccaatttcccacagcagccaaagacattttttttttgaagtgcatatttaattatgtcatttgctgcttaaaatatttcactggctccccactgcagcagaataaagtagaaatttctatgtgacttatcagatcttttatgatctacagtttacctctatagccctatttctgactgactccccaacttatgctctataccttaggccaactaatttttctgcatctccccaaacctaccacattttatcttattcccagtcatttgcacatgatactgtgtctacctgataccctctctctccttccaccaccctttccttggctatctcctcttgagctttatatctcagatcagataacattttcattaaaagcccactctggcattcctctctccctcttgctcaagcaagcatggccaggggcccttcttgcgtgttcctacagcatcctgcatttacatgtttccctgtagcacttatgatactatagtttctgatttacttgtagttgactctatgggtagcctacccaagagccattccttcctactaggcccccagtgaaattcaaatatccacctacccttgcagccacatacttacagggaggtgggcctcagccccagccaccatgagggaaacctgattgtctcagctaatcatgaaagtacgatttccaaggcagtgatttgttaagacatcggcatgtgaaaccattttggccaataagacattgaagggaagtgggacaaggggagaccatctggaaatgattttttttctttcttaaaagaagacgtaaaaagaagatcctcttttctgactggccatagttatctgcatgtaataggtggacctgtgacagacatctcgagtttacaggaacaaaccagaaaactcaccaacacttgaggctggcagaagagaaagatgaaaaagactcaggccgcctttgataatgtcactgagtgacttggagcctcccacctcaggatggctttggtttaagccagttaagttacaactttctggcagttacagctgcaagcattctcactgactgacacatgtctatcttcctcactgtactgattattaatgagaatttatgcttggagatggaactgcaaaggaactaagaactaaagaaaacatcttagaaggctgcatggcatcatggtaattaatagggaaaactttattaatgtggcatcatatagagaatcagaatcagcttttgaggaaaaggatgtagaagtcttctgatttattttctgggccagagaataaaatggaacagtaatagccttttgaaaagctaggtttaagatgatcacagaaatcctactgtaccaaattcagaagcctctagaaaagtgacctaattcagtttctgctgtgctctgccccttgctgttcactttcctatctcagctctggttttacttcaaaagctcaggaacttaaaagggggaaacctaacaacatatttacctaaactctgatcaaagatccaagaaaaggtcaaggtgatagctgaacccacaattatattaaccttttgtggaaacattgaacaatgcagtagtatctttgcttctgcagaatatcttgttagaaacaggaatttcaagaatagccagaaagataaatcttcttgctacctacgtttttacgctttaaatagtaaatgcatagcaaaaggacctacacagtagtgtattaaacagtgacacctttgtatttatcaataacagaactctcaatattcataaggaaatgtaagataatatggataaccaagattattgcttgagcatattctttaaaaattggcagacagttcaagctcctatagtgctgcaaatggaacttattgtatacttatagttacttgtaaaatgagataattcgtataaggtagaagttacccctcccttgaaagtttggtagaacttgtatgtagaattatttgagccagtactattgacagtctgcttattcactaatttctatgtgtggaggggtaggggtgtctaaaattgtaactattgatgcaatctgtcaaattgtataggtctactctagattttttttttaaatgtgttgagtcacaatgataaactagattaagaaaatgtggcacatatacaccatggaatgctatgcagccataaaaaatgatgagttcatgtcctttgtagggacatggatgaagctggaaactatcattctcagcaaactatcgcaaggacagaaaaccaaacaccgcatgttctcactcataggtgggaattgaacaatgagaacacatggacacaggaaggggaacatcacacaccggggactgttgtggggtgggaggagggggaagggatagcattaggagatatacctaatgctagatgacgagttaatgggtgcagcacaccaatatggcacatgtatacatatgtaacaaacctgcacgttgtgcacatgtaccctaaaacttaaagtataataataaaaaaaagaaaaaaaatgtgttgagtcagtttgtttcatttttgtacttttgtgttacaatcaaacttaaaaatataacccatggtaaaaatactgcagctttaaaaatacattattatttttccctctctgtgattctggagccatatagtctatagagtagccccccccaagacacatataactattaaatacttaaaatatggctagtccaaattgagatgtgtcaaaaatataatacacactctggattttgaagacttagtatgaaaaaaataatttcactgacttttaaacttttaaaaatctggctattaataaaaatctaaaattgtatatggggtgtgcattatatttccactgggtagcactgttctaaagcattcaacagctctcctcacattatgccctgcactacagacattgacatatgtgtaatctctaaaacacatgttacaatgaaaaaaagcatattatttcgaaatagatgtgtgatcttgcttggaaaagacacataactttcttgcatttccattgcttcatctttaaagtaaaagggctgcataagatgattcctaaattcctttccaattcgcatatatttaatgacttcatcatttccccaatagattccaaagccagagaatacaattcatgtaatagctcatttcagtttgataaatatttctgaagcatttgtcatgtgccaggtcctgtgagaggaggtaattttacacctaaccatcttccacctttttttagcactattctttattcttggcaactctttgagaaatatctatggaatgaatggacacattattattctgctgtctcatatgttaatacagaaacagaaatacacacacacacacacacacacacacacacacacacactccagactggctgtgaatgaaataccaaaaaaaaaaaaaattaaattgagttgtgattctttagcagaaactcaagtgcccatataactgaatggtctctggatctggtagctaaaagtgctttactctttctgaaaaatggaaaatgcattataagtctaagtaaagagcactccaattttagctgccttggccccttctgaggctttcctgggtcaataattagcaacagagcccaggagactgggggaaggaacaggatgatgaacaagtgcaaatgagctaccttaagaaagcgatagcacaaagcatgagagcactcagaattgtactgcaaagtgttcagattaggcaggcccaaaaatgaaaaaattgaaaattaataaaccagaacctagctgtatgcactgacttaatgagatccgttgttaatgtaacacatttttgcctactacttttgtgaagacttcttaaattattttaaatatttctcaagaaatgcctctccaattttactggggttcttaacgttcttctcaattttctttccaaaagcataagggagagaaatgaaaagatgatttgaaatactagaaagaatgtaggactaagagccaggaaatttggtttctagtcacagaactgctacaaactggtgatatggagttgaacaaattgtttagtcttctttggtccatttcttcgtctgaaaaatgaggataaagctctgtatattctagaggtggataagggggatcaaatgagataatggtaagaaaaattacatttacaagatacaaatgttctataagtgtattttatacaaaattatcagagaagtctcttatgagctaaaatatgataatagcacatgtggtccaagatccaaaagtgaagactaagaagaaaaatatataacaaaaattatatccttttattagaaatagcacaatatccattaaactaacctttaaaagcacagggagcagtggttaattatatagactctgaagacagactagtggaatttgaggtctgacactgccatttactagctgtgtgatttggggcctctcacttcaccttgtgtactgcagttttcacatctgtaaaaagggggtaataatactacatccctcctatgtttgttgtgaggattaaagcacttcacatatatgaaacactggcacaatgtaggtattatataagtatagctgttatatgggagtacattctagaatgctttaaactctaggcacacttcctagctagcatttgatttatcttgtttgaaaaacagcctgtatttaacatatacatatcagaggttggaagtgtcacaagtgtatgttgggagaacaaagaaaagcaacttcagtacacaatccacaaaataatagcctcgatggactctacacttcagagggctaaattagatggtgaaaccaagtacactcatgtagtgccttggtacatgtgtggctttgtgtttttacattttcctcaggtactgaaataatgactaaaaacaccctgtatttgcattgcatttaaaaaaatcactttcacatatattacctcattagaagttgagggtcattaaaagtggacaatgaacttgctttcaccctcacaaatctctctgaggaatcaagtcaattgaatacgtgtacttgagaaaaaaggtgggctttttgccaaatactttctggcagctcataagcctgagcttttcatctgagccaactgcaagcctggaagggtccagaaaagcgactcatctgctcagcagacctcactgcccctttgttgtggtgggcacggtgcctttcacacacagctgttggtcagtatgtggatcaccgactgcatcctccttgcaagaaggccattttggatgtttcgctaaggaatccaagagtgcaaggcagagaggggaggctgactagttggggacttcctccaggattttcccataggctccacccagttgcttcattccattgatggattcaagggtgattttccatgagactacacctaatggaaaaggaagtctcgggctgttcttatctaatttgccaactgttacatcagcattattgattcagagcccccaaatcagggaaatatagaacagatgggaattccctgcaaatgttttcatggaatcatttgctaggaaacccccaactagcaaaaagcataaacatatacctttttattgaagccctgtaaaatctaaccagaatgcttgctccaggaagagtctgttctcagaaatcatgttgtctgatcaagtttacttcttttgtctactcactgaagtccttaaatacattataagagaatatgctaaacatatgtcaaccttcaatcaataagcatagtgtaatgtctaaaggtcatgatttggattatcacaatactttaggtatcaaaatttataaaactgagcatatctatattatctgccaaatggaaccagattattttaaaaatttcttcatcatcttgtgttatttgaatgtaaaaaacctgaaggcaggctgtccttgtctacttattcaacacttagatcagtgcctgaaacatagtaggtattcaaaaatatttatagaataaatgaatatctgagaagctgagtcattctcaccacattgacattttacatttatctatagtcaaaacagtctcaaatttatgaagggaaattaatattagcaacataaaagtgttttcttttgcagatatatgacattaaattataattgtgcaaagtcaaaaagtaatttacaaattaattatggagcattattaagtgagtcaaagccattctataaataaacaatgcagtacttttctaaaggttgttactattatatgtaagcccttgggatgaaaactgggagtcctatctttaatatgttcatcacgttaattaatgaatgatataaacaattcatgcaaacacctcagtcaagcattactcttggggatcagggggctatttcagtaacaagagttaaaagcagggaacacaatcttggatttggtaaactcatctaaatttcttgatattctccaaagagtagcatttaagcaaaacctggtacagaagtgaaatatatagttgaagccaactttcccttggtaaggtaactatgatcctttcacattagtgagatcgtttggaccccatcgctaaactagccccaggcaacctgttcttggtggcattctccccacctcctcctgcacaattctctcctgcagagagaagggtaaaagtcttcatgctctcccactctccaatgatgctcatgaaaatttgttctcaggtaagattctaatctcacgtattcacactcacatacattcaaatcaccaagctaccttcccctgaagtatctgacttactggtttgcctctatgttaaaagagaaaaccattttttttatttctcaaaagaaattttaagacttagctgtcaggaaaataatgtcttttagtttatttcgttttgagattaaaggcctttctctgacattgaaatttcatatgtagactaaattgaacaatttggttatgttgtttcagctacttacaagaaactacacaactcattggctggttgtctcgctgtggcacttctctgtttatgttgccatggcttcctcgacagcctcattcctgccttcgtgtctgacacacatttctgacatcgtgatggatgcctctaccctgagcaccagcacctcctcaagggaaacgcagcctcaaccacactcatcattttctttcatcaaccgcctgtccttctggatcgcccagtttccagtcttgagagctccgttatcactgaccctctgtctcctgatcccattgtagtagttgatagtgtcaactatgttacacctatacaatgttttcagaaatgacctctttttctattttcccctccatgaatttagtttataatattatttcttaaaatacaaataatacttgctcattgtagtttttccctagggctgccattacaaaataccacagacttaggtggctttaacaatagaaacttatgttttaaaacagttccggaggccagaggactgaggtcaagatgtcagtggggttggtttcttcgggagacctctcctcttggcttgtagatggccatcttctcctcatctccacgtagtcttctctgcgtgtgcgcgtgcatcttaatctccttttcttataaagacaccagccttgttggattcgggtctaccctaatgatctcattttatcaaaatcacctatttacaggctcaatcttcaaataaagccacattctgaggtcctaggttaggacttcagcatatgactttgggtgtgacacaattcagcccataagcctcatgttttccctatggtatgtgctctcagtccagaatgacatttcttttccagaatcattttgataatctatagaaaaactgttccacagccacagagccatccttaaacaaagtccctctgttcagaatccaaggcctgttgccccatgttaaatttatgttttcaagttccctttcttgcaattctaataaaacacagtcactctgaatctctcaaacacaggcttctatttcctacttcttttgcttctacttaggttttctgtctccaagaatgaaattatccttcaacattctaatcaaatgctagcttactttagcgccagcttttctcagtctgagatatgttcttccaaacaatcatgattcctggttcttagatccatggcccatttacctggctctcctatttcatttacctttctctgtgggtttcccagttcaccaaatcataagtatctatgaatagagagctccttagagcatggctactgataaatcattcactgagttgactaaatccaggcagtatgacatcaatcatttcagaggcaatatgatgaaaatatttcaaacaattattatttattcttgtttttatcttgtaaacatggcataaatcagattttgatgaccaatggtcagtgatggttttttttggttatttttcttcccaaaacagcataaaatttttactttaaacaattacaatatgtatgtatatactttattgaatttttggtgacatttttaaaaactgagagaaacactgttatttttatccacattatgagatggaaagccctggggtccattatgagtgacatgcttgcctaatgttttgcaagatctggcttcaaggcactcttagataatgtctagtttattttccactctaattcaccctttccaagatttactctgtatttgatataaaaaatcttagttcttctccattttcctgtccttaagacaccttaacaaattgacattaggctttaaaaactatacattaatacaggccaaatgtggtcgacaatttgattggctagcccacagtcttttccaaacttcttcatccttgctatctttattaaaaagaccagaaaaccaaatgttaacttccatctttctgcactcaagatgaccatgtgtcatagttctggctaaagggctgtaagctctggggaagggctttgtgtttcttataagtggggtagatacaactttagctggccatcctctctcatccttcctccttccctctcactatctgtgacacagacatgatcatctggacgtgcagtagccatttgccatcaagaggaacaggccaagaaaattgtggagatgctgcctctttgcaaatggtgataacatcatgcaacagctgaaacacctccggtgccacctacttaaaagtaattcctatttgttcaagctattgtgagtccaggtttctgttatttacaattgaaagcattgaaaactgatataccaagcatatctgttggcagtttgagttttcctcaaaggaaaactcttttgtagccatagaacatactctataatcaaaatccagttacaaatccgcgaatccagttctctaggtcaaaaggaggcaaaagagaatgagttggctgttttcactataaatcactcaccactaaggggatctctgttatcttcttttttttaatatgaagggcagcatttttcttttccctcagggattgttattaactattttctggatatatcgagaagggggaagttacattaaaaattagacagaaaggggagacttttcacttaaagttgtgacaaccttcacttaaagttattgtaacatgcttcttgggaaggaagaaggcataggatggcatagcatgtcaaggtccatctgctttcttttgattttccctgtgcagaatacctcataactgtgatccatagttggcaagaatcccattcatttccaacagaaatccaggaagcttagtgtgtctctctccagttcattatcagagcaattaaaatcagcagttttaatgctgcttaaagggcttcagattttgtaatttatgtagcctaaggcaagattcattttttatggagagattttgattccatcctaaagagttctaattaaagactccttggggagtttttcttgatctgctggatttaagattctttagtaaataacctgctaagattatttctggtggggataatttatctttaattttcatatcctaattatatttcatacatatcttgaaacccaggtcagtaatctcattaagtaaatataaaatagtatataatatactataataaaaatgatgcattgttaaaagatgtatgcaaatctttaaacctgcaggtcttgtttatgaggatccaaagctgaaaagtctttactgctacttatttgaataatagctaccttcatatgcttaatgttaagttatagggttttcttttaggtactaagtttcctcataaaaggcatacaatcattatatctctgagtgtttttaaatttaatagtttttttaaattggagtctgatagcctttataggattggccacttgtttgataatatcagtgctaagggaagaaattaggggaaaaaagttggaagagaggatccagtggagttttttttttttttttttttttttttttggagatggagcctagctctgtcacccaggctggagtgcaatggcatgatcttggctcactgcaacctctgcctcctgagttcaagcaattttcctgcctcagcctccctagtagctgggactacaggaacctgccattatgcctggctaatttttgtatttttatagagatggggtttcaccaccttggtcaggctggtctcaaactcctgacctcaggtgatctgcccgcctcagcctcccaaagtgctaggattacaggtgtgaggcactgtgcccggttgatctagtgaattttatttgaagttgtgtttgtagtgtaagcatgttgattatacgtatttagcttttatgttagttgtgagtatgtacactgggaaaactagtgcctcccaaccaacccttggtaccaccattgttttacttaggtttgtagagaaagcaaaaccatattaatattggaacagaacttgaagcgggtcttctcctcacctccccattcctaaaaaaaaaaatcatttttatattctataaattaattacattctgtgtgtctcttccatggaagagatcaacctaataagaataacagaaatcatctaatccttcccatttcttcttgaaatgttactggtacatatgtttttccttttcctgaaacccatttgcctctgcttttcacttggctaattcctattcactcctcatttttcagcttatacactacttccttccagcagccttgatttcccatccatcatattaattggttctctcctttcctgggatctttacttcttcaatgcattttatctaattatgcatttaatcatgggctgatatgtttaatgtttttcttcgctattcctttggaaggctcatgacagcaggaaccatgtcggtatgtttaccactgtgacctcagagcacagtccagtcctggcatagtataggtgctcaataaatactagtagtgaagatctcagattgctttcctgtgcccagagcatgggaaccaactccaagaagcaatagcaataggagacttctgacagtaaaatctccattttgcagaggaaacagctatgaaggcagaaagtgcccataactcaggaaaagggaggatggcaaagaactgcatctatttcacagtcttgctcagggtcatggctgtggttatcaatctttgcctctaaaaatacatagtttttgcccctatgggtggtcactgcttagtcactgcaatggatttgaactacacaacctacatttatcacttttacccatttaagaccaacttaaaggcaaaaagaagtaaaagaatgatgaagactttttttttaagattctgcagtaccttcataagtgtctccctctcagggatgaagtaagaattgctcctttaaaaagtgtctttctgtgaaaggaccggaaaattcctaaagatagaaactaaaaagctagatggcagcagactgcctttcatgtccctatcaatgaatagattgctaactaacaatcaggggcattgttcatatcaataatataaatagttcaaaagactccagaaataagttcctaaggcactcccagccatttggaataactatggcttggaaattttcccatctttgtaattttgcaaaaaatgatctagactagaggtctataactatattcagatgattcctattcataaactgagaataaagaacagaccaacttcagtaacagtgacattgctgggagaataaattggctcaagaagtaacaacagcagcaaaacggttaaggcacttcaaggtaatcaatttagctctatcgctttttgctgtgactctgaaggaagttaattgaatctctgaaagtagtatcttgctgcctggaattggtacccacaagcttcaaataaactattccatgaagtttaagctgtccttgacagaaagaagggcacaatcagctccaagccattagggaaggtataatttcacaaggcaagacagccaaggaaagtgatcctcaaagggaaactttcgtagaaaaaattttgtactttcctgtccccatccatcagtaacctcaacagagctatttttggattgtttccctttattcctattgatgactattattatatttttgaaaatgtttttgttaatgttgttagaaactggtaggttaatgaaactttagccatggttgttgttgttagaagcaggtgtaattaataaaagtttagctgtgaaggccaggcatctcagggttcaaactttagcttattgactactttttaagctatgcaacccttagcaaactgcttactcacatgacctctgttctcacagctgctaacagaagtggtggcagtgataataatgttgagaattgttttgaggtataaccaaattaccatggaaaatgcctagcaaaagtccaggcttatagtatgagctaattaatatatcaaaatctcattcctttctttttttggctttcctttcttctacggccttctccatcttccaagacccagccttagtagcagatgatgacttgggtctcctgcctaccaagaagcccagtgcgctggcttcctgacacaagacatagccctgttagggagtcaggaatctatttactcaatgttcagttcatattagaatgcaaatgctcttgcaaataaaaaacattaactcatgtctaattgcttatctacactttcagcacttcttcatttttttaaaattttactgtgagcaggctctaaaaagagaatatagcaagaacaaaggttttggctttgatgaggaaaagtgtgtggagagaacacaaaaagaggagaaggatgaaggaagaagacaggaaggtctcaaaacctgagctcctgcagcagtcactccactgaactagcccattctgagcttgtccagttcttttgtaaaccaagcttgcatgcttcttaaattgtcaatggttagcttttcatggttcttaaaaaacttaaatttttaatgatgctggtataagtgaaaggcattcataagttcccccccccccaccttttttttttttttgacacggagtctcgctgtcgcccaggctggagggcagtggtgtgatctcggctcactgcaggctccgtcccccggggttcacgccattctcctgcgtcagcctaagttcccctttttaataatgaaggtcataaataggagcagtcaacagctaacatttttgcagtatttaccatgcagtagacactgtgctgggcactgtacatgattatctcacttaatccccacaaagccttatgagctattattattatttcaatttacagataaggacactaaacagagagagaatatacagctaccaagtggcagaatcagctaataggccatgtgttgatatgttctgattgcagagtttgatgcctctcctgggtgaactcaataggaccagaacacagttctactagaacatctggtatgatttcacaatgtcacgttgtttttgcctttgaagtgaattggggtattctgaatgggcatggggacattttaagaggtcatggggcacgagattaaacctacaaatgtcatgggagcctctccatcttgtgaaccctcttactaaccaccttcattcccatttaggcttttacaaaacacatgactgtaaactgattttctttggtagaagagaggaatgttgtggagaaaacacttgaaaaagttcataggttaaaaaaacacaagaactacttgtttcatacatggttttatgtaaatgtcaaagataacctctcaaatattctttaagtttccactaatatgtgatatcccaaaaatgttgcctcccgtgataatatcttgcattcttctgttattccatgaagcatatcttacttggttctcacagccaacaatcaactgaggtaataaggaaagataaccatagccctgctttatagaggcaaaagtgggatctcatgctatatggcacagcagaaacagaatctcaaactagtatttaggcccctagtcccagccaataacaagtttcattagcgcaaaagttctttacctacacacagtctatggctttcttggtgaaaatagtattcttggtgaactgaattttgcacaggaaacaatggactcagcatctcatattcttgtttagtgtatcttaggaatcatgtgcatgtccagtctaaagcagcaggttgtctaaagagtgttcggctaggcagtgccgaaagactgcacgtcattagcttttgaaagtcattaccattaagtccatgtccctaaattgtttctttctgtgaggaaggcagaggatcatatttgaatccaagatcatcgaagtatggtagacatgaaaggcgtgtggttagggcactagcagaactcaagagcaagtatgcactttccaagttcccagggggcaggctgatggcagaaatgtctaatttgaacaaaactgctaaataacttgcttttttacttaaattcctacaaaaatttcccactgctatagcaactattaatgaaagtctgtttttatgcttctcgatgacatttttagcataatttagagaaaaaacctcagaaaataaaaaaagtaattgtaagacatatgttatgaaaatatcttatgaaatatgttatgaaacttttgttcattatgtaaccagtgccaaatttgcaaccatttaggtctctgatggtgataacttatttatcttgtcattacttttccaaatcccaagtcctacagaactgtagcttcaactagaagccaagccctacctttgtcctacacaaaaagagacctagactgtgagcagcctcgctacagatttctttgactccctttggatcacacactatgaatataagaataaccaagacatgcatccaagtttatttttaaattctagttttgctttttctgatgtagcaaaaagtgagttatctgagcatcaaattacatattttcctgaaatattttatattttctcaaagccattttccttagtaactaataatgagagatgatagaaggcaatttaaggcatctcagcatttccaaatagcattctgtctaaggttagtttcagcatgcaactggtgataaatggcatatagatgcatgtgcaggggaggaggtgttctgtggcaaaagaagtttgagaaaaagattttaaaaagttaaacagttttttagcaattctcagtgcctttaatatgcaaatcaatgaatcatgtttaagacggtaacgatacatgcaacatttcttaaaatgatttaagtatagaaccattatttgcagagcagttgcagggaccagtgttccatgggcacacgttcggtcatgtgggctcaggagtcacacagacctgaattcctattacagctcagaggagctgtgcgtccttgagagaatgattgaagcacatggtaaatgttggtgtcttagcctcagtctcttgaggttaacaaaaggtcactgaattcaaaaatactaagaaaactacattatattcttgacattcaaatgcatcttcacaaatcccctaattcactaatatcactctagcatttacttttcccctagaaaaatttagtgggtttttttgttgttttgttttgttttgtttaaaaaaaaaaaagcaattctcattggtgcattaatccctgttgctttacaggaatgtgttcagtcttctcaccctctctggaatctcattttcatcaacagcccctatttgctaatgttttaattctctcttgatgagcacttttgcattgactggcacactctacagaaagttccaattttttttccctagaaacaagcacagagtgaactacgatggacttgctcataaaatttgatctcatttatcactttaaattttatccttttaaagaattaataattttcttagctgtttttgcgtagtgtctactgtctagatcaacgctgttcagtagaaacataatgtgaaccatgaatgatggccacaacatgtaattttaaatttttaaaaagccatattacaaaaagttatttttacaaccaggtgaaattaatgtatttactttttacttttgtgggtacatagtaggtatatttatggggtacatgagatattttgatataaggcatacaatgcctaataatcacatcagggtaaatgaggtatccatcacctcaataatttatcctttgtgttacaaacaatccaattatactctttaattaaaaaatgtacaataaattattgtgactgcaatcagtcttttgtgctatcaaatactagatcttaatcattctatctaaatatatttttgtacccattaaccatctccactcccacacccctgccactcactacccttcctaggttctgataaccatctttccactctatctccatgagatcaattgtcttcatttttacctcccacaaatgagaacatacaaagtttgtctttctgtgtgtggcttatttcacttaatataatgacctccagttccatccatattgttgcagatgacaggatctcattcctttttgtggctgaatagtactccattgtgtgtatgtaccatattttctttatccgttaattggctgatggacacttagatacaaccaggtgaaattaatttaaatatgttttatttaaccctatacacagtattagtatttaaacatgtaatcattatgaaaattacaaatgagaaaatttttactttttttcacactattatttgaaatcctttgtgcatgttacattaccagcacatctgatttggattagccacagctcaagtgctctatggctactagctctcttgttggacagcacaggcctagattagcagtcagcttccttctgggtggcatttttctacacaggtacaatgtgtttatcagttcagagttattacatttgcaagggagggtagagaataatgaaattatattgtgatttgaatacttggtggtgcatgggtcccttcaatagtttggtaacttaaatccacacgagagctccgttgtactttggatcaaattactccctgtcatgaagcatcagagtcccttataatagtccacaccacaaaagccaagggatttttgtaattgttttacaagtaggaaaagcaataacagtgatttgaaatttttacaaagttaaattctgtaaatatatgttgaatacaaattgtgtacttgacacttggctagttcttaacactgaaagttttttagatatgagacatccaattttcttggcaaaggtatgtatgtatatataatgcgtatgcaaacacacacataatatatccatatatatccaaaatacatatatatgcatgtatgtatgcatggcgtaactcctatctattttacagggtcacttggttggtgattatttccttcttttcctttgaatcatgggcactatagaaaagcataaaatcagtcttgtttcataaattaatttttctattcaaacttgcacttatctttgatggaaagaaatgtatagcctattcttgtgaataacgctagctgatgtgagctgactgtttactctatgccaggcgctagtttaacggctatatatgtattatctcatttaatacttgaataactctaatgatgtaggcgcagaggcacctgaaacagagcacacttaaggaatttcataaatgtcatacaagctgcaagtggaagagccatgatttgaactcaggaatttctgctcaatcatgaagtgaactactcactttaaatgcatagtattctaacactctctttttagataatgatttgttagctaacctgaattaggtccttaaaagcaattctcaaattatgattttacatatctttgaaggtcttaacggaaaggaactttgtaaagatagttttatacttagcataacctctcattttattttccttcaagacaaatccatgaaaaaattcagcttcattccttatctctgacaaataccagaatgcacaacacatggtgcctctgatctgtatcgtttcccctagcgcttgcattcatctttgatgttgatattttgtggtctagtggctcttgagagaagacaattacctatctcctttgaaccataaattaccatatttggagttgcttcttcatataatttttactagtcctttttatttctctcatatataaattgaaatgttgaaatgatgagatctatttttaaagtacataaattttggggaggaatgggacagagtttaaattgttgacaattatacataaaccagctgaatcaactgggcaagtaaacatgggcaagtaaactgggcaagtaaaccttcagtttcacattaatccatttgtgtgtaggcatcagggaggtctcattcttgtaaccccagaatataaaatataaagtcagaagtagtcttcattttcacacccctcctcttttcaaaaaattcatttaaaaatatttaactgacaaacattgcatacatttatagtgcgcaagatgatgttctgaaatacgtacacattacggaagagctaaatcaagctaattaacatatgcattaactcacatacttttttgtggtgagaacatttaaaatctactctcttagaaattttcttttttttttttggttttgttattatttaaagttcagggatatatgtgcaggtttgttacaatggtaaattcgtgtcatgggggtattaagcctagtatccattagttatttttcctgattctctcccttctcccaccctcccctctctggtatgctcctgtgtctgttgttcccccctatgtatccatgtggtctcattatttaggtcacacttataagtgaccacatataatatttggtttacaatacattgttcttaatgatagtcaccatgttgtacagtagatctcttgaacttattcctcttgtctaactgaaattttatatcctctgaccaccatttccccaatccctcctgttcccatcaccccctggtaacccccttctattatctgcctctgtgagtttgacttttttagattccacatagaagtgagatcatatacatctctccttttgcttatacttactagctttcagccagaagaacaatgttagcaaaagggtcacttttgaaagctgaccaacccctggttaaaacaacatatatcagaatgtacagcataaagtttaaggcttcataagtctagcagattatatactcaatatacatttgttggatgaattattgaattggatataagttcacagggacattgagctattctttgatatttcctgggcttggtgttgatttcatgaatgcatgcttgatgtatgaagaaatatttaggcacatatcttggatcatttacaattttctcatacctccataatgttatttctgtaagcttaaaaggatattgtaatatacagtccatacactcaatttcgaatgagaaggttgaggacccatgaagttaaggtaacttgtccattgttgtttaatgagccaagacaaaagtggaaatctagttcagccggctgctgcccttccatgcaaaaactggtataggtcatattatgattaccatttgaatgcaacctaacaaaatgttgtggtctgagacttcatttatgataataatgaaaatttatattaaaagcaagaaattacattttgcgtggtggattacacagtacatagcacataaatgaaatctggaattggatttgaatatttaaaagtacattatgccttcatacaagatactaaacgttttatgggggaagaggtttttcacaagggttataataaaaatactttttatctatgtagttgttccttagcagttcctcagtagttcttagtataaccaagaaatactaaaagatgtattggcccatgccttcccctttccccaaagtttactgtcataatggtaaagggtgagcgaaaaatgcttgaaaagcagcccatgatcactgaatgattccatttttagcacaagcttcatgatatgaatcgagtgactcttacgtaaaaattacatactttttctttttttcagagatgaggtctcactctgttgcccaggctggagtacactcctgtgatcacattcactgcagccttgacctcccaggctcaagcaatcctccctcagcccccagagtagctgagactacaggcaggcaccatcacaccctactaatttttaaattttttgtagaaatggggtctcactctgtagcacaggctggtgtcaaactcttggactcaggcgatcctcccacctcaccctcccaaagcactaggattatagggtaaaccactgtgccccacctcgtatgctttttcaaatttcacgatgtgaagtatctgtctggtaataaagtgatatattgtttcacatcatgaaacccttagaatacgtttgatattgctctaatgtttacttatgttccctcatatgccacaaagtagagagccttaagattggattttgaaagctttaagaaatgggacccacagttatcacacatactaaatttttcctgacatcatctaataattaatgatcacattttgacatggtacaaactgaaccaggtcaacaaactttatatgccagaagccggattgatatcatcaatcagttatggggagctttggagatgacataaaaatgaggaatatatattaccggaatcttaacattaaaaagacataatgactataatgacaaaaaagaaagaaaataaagggaaaaaaaccttctttaaatgcatgggtaaacaaaatcttgaaaaagcaatacacatttattttagcgtgacttacactgcctatgcatttactagtgtttttcaacaggttaaggtggtttaggaaaagtccaaaacatattttccaagaaataatgtacgggaaggaaaacctgatttaaagtgagcacgggatatatagcaagaactcaaagtacgacatggaaattttaaaacagaataaaagattatttattggtttttgctaacaatgattactattggtttgaaaaatgaatctggataaaatgtagaataacatcacatatttaagctgcatatggatcaaacagggaaaactctatttctgcatatcagatcgtttcttattttagtcacttaattcacagttacatagtattcatcatgaggagaaacagacagagtgtgaatggctcactgttacccacactattcctggaaaaacaggtcctaaagattaaaagactcaactgcataaataaaaggcatgatgacattgttattacaggcaaacattttttaagatgccatcactgaaaatggatgacctatactttggtaagaatgcagagaactgaaacatcactttgggggcgacataaatgtggcaaccagtatagaaacacatttggcaatatctaaagacaaaggcataacctatgacccagaaatcctacctcttgggatatacccaacctacgtgtatgcacaaaacactgcaacactacatgtacatttgtttactaagtgatatatccaataatgttcataatggctctaattcataatggcctaaaactggaatacttaactatccatcaacactagaataagtaaattgtagcatattcatttggtgcaatactaacaaaatgagaataaagaatgcacaaaacactatgaatgaatcccataaacacaatattgactgaaataaaataagagtttatattgtataatttcattcatataaaattcaaaagtagtcaaatctatgctattggaagtcagttagtggttatcttcgggtgcatagtgactggaaagaagaataaaggggtccccttgggagctggtaatattttgattttgacctagatgttggttatatgagtaaatatggctaagcatttttttctctcttactggcacattcacacccatcattttataccaaatagatccttgcagagtgctaagggttatctataaatagcaaagaaagagaatcctttccattttaaccaacatgaggaaggcaagactgcgagacttttttttttaagtcatgtagtgctaaaacaaacaataagccttttaaattcactccaaaatacaggataatttgtttcccccaccgataataatttcttctttccctttcttggcattttggtgtgtcagatctccctaaggtttatgttgtctcagtttacacggatttgctttaggaaaaaaacctgacgttccttgtatgagtatctcatccaaggggttgaaaagcagcgcatacaacagaagttgcacaaagccgtccttgtcatcttccacacaggaggacagagaacaaaaacgtcccaaccagtgagtggcagtgccactgaggacctcctgaacaactctactcaaagcattttgaactttataccaagaaactgaggaaagttaggagggaaaatatatagtccttttctagaaccagtaagatgtgagataaacaattatttgagcgatgaaatgttttcatcttttagttcatctgagatcagggcagtgatacttcatagaacccacaaataaaagcttttcgtcaggtacaacctgaagatggcagaaggagttttgttgcttgtttttttcctccactaaagtggccactctttcactagagaatgtactaacgtcatcaaattaatgtgattcttaaacaggacataaatcttccctttggatgggaacacaaatctgattcattaactttccattctttatctaaacactgccattatgtgaaaagaaaaattcctgaaaatcaaggatattttgcagttaaatccctcctcccagccagtctattttgttaccctatataaacaaactctgccattacattcctttatccatagcaacttccagtgggtaatccacaaatcaattaaaggcaagttaattgccaaaaagggatcaagtgacaagcattggaagcatatttatgggtgctattctcaaaatctgtgtgtcagaaaagtttcgtccagctagctttccttttaatgcaagatttaaaatttgtattatttctttgaaaataaaaaattaatctcacagttattcttagcttaaggtgtttatgttttgtaggcagacacagacacatatttcaaacaaaacaaggttcctactataggactattactactgctaccgatttttaacttccatttttctttgctttagtattttctacgtataaaaagttttgagatagtgtgaaacaatgtaatagaaagtatattgtaaactgctcctcttccccctacatcttcttttcatcttcctccttgttttactttccctcactgtatttttataataacaaagaagcaaaggtaaattcactcaagagactggagactgaaaacaagtcagtaatgaggtcaatatttatatggttccattgaccttgtgcagttctgagtttcaggcctagaactacaaatgtactcacagatgtatggaatggatatgcttgaacttatatgcaaataaattatcaatttctttgtaaaggtttccctggcttccccaagcagaacctctcatctcagtctctatttattttatttattgttaacttgtttattttctgtctttctctaccagaatgtaaacttgatgaaagcagagaccgcatccattttgtccctcactacattctgttacatttttaggagtatttataagtcagttgttaatacccaacagttattaaaaattaaattacataaaaatttttaactataattaaacaaattatattaaaaacaatggaaataagtattcaaaactcataacttctgaatgatttggctacattttgtattattatgtttttggggcaacttatatctactgtatctatatgatagaaacactgtatagagtactatgtctatgtatctcttgccaactccacatttagtgacctctgctgtttgaaatgggcaggtgagagaattttttggcacagaaatcagcaaatactacaaatagtgcccttcccctcccccatagagagctggttgtgaacatttaccacctgaaggaataatcttttacattctgttctgttcatttttgaatgtttaattcattgtcataacaattttagggttttgtttttatagagtttatttctttagctcaacacaaagcttatctttttaaagcttcacttcaaagctttttttttttttttggaatgtggcttacatacttgtcccctttgaactgtcctttgcatttgattggcttaacataattacagtaatatatatttactctattcacaatccatctttcctctttatcattttagtttttctcttccaaatttacactattaccagctaatgaattatataatttgagccatgtgccatggctcatgcctgtaatcccagcactttaggaggctgaggtgggaggataacttgaggccaagtatttgagacaaacccgggcaaaacagactctaaaatatatattttttaagccaggaatggtagggtgcacctgtagtcctagctacccaggaggctgtggctggaggatcccttgagcctaggagtttgaggctgcaatgagtgatgatcatgccactgtactccagcctagatgacagagtgagaccctgcctctaaaataagtaaataaaataatacattcagacaagttttaaagtagcatatagtattcttcctttgccaatggatttttcctttgctctgattcaactctgtgtgcttatataacccagccttacggaaaatcagacacctctcttcagacccttgttgaaattaaaaaggcttgtcaattatagtttgaaagtagaaaaaataatggaagttaggaggagggagagccaaggtagaaggtgggtatatgactgtggcaaagaacatgatagaagctgaggcctccagaacaaggagtaccaaggtaaagtgtatagaattgaatgcttcctcttttgtaagaagtattccttatttgctctgcccagatcagacaggctttgatccagctgctcagtcaaggtactgtctcttaaaatcacttgatgggggctcatccacttcatgacttaaggacaaatggcactcgttgaaaatcataaaatcaacattatgaaaataaatagtataaattttataaactactaattaagcataaatattcatacctattacccattcaaaaatggtatagttttaactatagtgaaaaccattaacacactgatgatcagaaatatccacagcatgattataaacccttggcagtttggagtgtcttttcttcttttgtcaccttgatttttttgtacatctcctggcattccacatttgccagagctctgtgctggtccgtagcctgcaggccaccttataaaaccaatacctttatatttattgcagagtttgtaatctttctgcctgtggttgttccatgtgctgtcatgataatacagaaaacactcaaactgtatctcccctctctatctctgtttctagtctacattgataattgagcagattcttttgaatgtttgagatggggctttccttcaattttgaaaaaaatgcatataatgcattctacaaaaatgttgtttacaaagtggtacttccttacaaaaaccctattgtagctgttgtagcaagtgatttttagacttgtaagtaaaatgtctgaacataattttacttggataagtctttctcttattcagaaacctgtccttccatggtcattgcccaattatggctcttatacactctcctgtctgcaagaagtgtgctctgaatcattcattcattttgctgccttactgaaagcactgaattagatggcatatgtattgaagtgaggggtgggacattggaacaaagattttcacagaagcacacagagccagggttctagctctgaccaggccgctatcaagttgcatgaccctggggcctttcaaggtcttcaagctcttcaatgtaagacaaatgagtttgaacaaatgaaccatcaggttccttcagctctaaccccctcttcccatgaatgtggcaaaaggaagcagagtatcctcacacttgccatgaatcggaacacatttgctaataggttcattcattcaatacacaaacgccaagcacctaatatgtaccacacactcttccaggcactggccatacaaaggtggaaaaaaggacaaaaattgctgccatgtggagcttacattctattattaataatagctgacatttattttagtgttgtctatgtgccaggcactttacatggctaacacacttaatcctcataatactccattttacaaatgaggaaactgaggcacatgaagtaacttgcccaaagtctcatagctataagtgataatgtgaaaatgtgaacctcagcagcagtgtggctgtagagctagccagctgtcaatcattcctgcacactacatttccaaggtgagcctgggttgtatgtgcaagttgcttataaggtaaccatttataagccagctctattgtactattctgtgaccaagagtggtaccaatgatgatagtttatctgaaaatgtatttcacaaaagaagcttcacaaaatttgtgaaatgttagtgaagacttggaaaatgctatgaaagagttggcaggtagtcctgcattcacgtacatgctttcatctaatctgcacaacgaccttatgaagtagatattttaattttctatttatgtacatggaaatggctcagagaggttaggaaacctgcccaatcaagaaagcagcagagttggcactgaagctgggtctgtttggctctagagccaaagttctcctcctataccatgctacctcttcctacaatgtgcaatggttgttagtagtattgttattcttagatataaatgttgtctataatttctttttgtcaatttagccaacattactcacaatttgaaatatcattaagaaacctagtttaatagtcaagactatgccagtagaataaatagacatgacacaggatggagttgacctctcgagctcagagaatcttctggctcctctgaacagctggccaaggagtaatatttggcagtaaaatacaaccacatgaccaatgtttttggccagatgaaatgagccagatggaagcccatgaagcaaaagccaggagggggcagaagcagacaatataaaataacggattcattttcctttttcttctttttaatataaaaatacctctattttgatgcttttgcttagcatttctttaaaccaacatcaattaggttagaggacagtttagatattatttaacaagtttatattttaactgattactaagccctattctataacaaattacgtggtgttctgtcttcagagaaaaattcagagttaagtagaggaagatagtacatctgttagaacaatacctctcattatggaatttttttccttgtgtgctgataataggatctggtgaggaagctggaggtgggagagggaccaggagtcctggttctaacacagacttccagaattcacacctgtgcaggtttcttaaacttgctctgcctggtttcctcatttgtaagataaaggtaatgctagatccacctcccgaggctgttttggaggatgacatgcatgagctaatgcatgtatgggattgggaatggttcctggtgcatagtaagtgtccaatacaaactagctctactgttcttactttggactttctaaccacatatatgtgtggtctctagtccctgaaccttcaattcttcttctcttatttgatactaattacactcatctttttcacttaccctaaagaattaagtgagatgagctgtggcacactaaaaacaacagctgtcacatctgttacatctgaaaagctttgaaaactaaaaagtgctatgcaacaggaggtattcttggggtatgcagaaagttacatcccagtgtattgattcactggtggcattcacttcctttctaagatgtgggtttgagacagctttttctaatgggaattgtgcagtttggttgggcaatcactgatgtgctaccactcaggttttggtagtagcaaagagtagctatgagaccacactctcctatgatccctgttcatatcagctactatacaatttccagatcaaagttgtagatttggtctttacttcctaataatataggaggtaatttagggatatctagatcttcttgtttgggcaaatattgctttatcttttcatagcccagataccatttgtacttttgtttgttgatctgactgtcattaatccttccttctactgttcagtctatgtcatatcaaataaatttactcattagaccttctacacgaggtacaagcatgcacatatgtatttaattaatcacctgtttggcagctctgctaaaatgctgggaaggaaaagatgttgaaacaattggcaaaaatgagatttggagattttctgagaatttctatcccatgacccctattactataaagggcaagaaaactagaagacactttctgtttctggcctgtggaatgctatggaataatctctgccctacattcaaatgtaccttgagtgactttctcttctatttacatagtacctaccccaaacttgtcacataaaatgttccttttaacatccttgtgatttgttctctttggaagacagaatcatctcaagaagagtaattttctatttaaagtttccttgaacactactgtagttttaagcaataatatattttaaatcacaaaattccctagtgttctcttattggagttgtcagggtccacaggcttgctaaatctttgctccttgattctttctttacttcccagatcgtttttccccatttttttttttttaggtactatgtttaaacaaccaatataaacttctccacattgttttcttgagcacatcattctcctctttcttctctataatacttgggaggggcgttgctctaaagtaattaggtgaatctttaaacatgtgtgccagaacctaggcagataaatcagcaccttgccctcaaaattagtactcatctttgtaagtggtgccctaatgctaacactgatcccattactgaaaacatggttggcaatctcttctgggctcacagagaaaaagtaccttccttattatgtaaccctctgctttctctctttttctcttcctcactcctccttccacggccctgctcccctcctctcccctgcctttccttccctctccctcttcttttctctttcaatccttctttctgcctcaatcaaacttaataagctatatattaatcttttcttataaaaatgtattttacccacataagataaaaaattgtcacagctgaaaaactttcacatctattttgagcattgtaaaactgtttcagattgtatttctcaagagtcaacactcattaaatgtatatgatttgctattactttaacaaatcagacactaattgaatttcatatcttgtacacctggctttcctttagcctgaatattaccaggcagcaaaagccatgccaaggaaaaatattccagttaaagctaagtgtacccccagtagcatgcattattatccattcaatagccaaagaaaaatgacactacaataggcacatttgaagattttacaagataaaaaatattgctcataaaaaaaattataagggagaaattcaatgaagaaatgttgtccaatgtccagttctttcagttgcttcaataatggaatcagatccaaagcctcttaaaggtcaagataagcttaagttactttcaccgcgtaaggattttgtatattttttaaaaaataagaaatgcaaaaacaaggctgtgacattatgagatattttacatgtttacatcaaatagtttaacacctttaattccaagaatgctatgcaataaaactatgctcttcagaagataattatagcatttaactgtgcgtgcatgtgcctgtgtgtggtgtgtatatgtgtctgtatatatatagagtgactcatggtgcatttgaggtattatggtatgataaaaattttaagttatatgatatgtaccttttttcattattgtcagtacattgtcgtggctgaatgcgtaatctcctttggatacatgagggacctgcagaaatgcaagagccagtggccaactgccttcctacctccctaacccttccactcaattcaacttatgatagatatgatcatatcaagttggctatgccaataaaacattatcgggtgatgccaaataagaaagggtaacagaatactttatcaaataggcattactggcatttttgctgtatgtaaggaaacttctaacctcaaagagtttgcagtgcaactggaaagataaactagaacctccaaacagtgaaagcagcacatataaaaaaattaattattctgtgggaaattgtatattcaaattaagaggaagtaaaggaaggactgagcctctcaagcttccgaaggaaactgactcatgatggatatttgagatgtcattctcacctcttaaacttgttacaaatgaaacttgttaaaattacagatgtgaggtattcaaatacatgaaaaagtcattcttagctgctaatgcttatattttggaaagggtcagaacttgaccaaaggaaccttgaaaaaatatatttatcatatagctttaaattgttacaataccataacacctcaaaataaaaatatctttgccaaattgagaaggcaaggtttataatatatttgcaaactacacagaagagcttaaactctgcatttcgtgagatttctcaaattcattagtcaatcaagctattgcttttactttattcagcagctggagatttatgatattaaggagcttgttatcagatctagtgatgaagagagcctagaagccaccatatgttggaaatatgcacagtaatgttagcaaatcattgatgttaagttctaaatgtacaatttagcatacaataagcatgagaatcacatttaacaaaatgcaaagcacataggaagcatataatttaaaattttcaactaaattttatagctgtaacaaacataacaaataaatcattattttattttgaaataaaaataaatggagttaatacctatacctttagctggcaaattatatttacctcttgccaaagtttgcttatgcattgttatacaaaatttttaaatttgatttctctgattttatagttccctaaaaattccaaggacattatcttctttagtgtctaaagcaaataattaatccttataaattattttaattcaaactttgaatgttttatatgcaggcaaatcagaacacattttaattcagtgttaatatatatttctacataggcttggcagcttccagatgtgctgcatttggtctaaataagaaagaccttatatccaaaattttgcaaacaatgtcacttctatttactattgattaaatagatacctttcagtgctatagattgtaatcaatcaaaaacagaaaaggttttctttctaaacaataataaagaataatcaatcttctctttattaacacctagaatactcaaatgaagaaggaaatccaatattttttaagtgttttctttctttccagttatttggttaaaataagctgattttgttgtaaaacagtcattgacagtttagtgaagtcatgaggtcaagatttttaatatgacttccagaaacaaaagattattaaaatatttagtttgaattcatgacatgtaattctgctgggcaagatgaacactgaattactacctgaaacagcattagtttccattttttcatgtgcatgtgccctgaaacacttatgaagaataatgtagtgttttttttgttggtcaaacaagaacccttccctaacatttagagttgactgtattaagccattagacaagttaatacactgtttttcaggtggcagtaatatgaatgctttgttaagtttgccatttaactctcagaattagcttttaaagttagtcaacttccttcaacttctgcacgtacctacatacccctatttcaaggtttacatcatcttcttggctcttatttaatatattgtcaatttaacaagcattaggagttagaaggtcaacatagggcaaaggcttatttgcaaggggcctaaggcagttaaacaattcttcctagctacaaaaggaaaagagtaatacctgtaggactttgagaaacgcaatcttgatttggctcttgtagatggtcctggcaccgtggctcccagaggatcccaaacaaaagccatttttaaggacgatgccaagatccccaggaaccacgagaagtcagagctggtgcggggctctggggccctgaggccccgcacggagcaggaggcacttgtagctgagtgagggcatttcctttgtgcagtggtatgcgctgacagagagatggcaggctggctgaggcagggctggaagggatggccaggacttcctgctgcatgacacttggcctttgcgacagagtttgcttcactcaggccttatctcataattaacgtgagaaacactccctcgaaaatttgtttttaaatatagccctgattaaacagcatagtcacatgccactcctgaaaagcacaacacacacacacgcatgcacacacaacaaaaggtgtgattgaagtgggtaaacctttatatcagtgtgaactttaaaaaatgtaaacccacagggcttcgttaaaaaattttaaaaaatacatgcctatgactgggtcatctgacaaagattactaaatttcacacagctaactgccaactataattttccttatttcaacttctcttaaaaagagatggatataattcttagccaaccttccacaggatgtaaacaggatttactcgtcttgaaaataccagcgcctctctaaaagtcagtgtgagaaaaaaaaacaggcagatcactttcagaacttttggcagctttgccctcaaggagatgctgcgtcaccttagagagtgaattacaatgcatgactctgacaacaaagatcaattatcttgtccattttctattccctagaaacatttcttaactctgataaatctgttaaaacaactttctttcaaattaaataaatgatgaaagccaaatagaatccttcatatattttatgagtccaggacattttgggaaagcatctatttcaagaaattgtacccaaggagtcaaaggaccctagtgccgtcatcggtcctcaccactgagtggtattcaatgttaacaatgcagcataatttcatcagtctgtatccaaacactgccccgcgggtgacctcaactgtaaaccaagggagagcgccacttcttcaggataagattagagaggcttcaagtgcccaagagtgaatttaaccctctctgaactggacaaaattgaccaagagttgagctcagtgaacatcaccatatctgcaaattttgagacctctaaagctcaatctgtctcttgtacaccaagggagtcttgaatattcatataatttcaataaaagctcaagacattaaacattatgcttgttttcacaacagcatccaggacaccaggggttcttaagaatgctacaggtttcatatcagctttggagacgagtaatagaaaaggtttttacagtttcacctctttcttatcagacatgagctcaaagaaagtgggtgagtgagaactgccctgaacagcagcaaccttggaggagcagagagttcaaaaataaacacaacacattctccctgaatcaacttgcaatattgtaacgcttcacaaactgtctttttgcttttgtatagagatccaaatttcgcatgagcaaaacaggtagccactttcctggtgttctcaaagaaggactgaaaaggtgcttacactgatgccaatctgcccttctggtgtatgaaatgccaccattatcatttaattctttcaaactatttaatttccattttcggcagctcttaggaaatgcacacattcctggcagagttagcactgagctgaacaacttggtgcttattagaatgtcttcatctgagactaaagccagacagtgtaagataactggtgatctgcgtaaagaggggaggagtccctaacagctggtggggtgaggtggcttggtgtgaaagggagggggagggaggccacaaagacaagcagaagagtagaagggatgttgctggcaaagatggacttttttcaccctccaggcaacacaaagctctcattttgtccagtggtgtttaaatttttgtaggtgaaacagcatcactgatttctaataaaagctacagtttatgtatacgactttggaagcagaaaaatattttcattgttatcccaattttactgatagcaagataaaccctatctttgtattcaggctaaagccagcagtatacattttcacaaataattaactgcctttgcttacaaatttacctttttaaagggatattcaaatttaatggatatctaattgataagctacaaggacatacgaataatctagaatgaatctgctagggaatgtccaactttttctaaaaatgtgcaaggaaggagaactaatcttgtctttttcattactgtcaaaaacatttcttccttcttttccccctgctttgtaaaggcagtcatctagaacagttaagcaagataaaacaatggaactgtaaatgtgaaattatgaacaagaaaattgaaactctgcttcattttcctagtgtgaaatcagttacagacacaagaagtgtctgtcaatattaatattattttttcttaaataattacttaccgcctccttttcatttcttccacacagttacacataatccttcttaggttaccaggtctcagtaaggtcatagaaataagctacttatttctgagattaatcatgagcaaaattaagccttgatttcaaatagaaatatcaatattgtttttgaagaactggctaatatttcacagacatgagaatttagacatttggaaaaaataagaaattaaataaaatgattttctaggatgaatctttactagcatttataatacaacaagctgtttataatttttacttcatgggtatcaaagagtataaaagaacaaagaagacatcttttgaacattctaattactgtcatttattaagcgtttatttttccagatgaattttagtaaaagcatgattcaatagcaaggagagatgttccatccctgagacaaattattatgtttacaagttgtgcacactaattttatatgtcctagggaaaaccagattcggaaatctaaacattgctccaatccaattgttatccatgtaagtcctaaccccactaaagtatcagcaaagtgcccgtctcctgccaataacttagctcttatgttctgcagagctctaaataaggcatcgtttttgcctcttgaatatttctgggattttggttccaagattccagatgttacaaatggcaaatttgggtttcggtgtctgacacagaaactcagaatttcctttataggagatagctactatgaataaaaatgaaactcccaaatttgagagtgggataagttaaacgtaatccacataggcattcaattacttgcgcatcaagtctctagttaacaggcatacggaagagacgagggttgagctgaacttcagagaaataagcagttacatcagtggggttgcgttaggttgaaagacattgcttcaggaaaccagagcaggcagatagtgggtttcaggatagtgctgtattttgaaatagtctctggttacagactcaaagccagcagaagttaatgtggaagcaaataacagactgttatttaccatctacttctgatgagggtgtcgttgtaattctatcttcagaatgatacattgcaaaagagtgtgacaaaaggcagtttgataacggggcttgtgtactccttaaaactaatatccattcagtacaagtaaatgtaaaaaatgatttttattacattacttatcaaaatcaactataagttatttctcaaaatggaagtgttgcaaaataataccaaaattttctttgaattgctttcaaatattcattctaaaccttatatgagtctacttgattgaaaggtcaattattccatgttctgaaatgggagacaattattttaagacttggcaacagtaaaacattaacagaattgaaggtaccccatggtcttaagaacactgggaaagcatgctctgtgttttaagcttctacaattgcatccattactcatatatgacccaggacacaaacagacacaaactgtaattaaagagctaaaatcaggatatagactaaaacaatcaataagaggcatgcttaaatataatgataaaaaatcaatatgactatgattgtgaatcaaaatgttttactagacacttaaggtttccatctacattaattttaggattttttttagcaatttggaaaacaactaagtcaagcttttctattcactaaactaacaaagctccttctaaagctttgttggataaagcctacttggataaatgggattgaaggaaagaaatcatggaggaagaaatggaaggaaaagaaaataaattttatgtttattgaatatctactaaatgactgacaagttcctaagagatttttctaactattcaaaaaatatttctagactcaaattctttaaaaatcttgaaatcaatgtagactaatcatttgaaataaataatttgacacaattttctaacaagtgtgtaaaagtcttctggtgtcactgattgtcttgttcaattctctgtatatgaagattttaaaagtcataaaaattctttctatttaatattctactcatgaatacagtcttaaataaaaatcctacttagctattgactggtgagtgaaggagtggtggatataggattacatcttgaaattcacttcctccggaagtcttccctgcctccccataccaggtgaggtctccactgcactttgtacttcctctttgtcaatgtcatcacattagtaatgacttatttggtatctggctcccctgatagacctaaacactatgagaacatggataacatctgctttccctctgggtactcagtgcttagcaaacagtctagagacataaaaaccacaattatgtttgtttaataaatggacaaaccaatattttcagggcatcttaaaaataagatggagcatttacattatattcttatatgtgcctaaataggggcagaaatttcagaacaggtaatttaggtagggcttatttagtttctttttcctatttgattgattaattaatttttttaatcaaaataccattgggcaagttttcagggcagcactgtataggggattagagattagagtcacagttatgccatgaacttgccatgtgaccttgaagattgttgcctgaccttgctgagtttcagtgtcttacccatttggttctcatttgagagccattgcaaagagttttggagagggctgaataaggcaatttatataaaaacattctgaaaactggacaaaattttaggcacacactactgatgtttgtaagcttttgggagaggtaggaaaactatttttatactgttagaaacatctttaagttctaaaaattgccaattggttacttcatgagcatggtaaataggcataccactttatcagtttcaaaaagaatatcagtcctcagttttgatagataacacttttctctatttgaaatctttatatcccatgtgtgtaagaataaaatattagctgttatatcttgaaggttaatcatatgaagaaatgttaatgttttatttgcagcattaaaaccctctaagaactttgtttacaagatctaaaaaaaattaggtggcaagaaattttacaaaaattaggtgatagaatttctcgattgctcaaaaccctaagcttctcctaaatatagaaatgtttctacttattttttgaaaacttatgggatcctagagacaggttgtttaattgggaaaccagttgcaacactgactccaactcatgctacccttattgttggccacgtaccaaataaggacagaaatggcttcttacaactttttagaattatgcttacaaataagcaaaagcagtgatgaaattgctaggctgagaaacaaaatcactcccttgggagaaagaaaaaagacccccaataccaagaatccctaaataaaaatctcatgtgctaaattttggtgctgtggattttttccgtgactgttcaatatcttgctaaatctggttatccatttgttggagccaacagtcataaactttcccattcctgagtacctgtcatcctcagaccccttccttacttggacacttcctgtgcactgaatgagtttgtgaaccaaacatcaccataatgtcgggttaacttttctaattcctcattttactatgatgatatcaaccacttatttggtgtttattctgtggtgtttattgaccttgctgagttataatgtcttatccatttggttctcatttgagagagagccattgcaaagagcttttgagaggactgaatagggtaactaacatgaaagtgttctgaagactctgcacagaattttagggtatactatatattatcctcataataatttatctgtgtgctttgtgttatttttattctgtatcaccactgaggaaacgaagacttacgaagttgaagtaacttgcccctatgatcatacagccaatgagtagcagatctgaggttaaaattgaggtccctcttaattgcaaaatgtatatcttaaccaatacatgcctggaatataagtaaatacaggaatgaaaaaggtcaggtcaccttccttgaagaattaaatcataagagaagttttgaactttcacaggaaaaacaattggtgtcaggtataagatctacatgttacttaatcttccaactcacgagcagacattattatcaccactttatagatgagaaatctgagactcatagaggttaaggaacttggctaacaccacagaggtaatatatgacagacatgtgagtccaagtcagttttgcttatctctaaatcttgtctccattgtggctggcttacctgagatctttcaattcctaattccaggacaaaattggcctgtgagcctggggtgggactgaggctgcaagtaggggctgagtgggttcaactgtggtaactagagagagaggaggcctagagtatagttcagcttgaggaaaagtgatcctgtcaatgtttgtatgcattgtgcactgccctgcactttccctctgaatattctacataggagaaaaatcacaacacttttcagtccatccaaccaaaggtaacaatgtgctaggggctacaatagaaatccagatgtttgagtaacagcaaaagaaaacagcttattgttgttatttgtttttgttttgtaacagaatatataaaacttagggtgccatttactagctatctctcagaaccagctaagaaatttataacagacatttacacaattaggctattattaataagacaattggactggttctggtttttgctttcagtgttaccactaattttatttctactggttcagtggagttaagtgaccttcccaagtttggaaagtgctaaataatggggccttgatgaaaactttagcttacctctaaattttagagaataagccatttttatattagagatttttaattaaacttactaccttaaaaatgtagaagtaaatttgagaacacacaattgttatttcattggtcagatgatatccagtaaaatcatttatccagcaaaattctgagttaaatttgacgtgtttttgtttgatatatatgctataggtgagtcttaagggattgaatttatatttgaaaataaaacaaactttggtcaaagaaacaaaattataactatgggcttttaggtctcaccaggcactggatggtgaaatgcatgaggcagcaagtatttttctaaatattctataagtgaccctaacaaaaacacacaaagctttgaaataaacagagctaaaagatatagactagtaagctactttctatatggaattttgttcaacagctaatcaaaccaaccagcctcccttcctttttttcttcctccctctctcttgcccacccacctaccttccttccttccttcctacctaccttccttccttccttccctcctttcttccttccttctactcacaaatgcatgtttagcatcacctcacatgtcccaggctatgccagctgcctgctagtagtcaatggtgaaaacaattcatgcccaaagagaacttagggctgaatgaaccaaaaactgaaactcaagggtaatacaaaatttgactgggcttaggtttatttaaagtatcagggcaataagaagagaaggaatataaaatatttatagaaataaaaaataacatgagctcttatttaagaaaaaatgtatataattaagaagaaggtagccaggtatgaagctcatgcctgtaatcccagcactttgggaggccaaggcggacagatctcttgagcccaggagttggagaccagcctgggaaacatggctagatcccatctctacaaaaaagagaaaagttagccaggcatggtggtgcatgcctggggtcctagctacttgggaggccgaggtgggagaatcacctgaacctgggaatcgaggctgcagtgagttgtgagtgtgccactgaactccagcactccagcctggctgacagagtaagaccctatctctaaaaacaaacaaacaaacaaaaacaagaagatgatttttcagatcatcaacattaaaaacatatcaaatgagttatttttggtgaaacgccagtttgtaacactggcctgggggaaatatttgggctcaaccagtcaattctttctattctgttaaagtggaaagagcacaggagagatacatttgtacagaagtttctatttcagcccagtgtgggtctaaataagggctccgtggctgggggtacagagatgggtcctggtgcctccttacaaaacttgcaaaccagcaagaatcttacctcggaaaaatatctctgtgatctgtggcagtaagctttttctcaataaaacatatcagtagtgctcacacattaaaactgacaaacggtccctttgaatccttcttatacacataaagaaaaaaataagcatgccttagtagggcaatcagtcctggaatagtccagaatgagctgaattagggatgtctaaaatataaacttgatagagcatataagatctgtttcagtagaatatggttcttgccatgtcaaaaagaggctttttccccccaagatggtattatgaacattttcaaaaatacagaaaaattgaaacaagtttacagtgaacacctgtgtatctactgtttagattccaacagtgacatttaagaaactgcttcttaacaggtgattatcatattaggtgagcaattattcaggtaagactcatctgaatactatttaggattgtgcctatgtttaacctaagttataagtctctatgttttcttctggagtctattttgaagggtggactttgtacaggaaagacaatttgtttttttctatgtcatataaagcacaaaataaatctgaatttctaaatcttactaacaaaaataaattcaggataaaaagtaaatctaaagatatgctcaagattatgagttatccaaatcaatacccatttaattgataaaagctatcaaccatgaagttttattccaggttagtcctaggtaatatgtttttgggattctctgaaataagaaaattgttggtaagttatgagtcagtcaagcacttgggaatgagataattgggagctttccacagttactgatattgtacaaactaaactataatatttataaatcaagagatgttttaataggtgagttgtttttgggttttctgtgggttttattattttgttttcttttgatatattttaaatgaacattatataaatgttaggccttgtttgtcatgaacaagacattgtacttttctataaatgaaaaaaattcaacttcaataactctatttttaatcaattatttctgatgtgcctagtgtaaaagtcagcttgctaacttctcagcaatttgaaatgcaggtcaaggtcagatgacattacaagagtgacagagaaaacctaattttagtctccatgaaactgaagaactcaacacaaatgattactgaacactcagcccatgtttggagttgtacgcttacaaaggcatcctatcaggaaggagcaagtactgcagaatcgtggaagaagctagtgtgttctcaggtgctccaagagctgtggaaaatctcagattcagactatcgactcctcaagtacattcaaagaacgtgtatttgcaactctagtataaactcattacagcagaagttctgagaaaatagccaatacagctataagtagcagaaagtggcattttccaaaaaagttaatgttaatactttgtttaaaagcatattataaaattgtcaatactaagtagaatctaattactcctgaaaagcatttctcatttaaaaatctattcattaaaatatgcaccaaaatgttgatcaagttatttctgggtaatagaatgatagatgtttttaaattttattttccataatgtttatattttctacaataaataaagatgacttttataatcagaataaatgaaatacatgttattaaaaaactagagtagtcaagtttctttttttcccaccaggaattttaggtttttagttgattagacttcaaacaaaggtcaagagtaaagacttttgaatcatattaaattaaagatgtctcatagatattttacacattggtgagatgtaaagtagtgagagagaagtcctgagaagccagataggcatacacatcatttaacacctatgatggtattatttaaaatcaaatcattaatagaatcagcatgatgcagtttgcagaagcataactagagaagacaagaagtctgccttacagagcctaagaagaggcatggcaaggaaaaagcaagagagagagaaagaagcagagctcttagtagatgtaaagaaatccacttcgtgccagtttgcaaggaaattttcctttatgaagagcagagcacttaatagatgtaaagaaatccacttcgtgccagtctgcaaggcaattttccttcacgaggagctagctgtttgcacagcgccctcttgtgaagagaggttttcgtgactgtaccttcaccccaagagccaaaaacttcaagtatccttccagagcaattgcttagctttcatcagctgaggattaacttccaaggctttttgaggatgcatgtatgggtatgagtaacacacagacttgacatccgaattctctattattaaatgtgcacataaatattccacagagttgtgcttcttaatgataatactttaaaaagaacttcctaaaataggaaattagcatctatgtttgttcccatgacttgtgaaacttgctcttttgctctgatgaatgctgtttctccattcggtaaatgaaaattgaaaaattgaaaattggggactacattaaaaatcaaaaattgtccattcatcttaaaaatatggagacatttatttataaaacgttagtatgcttatgagtgccatttgaaaatgcattaggcacctgaaatttcatatgatagtcactgacaaaaatattgccatttgagtaatataagaattagagacatttggtgtgcttgatttagcacgttaattagaataaaaatctttattcatgtaaatgattccactgatttgcaattatctggataactgctcagcaggaaaaaccaaattttggatacttcttgcaaaaaagtaaattactgtggaatatgatacaatgtatgcaggaagagttgtgctttatgtgatattctgactcaaaacaggagagaaaatgatttcttctcacattcagttgaacaattgattgggaagtgattacaaacttcactttgcctgtcagtgtctgtgctatgtatttattgaggagctcattcattgctactcactttcctaaccaaaccatcatgaaaaacatgcttagaaccctgagctaggtaaaatgagaatgtgtggcttagcacaaatcataattaaaaagcaatggcaacaccaaaggatgggttggggtgcccctccataaccgctacaaggttttccaaacccaccacaaataaatatgtgtcaaacataaaaacgatgtgctttctatgtaaatgcaaattcaagacaagtccccaagatcccttagcttccaatcaaattgtcatcacttctcaatctactactatctagaaattctactgtggcctttgctgaaagttcagagcattcattgatgagtatcattgtattcatgtggaagagatgacatgaggcagacaaggacggtaacaagtctgtgtaggaatctacacatatctagtgcttgtgcaatgggcttttgaataggcttgtgaaaaagactaacgcctcccaactgtatctccatccctgacattttgcctggttttcagaatagtatatcaatctccttcttggagattgacatatgggtatttaatagtcttaggtttaattccttccagggagactgcaaaatattggagtgcgtagtttatttggagaagaggcaggaaggcgattctaggaaatcaaagttaggtgatggagaagtgggatagcaaaggaagaaaagttaatacagtgtgtattaataagcaggggcagatggggcccaatctccccagggaccttttgtgggaccatatatacacatgcctcaggactgtcccactggagaatgtggaacctggggtatatgagcaccaactctggaccctcaatgttggagtgttgccactgggaatgttaaaaaattctgtaaacggtctcagcaggctcctttgtactgcagaaagcccccaggtgcctgagatgggaaactgactgagtctgccatagcctcaggtgaactctatagtgggtggagggaaatggggcagcactccaagcattttccacaaacaggactatcaaactcaaaatgctcaaacagaaccaccccaccactaaacctactcctcccttgaactcctcaagctcaataaataaaaacacacatttccaatttgttcaggccaaaaacccttgaattatctttgactcatctctttttctctcactctatgtaaaaatccgtcatcaaacacaattagctctggtttcaaaacattgccagaatctgatcacttctcgccatctccactgccatcacccgggtccaagtcactactgtctccttccaaggctattgcagtggcgtcataaccattttccctgcttctactcttgctcctactctattcttcacagagcacccagagtgatcctttgaaaatgtatgccatttctctgctcaaaaccctttactagtttccctctccatttgggataaaatccaaactcttttccatggttttcaaaagccctctcctctctttatggcctccttttctattctctttcttgcttactcagttcccacaatactcaacttcttcctgttccttaaacacaatgtgcctcctcctaaggagctttgcacttgctatttctttttcttgaaacactcttcctttggaaaaatgcataattcactcattttgttaagatttaaatgtcagtttaacagacagggatacctattctgactttttaatctaaaatcacactcgtattactatttctttactctgcactaatttttttcatagaactaaccatcacgacacacattttgaatgtgtttatgtatttcatatattttgtactatcctccccacaaaaaattaaattctttcagaggagagacatgttgattcactgctgtttggccaacaactagaatagggccagatagtggtaatggttcaatatatatttgctaagtgaattaattcactgttctgagagccatatgagataaatattgatacttattaaacacttaaacgttatgattgatattggcctataaaaagtgtaagcagcctctgctcaccagaagtatgaatatccaaggtgtagtgaaattatcagagtttagacctgtaagcttgtccaacccgtggcttgtgggctacatggcccaggatggctttgaatgtggcccaacacaaattcataaactatcttaaaacatcatgagactttttgttttgtttttgctcatcagctatcatattggtgtattttatatggggcccaagacaattcttccaatgtggcccagggaagccaaaagattgaatactcctgggagggtatattactgtattatgaacaatgatagttaggaaaagaaaggaaagaaaggttgagactggactgtgaaggaacttgaatgatacgttaggagtgggacctttgttccatttagaagtgaaaacttaccaagtttctctgaacaagggagtgaaataataaaagcagaattaatttcagaacaattgatattttgattctacttgcaaggacttgagcaggaaagattagaggcagagagacaatgtcgtgaactttcccccactcgaatcctcctttttcccagtattcaagacactggcatatgtactggcatatatgtactatttgcatcttttaaacttagtttgaagactactgtatcatcaaatatttttcatactcagttaaggtggtttttgatcttactgcgatgttaaactaccacactttgtttagctgaaaaaaaggtctgtccatggtttctctggattggaagtgaacctactatagatatgaaaagctcatattcattcttcttcaggttacctaaaaactaataactaaagtattagaaaaagataagtttcggtatgaatatactataggttatctggtgagacacagttatgagtcaacgggaataaacacgtcaaaggcatctgtagtgcttagcaaagtttctttacatctctaatttgtttcttacccagggcaaaatgcaaactgcagtcttcttttctctaaaggagtattgtaaagaaaaagagtggtatatgctcatgttctactggactctgaacctcctggggctgtataaccctgggactgcccagcacagtaggagtgaaataaatgtatgttaaatgaatccatcaaacctcttagaagacagactccagggaaatttcattattttgttctaaattatgctttccctcatgtaatgaatatttaattctgttttgttccagaaaggactcaaggcttctctatttcctttagtaattagcttaaataagccaagtcatccatttctctacctacccaatggacaacagaagaagcttacgtgtctcatagctttatctgtaccttgatatgtttgagaatatttcatatacataaaccagcaatgatcatttgaggaaataaaccagtaaactttacaagcaattgtaatttgaggatataaactttaaactctagaatgttggacacatctttgaaaataattccaaataactaattgaatctattagtttatgttacaagccaatttggttcaaagttttaaaatgaagaaaaaaattgtataaattgaagttttaagcatagtttaatgaaatcagctagtctaaattcaatattttcactcagttcatcaaattatttgaaaagtaaacacgtgggctgtacagagaacagtgaatcctcccctaccctgagctatcactcctgcttgtggggcacagagaaggcattcagacctgtgcctgccaccaccctacccccagccaacaccacctccagtgtgactgtgcacacaggctccagcaagggcctcctgcccacctctgtaagctgcattgcctctgccactctggtgaacatctgcaaggaggcaggcacccccacacccactagcacttcactgcagctgtcccatctcagcacccctagctgagtggattccaaaacttgaagaatgagaagacaaagtttgggcctcatacaagtcccccagagttagtgcacacagtccagaagttgggagctgagtgttggacccctaaaatcttccagaaatgaagccaatcagctgaatccacctaataccacaatcaaaccctcaaggtcatcaaataggataaaaggaaaaaaaaaacattcaaatgtcagcaacctcaaacattaaaggtagaaaagtccacaaagatgagaaagaatcagcacaagaaccctgaaaactcaaaaggccagagtgccttttttcctccaaacaaccgtgtcccttctaaagcaagcttctaaaccaggctgagatggctgaaatgacagaaatagaattcaaaatatggattggaatgaagatcattgaagtacaggagtatgttgaaacccaacggaaggaagctaaaaatcatgataaaacaatgcaggaactgacagacaaacagccagtatagacaagaatgtcaccaacctgatagaactgaaaacattattagaatttcataatgtaattacaagtactaataacagaacagcctaagtggaggaaaaaatctcagaaatctcagagcttgaaaactggctttctaaaataagacagtcagacaagaatagagaaaacagaatgaaaaggaatgaacaaaaccgagaaatatgagattatgtaaagagactgaatctacgactcattggtgtccctgaaatacatgaggagaatgaagccaacttggaaaacatatttcagagtgttatccatgagaacttccctaacctagttagagaggccaacatttaaattcaggaaatgcagaaactcctggtaaggtacttcacaagaaggtcatccccaagacacacaatcattagattctccaaggttgaaatcaaagaaaacatgttaaaggcagctagaaaggtaaggtcacctacaaaaggaagcccatcagactaactgtggacctctcagcagaaactctacaagccagaaaagattgagggccaatattcacaattcttaaaaagaaattccaaccaacaatttcatatctggccaaactaagcatcataagtgaaggggaaataatatcctgttcagacaagcaaatactgagggaatttgttaccaccagacatgccttacaagaactcctgaaagaaacactaaatatagaaaggaaagaccattaccagacactacaaaaacacactgaagtgtacagaccaatgactctataaaacaaccatataaacaagtctgcaaaataaccagctaacatcatgatgacagaatcaaattcacacataacaatattaaccttaaatgtaaatggactaaatgcctcaattaaaagacacagagtggcaagctggataaagaatcgagactcactggtatgctgtcttcaagagacccatctcacatgcaatgatacacataggctcaaaataaagggatggaggaaaatctaccaagcaaatgaaaaacagaaaaaagcaggggttgcaatcctagtttctgacaaaaaagactttaaaccaacaaagataaaaaagacaaagaagggcattacatcatggtaaagggttcaattcaacaagaagatctaattatcctaaatatatacacacccaacagagagaaacactcagattcataaagcaagttcttagagacctccaaagagacctagactcccacacaataatagcaggagactttaacatatcactgaaaatattagatatatcatcaagacaggaaattaagatattcaggacttgaacttagcactggaacaaatggatctgatagatatctacagaagtctccaccccaaaacaacagaatatacattcttctcattgccacatgccacatactctaaaattgatcacataatcagaagtaaaacactactcagcaaatgcaaaagaactgaaataataatgaacaatctctcagaccagagtgcaatcaaattagaagctaaggctaagaaattcactcaaaaccatgcaattacatggaaattgaatgccttttctcctgaaatcctgaatgccttttgggtaaataatgaaataaaagcagaaatcaataaggtttttgaaacaaatgagaacaaagatacaacataccagaacctctggaaaatagctaaggcagtgttaggacagacatttatagcatgaaatgcccaaatcaaaaagttagaaagatctcaagtcaacagcctaacatcacaactaaaagaactagagaaccaagagcaaataaattccaaagccagcagatgacaagaaataaccaaaatcagagctgaactgaagaatattgagacacagaaaaccattcaaaagatcagtgaatccaggagttgttctttttttgaaaaaattaataaactacatagaccaccagctagattaataaagaagaaaagagagaagattcaaataaacacaatcagaaatgataagggggatattaccactgaccccacagaaatacaaacaaccatcagagagtattatgaacacctttatgcacataaactagaaaaactagaagaaatggataaattcctggacatacatactctcccaagactgaatcaggaagaagctgaatccctgaatggactaataaaaagcactgaaattgagtcagtaataaatagcctaccaaccaaaaaaaccccaggaccagactgattcacagctgaattctaccagatgtacaaagaagagatggtaccattcctgctgaaactattccccaaaactgagaaggatggactcctccctaactcattctacaaggccagcatcttcctgagacaaatacctggtagaaatataacaaaaatttaaaactcagaccaatattcttgatgaacattgatgcaagaatcctccataaaatactggcaaaccaaatccagtatcacatcaaaaagcttatccaccacaatcaagtaggcttcatccttgagatgcaaggttggttcaacatatgcaaatcaataaatgtgattcatcacataaacagaactaaagacaaaaaacacatgattatctcaaaagatgtggaaaatgcctttgataaaattcaagatcgcttcatgttaaaaactctcaataaactaggtattgaaggaacagccctcaaaaaataagagccatcaatgatatacccacagtcaacatcatactgaatgggcagaagctggaagtattaccattgaaaatgggcacaagacaaggatgccctctctcgcctttcctattcaacattttggaagtcctggctagggcagttagataagagaaagaaataaagcacattcaaacaggaagagaggaagtcaaactatcccagtttgcagattacacgatcctatatctagaaaaccacataatctcagcccaaaagcttcttaaactgataaacaacttcagcaaagtttcaggatatgaaattaatgtgcaaaaataactagcattcctacacaccaacaatagtcaagctgagagccaaatcaggaatgcaatcccattcacaatcaccacaaaaagaataaaatacctaggaatacagataaccagggaggtgaaaaatctctacaaggagaactacataacactgctcaaacaaatgagagacgacacaaaaaaatagaaaaacattccatgatcatggacagaaagaatccatattgttaaaatggccatactgcctgaagcaatttatagattcagtgctatttttaataaattaccactgagattcttcacagaactagaaaaaactattttaaaattcatatggaaccaaaaaagagcccgaatagctaaggcaatcctcagcaaaaagaacaaagctagaggcatcatgccacccaacttcaaactatactacagggccacagtaaccaaaacggcatggtactggtacaaaaacagacacatagacaaatggaacaggatagagaacctaggaataagaccatatacctacaactatctgatctgtgacaaacctaacaaaaacaagcattggagaaaagattccctattcaataaatgatgctgagatagctggctaactatatgcagaagattggaccccttctttataccatatacaaaacttaactcaagatgtattaaatagttaaatgtaaaacccaaagctataaaaatcccagaagacaacctaggcaataccatcttggacacaggaacaggtgaagatgtcctgacaggccaggtgtggtggctcacacctgtaatcccagcactttgggaggctgaggcaggcagatcacgaggtcaggagatcgagaccatcatggctaacacagtgaaaccctgtctctactaaaaatacaaaaaatcagctgggcgtggtggcgggcgcctgtagtcccagctactcaggagactgaggtaggagaacggcgtgaacccaggaggaggaggttgcagtgagctgagatcatgccactgcactccagcctgggtgacagagtgagacacccatctcaaaaaaaaaaaaaaaatatgtcatgacaaagacaccaaaaccaattgcaacaaaggcaaaaattgacaaatgagatctaattaaactaaagagctcttgcacaggaaaggaagctgtcaacagagtgagcctataaaatgggagaaaatttttgcaaactattcaacaaaggtctaatatctagcatctataaggaacttaaacaaatttacaagaaaaaacaaccccattaaaaagtgggcaaaggacatgaacaggcacttttcaaaagacatacatgcagccaacaatcatatgaaaaagtcttcaacatcactcatcattagagaaatgcaaatcaaaaccacaatgaaataccatctcacaccagtcagaatggctagtattaaaaagtcaacttatacactgttggtgggagtgtaaattagttcaacaattgtagaagacagtgtggcaattcctcaaagacctaaaaaagaaataccatttgacccagcaatcccattactgggtgtatacccaaaggaatagaaattattctattataatgacacaggcatgtgtatgatcattgcagcactattcacaatagcaaagacatagaattaacctaaacgcccatcaatgatagactggataaaaaaaaatgtggtgcatacacaccatggaatactctgcagccataaaaaagaatgagatcatgtcctttgcaggaacatggatacagctggaggccattatctttagcaaactaatgcaagaacagaaaaccaaataccatatgttctcacttattagtgggagctaattgatgtgaacacatggacacaaagaggggaacaacacacactagggcctaccagagggtagaaggtgggaggagggagaggatcaggaaaactaataggtagtaggcttaatacttgggtgacaaaataatgtgtacaagaagcccctgtgacccaagtttacctatataacaaacctgcacatgtacccctgaacttaaaagttaaaaaaaagaattcagaagaagaaaatgaaagaaaagtaaacccgagtgtatagtcctccatctcctaggttctaaggattaaaagctccaagaaaagtgttagaaaaatacatagtgaattaagaaaaaattattccttatagttccaacgttgtgtctttgcttatactatgttcacccttttaggtatgtttgtacaaaatgaaaaaggaataaaaaccaacattttagaggataattcatgctactcaaaacaatcacgaggaaaagctgggctgaaactagtgacaagcttttgcattgtgccacattgctgtcacatttttgcccatattatttatgagatttcttcaaaatttttataccaggtcattcttaaggaattctttgctcaggaaaaagtccaagttagcatccttcagacccctgctgtctctccagctcctctccacacacatccatttatagggaaaggcaagggcagaaagcagatttagaagagaaaaaggatagaggagcatgagtgtgtgtgtccacgtgtgtgtgtttgtgtgtgtgtgtgtgtgtgtgtgatgtgtcctgctttaccacagtccagggagcttacagggaagtccatgttcaatatcagcactgcaggcctctccagcaggcccttgttccttcctggtcttcactgcctagtgcacggcaactaagccacaacacccaaacctgagacaaatcatcccatcccagggctaaaaaagtgactctaatgatgtgtctgcgtaacaatcaataattcatttaaattgattgcctgatacataaataatttccttataaccttctgacttttagcaccactgatctaagaatcacacctaaaaaagtgctgtcagaatgcaaaaatagttttctgtttgaataatacttattttttatgaccatatgaatgatgaatattcatgatagaaatttggaaaattcagaaaattaaatttttttaaaaatcatctataccgagaggcaacttgtaaatctggctcattttctttatttttatatgtatatacatatatttacgcatctaattttaacattcaattgagatttgatgtacataatttttggattctgctttgcattcatggtttactataagccattttctctatcacttaatgtcatttgaaaatatatttaatggttgacaagattctattggctgggtctaatatgaaaatttatttaaacattagttcatgtgaaatacatagaatatacctaggttctcaatattataggtatttttacggtgaatatctttgaatataaatattttaatatcccaaattacttccacaatccaaatatctacaagcagaattactaaattaagaggtaggattttaaaaatatcaatgtttattttagatttaggggctacatgtacaggtttgttacatgagtatattgcgtgatgctgaggtttggggcagtgctgatcccatcacccaggtggtcagcattgtacccagtaggtagagtttcctcccttattcccctttcccctcctggcttttggaatcctcagtgtctactgttaccatctttgtgtccatgtgttaaagggtaggagtaattttgaggcttcaagcttctgctgatttttaagcatttttctgaaataaaactttcaaattagttcataaatcaatgtaacagatgacatctgtcaatatacattattatatgcataaatcatatgcataaataacatgcattattttattatgattttataaaagattgacacaacataattcaaaataacttatttactacaaataggactcaccacatgaaaattagaatctaaagcaattaaaaaaactattaggaaatgaaaaaaaatcccatcatataaatcctcaattttggccatattttatgaaagggccaaaagcaatcaaaaaaaaaaaaaaaaaagagagagaaagaagtgagaaagaagtaggaaaaaaagaagaaagacatgtggctattattacagcaacatgaaggtggtcaaccacttcaagtttttgtggtcagtgaggtcacaagagctacaggctgacatttcaaacaaattatgcacattgaggtcacatcgctctacttcaggcagtttctcataattgtagtgttctgtttacaagaggtccttgacttaaaaatgtccttttgtgccctctagtgtttaaattcatcaaagcttttgagaagttcatatcttgtttctgaactccagttgaacaacatttcattcttagaccaagtgtttatctgtatctgaagggggccaacatacatcttgttccaaaatctctaaagtttacttaattttttttttatttcaaagggagctaggtaggggttggaaaactaccacagagcaaatcctgcccactactttttttcattttgtaaataaagtttattggaacatattatgctcattcattacagattgtctacagataactgcatttgctctgcaacagcagagttgagtagttactacagagttcttgtggccccaaaaggctaaaatatttactatctggcttgtcacagaaaaagtttgctgaccctggagctagagctctgataattagattggatgccatgacattttacaatgccctttaattccactccctttccatcaacccccggaatactagttaaaacaaagaccattgtaggccagtccattagctttgtggtccaggtacaaactttgcagttttagtgaaaccatttgttaatttttatttttctaatatttacttagcttgataatatcaactccgttctgatgacttcgatattaatatgattatattggagagaatataatgagatcaaatcgctttacccatcaagaccaggaactgaagaacttcttcctcctttgctacctcatctcttagctagaacttaggtgagtagattagtatcctcattcctctttatttttatataattaataataatatttgcaattattttgagaaacatatatctttttttgaataaagtaaacataccgtttataattaatatggaatttagtttaagttcatgcttgatttaaatctcacacaatcacctcttttatatactaatgaaagcacggtgcacaataataaagccgtggtcctatgtggtcaacttacaggctaccttctttcctcagtgcaaatatcacgtctttctaagtccctctaatattttatcctctcttttgtgtatctagaagctttactgaaacttcctactccttatctgaaatagttgacatatagttaataagagcttttttccaggaagtggatctattttattgctttctaacttaacatgtttcagaatagttacagccattttttttattcaaaggtacatgtcagcaatagtctggccagaaattttgcacaataataggagaaaacaaaaaactaggggcttagaaaagtgaatgaaaacagttttcagttgattattttgttcctgaaaaggcatcttttcctcatgacatgcattcatggccattgtagattacatgcctggagctgcccttctcagcctttcaacctctcattacatgcatattctttcctctgttctttacagtcccccatttccctgacacagaccccgcactacaatcctcttccttatacttgacacagaaataatttaaacacaaacccaaatacaaacactgcatagatttaccatatggaatcacatatgtaaaatttctgaatcaaataacgcaaacccacaatgttactttccaaatatatacaacaacaacaaccgaatgggtggtgaaacatattacttatgaaaggtgctcaatgttaaaagcaattaaaataaaattcagaaaaaagtgataccatacctctattccacaagcaaaaaaaatttccaaacttacctgcaaaagaaaagaacaataaatctcaaatcagaggatattttatttttttctagtaaatttggcaaaattgtcatcataaatatagttatttcttaattatcactgtgtatatcactctctgtaaataatgcttattggttcttatagataccaacagggctggcagtgacattctctaaaggccaattctcatagtccatagggtcattttccatatgtaatctgcttcataagaaagtttttagaacaaaaacttaaacaattccctggacccaggaaatctgcattacaagacatttttgggggtgctaaatccaaacaatgaaaaaagaaaaggttttggggtcagactgacctggactgaaatcctagttctactgtagcctggtaactcaagccattttatgtctgttgagcctcagtattttcgcctataaaatggggacattatatttatgtaattcaattattctaagcattgaagtcattttgtggcatgctgtagacactcaaaaaatattgccttcacaccatcctgtaagctttattttatgccaatactttgctgaaacataaatgcttagtgcggtatctaaagcatggaagagctttaagcaattaataatggatagaaaagtaacaagttttacatttccatcttcatagtgtgaccaagttggtttacatgaaatattaatcatcttctagatgctgggcaatttatttcccggtgtaaattcaagtgtttcactcagagttcaatcaattaactgagagtatggcagtctttagcacggtctctacatcccatatattcacatgatgccccctattatgtccccattcacgatctcacttatgtcccctcactgcagcctcactagccttccagccattcctggaaaaatcgcaagcctgctccagtctcaggatatttgcattccctgcccatttgcccacgaatctatccccactccccttcaatccttgcctcaaagggccctttctaacctgatttccctattgcaaattctaaccatattctcagcctctgtattgaactcccctgctattgcactatttgttccctagcactgagagccttctaagacgctacacaatgtatttatttactatgcttactgagtctctctgtccctaccactccatataagctacacagaaataggggtgtctgttttgttcactattgaatacccagaacctggaacaatgcctggtaaatagaagctattcaaaaaacatttgtttaaggactcaataatacacatatgaaaaaaccaaatataaaaatataaattatacatatataatccatatgtatatttgtttatatacatattttgcttatatacctacatatttatcacacaaatatttacatgctgattatccataggaatttttaatttttaattaaatttttagctagaagtaaaccatttttgtttttgtttttgtatttgttttgagatagggtctccctctgtcacccaaactgaagagcgagtggtgcaaacacggctcactgcagtctcaacttcctggactcaagcaatcctcctgcctcagctttccaagtagctgagactacaggcccatgccaccacacctggctatttttttatttttttagttttttttattttttgaggagacggtgtcttgccaagttacccaggctggtcatgaactcctggactcgagcaatcctcccacctgggcctcccaaagtgctaggattataggcgtgagccactgcgccaagccctattttatttttacttaacaattattatgagagaaattgaggcaaccattagcgatactggctctctctttgtagctctccaccctcaggacacatgtagatgcacttaataaccctcttgtagttgaatggagccacgtgactaattctggccaatcagcagccaagcgttgattcgctggtgtgagactctccatctcttcccctttctccttctgccagaaggatcaacaaagtccatgatggtaactctgtcagtttctgtaccagagtgaggaggctgtgcagcagagctccctgtcgatgatatgtagtatgggaaacaacaatcactatcatctttgttgttacaagatttagaggttgtcagggcaatttaactcacccatcaggataaatagagaaattatgcacatataattttaaaattatactgaaaaccttattcaaaaaacagtctgcaaaactatactatatatattcattgtgaatgctctttctcaagtcattttgtttctgctggtaattaactctataattctaagtaatatgcttatactgggtttttttttcttgattttcatttttttagccattatctattcatttcttatcataataaacatttaattatcttatactgatctccagttcccttttttcacctagttacatcacaatttttagttaaattaacaatcactgtttacatatttttactatatataaatcttatttactatgtatgtaatatatacatatttgctttacggctcaacttctgttttgctagtagttaataattgctttggttcttttccaaatggtactcatatctgccacccctctcagatgctctagcaaattggataatctatcaatttcattttctcttttcagcctcctcctcaacaccttgtactcttgcttcaatctgtacttctcagctagttgctttctaggcccgctagaaatctgacatcctaagcattctttctgttatttcccgtgttgattattggatctcatgatttcctttttgatagcttcctgctttttgtgggtcacattttatagaagctcaagtggcaaatgaagtgaatagtattaatattttacattttttggatcttgcatcactaaagatggctttattctgtctttacactagttcatagtttgacttgctaaaggagtctatgttgaaatgtaaattccttcaaaatattgaagccattactctattgtactccagcatctatttttttaagtaatttatcattaatctgattactttcattttaggtagagggtggggtaggaggcaaggtttcagcattcatgatgctgactcttctggatgttgaaatgcactgcccagaatcccctcagcatgtgtttctccagtagagggtatactgctcttgcccaagattatacccatttatacagagcagtctgcagacaatggctatttgataaacgggaaggagatagtatagagtcctaaccccttcctctaagttttagaaaccccaactgaaccagaagaggcctccattgagcctttaaccctgttcctactcttcttcctgtggtgctcacactgagaacatttccccacaaacaccctgcatcccaatctctatctatctcggagtatctcagggaaccagatctgcaccacagacattcccttcattccttgtttcagccccacacctcatccctgcagggtgctacatcttctctctcagagtcctgaccctttctgagaacatttctctagaaaataaatcttgggtatttctgtggtagggtgtgcgggtagaaacaggagccttggataggatgtggggaggcagccttctcttccattctcacacctttccttttaaattcctccatttaattacagataatatgaacatatggtccattcactacaattgattaggagtccattcttttagattgttggttcatctctgttggcatgaattaaaaacaattttatctattaaaagtagaaaaggtataagaacattttccaaactgttacattgaatactagtttttgagatgttaagagtccagttgaataataaaaacaagaaaaagactagagagtcaaataatttgtaaatatggcttcaaaatcttaaagaaaatatttctttttattacgtgacttctaagagctttaaatatactaattggaatgtgactattctagaaggtggagagcatttgcagagtaattagaccattcccctgtagacggcagttaatatcagagtaagccatgttttagaatatgacttgggcctgggcatggtggctcatgtctgcaatcccaggatttctgggaggctgaggtgggaggatagcttgagcccaggtactccagcctggggcacaaagcaggaccttgtcaagaaagaaagaaagaaaaagaaaagaagggcagggcagcgcaggaggaagggagggagggagggagggagggaaagaaagagaaagagaaaagacaaaaagaaatatgccatgggaattgctgcacaaagcatcttaatctaagttttatactaatcacagggcttctattactcctacaagaattcctttaccttagctggagaggtaaaatgaattgctaaacacttaaaaaccagcatgactgtaccaaggaataaaacatgttaactctgtttcaggtgagtgctttctccattacatcaaattgcctgcttacttaaaattaatcataatatttgaattaggatcacgtaatgtaaaaaaatctcatttcccagaatattctacactagaaatcaatttctcactatcctgctgaaatttgtccaagcaatctgcatatatttttaaatctatcttttttatctctagttcagcatgtgccataatgttctctgtggagcacccaaccccattactctgtaagcaaacaaaaagttaactatttaataaagtttggaatattttgcctatgtatctccttcctggatatttacaatatttatttagcttccagtaatatatcagtttaattttatgaagctcagcttatttgaccatgcaaccattttgcaggtagtacctgttgatattagcattccacaaaacctactttgggaaatactaacctaggttactaaggttcatactagcaagagatgaataagactaactattataaataataatggagaaaaaaagagctccaatgatctgacacagagaaatggattttatgaagggacatgatttctcaatgagaaagaaagaggaaacagaaaactaatagttccattgtatttccatagttagggtggcgtatggttaggattctttgttcagttttataaacctcgtactgtcatgacttcattaacccaaggctaagctgtaattctaaaaggtatatatatatttaaaaattgacaaataagaatgtatatatttatgatgtaaaacattttatttacatagatgtatacattgtgaagtggctaaatcaagctaattaatatatacattacctcacaaacttatctttttttgtggcaagatcactaaaaatctactcttttagctattttcaagtatgcaatgtattgttgttaactatagtcaccctgaggtacaatagatctctggaacttattcctcctgtttaactgaaattttgtgtcctttgactaacattgccccagtcttcagcccccacccatcagccctggttaacaaccattttattctgtttctatgagtttgacatttttagctttcacatttaaatgagatcatgtggtggttgtcattctgtgcctgacttatttcacttaacataacgtcatccagattcatccatgtgatcccaaatgacaggatttccaaaatatataaggaactcaaaaaggtcaatagtatgaaaacaaataacttgattaaaaaacaagaaaaggatctaaacagatgtttctcaaaagaagccataccaatggccaacaggtatatgaaaaaaatgttcaacatcacttaataatcaaggaaatgcaaactaaaaccacaatgagatatcaactcatacctgttagtacaaaaaagatgaaagatggcaaggatgtggagaaaagggaagatgtttacactgttggtgggaatgtatattcacatagccattatggaaaacagcatcgaggttctttaaaagctaaaaatagtactaccatattatccagcagtttcactactaggtatatatccaaaggaagtgaaatcagtgtgtcaaaaagatatttgcactcccatgttcattatagcattatttacaatagcaaagatacagaatcaacctaagtgttcatcaacaatgaatggataaagaaaatgtggtacacacacacacacacacacactcacacactagaattctacccagccctgaaaaagaaggaaatccataataacatcttttattttggatagaatggacatcaagggtatttgtgacagatataccatgaatgacatgaacctaatattaaatatttatttttgttgatgtaaggaacattaatagcctagaaactataagttttaagatttagcttaggaactcaaacgatgtagcaaatatatttcatcatgatttgatctatctatatcaatcttataaaattgtgtgagcatgaggttttggggatgaagagataatggaatcaaattttagcttttacccccaaaccttctagactttaattgtatattatgtaaaatgtaagtatttaaaatatgaagttcatgaatgggttcatgagtcaaccgcaggggagttggtgaagcccctgaaactatatgaaaaattgtgtgtacatttacatttttcaagagagatttgatctagtcaaattttcaaagcaccctgagatacccaaaaagtgatagaccccttaaagagataatctctaagaattctgtctcctttttcattaacagttttataagctttcttatgaaaagtatgtcatgtttatgatatttagtaatttctttgctgagccttcatttttagctattcaagaaatttaaaagtaaattgtaaatattacaattagtttctaaggattgtttaaaatatcattaattatataaaattttaatatatattttcagttcttcagctaggacagacagagcctctttaaaagattttatttgatgctgggaagggtgctgggaaaagagaactcctatacactgacgatgggaatgtatattagtacagccataatagaaaacagtatggaagtttctcaaaaaactaaaaataaaactatcatatgatccagcaatcccaccactaggaatttattcaaaggaaaggaaatcagtatattaaaagtacacctgcacccccatgtttattgcagcactattcacaatagccaagatatggaatcaacctaagtgtccttgatggaactggaggtcattacaataagtgaaatgagccaggcacagaaagacagatatggcatgttgtcactcatatgtgggagctaaaacagtggatctcttggaggtagagagtagaatgatggttaccagaggctgggaagagagaggtgggatgaaaagaggttagttaatgggtacaagcatatagttagatagaagaaataagttctagtgttcgataacacagaaaggtgactatagctaacaataatttattgtatatttcaaaatatctggaagagctgaagtgttcccaacacaaaaaataataatcgtttgaggtgatggttatcttaaataccctgatttgatcatcacacattgtatgcatgaatcaaaatatcacatgtacctcctaaatatgtataattattatgcatcaatacaaatatttacagtaaaaaggagatttgaattgtaagaaaaaaagagaagaaattctatttttgcaacttataatagttattatttgtgtgagatactcacttgcccacaagatggcgctctctaattttggatatactattttcccaaaccaatttctcaagaagttatttctaaagtgttctcttccctgaaaaataatatttacaataaattattcttcactactgtttgattttcatgcttgaacatctaacaatgcatgacaaagtatatgttaatgtttttgtgtgagtggattgatgaatggatgtttcagacattcacagaatgtttactaaatttctgctgcataaacagctttgcacagtggatttataaacaaagaaacaaaaggtgttaaagtataaagagcaaatcagggttactatttttcaagttaatatttttatatccaagagtttcatatttaaatgaaaaatgattgttatagacatgtaaatgtacagcaaagagaagacatcggttcagttaggtaaaagaccttataagttgttgtgacttatgaagaactttaaggtttgtatgagaaggaggtaaggggaagatatttaagaggcggcaaataacataagaaatagcttgaaattatgtagtcatgccatcccaaaataaaatggcctcccattagataaggctagatgagttacagagggtggtaaaagtcactccaagaggaagaaaaggtaactaatatttactgagaacataatataactcatactgttatttaatgatctttccccacccttgaaaatacgtggatgtgcctcttattagagtgttagaattatggtgctatatttggatattttgagtaggttgcacttccctaaatgttgtactaaatcccagtatacagtcaccagaggaatagagatttcccagagaggaaatcagagttaaggaggtgagccttaagtaagcataggaggagactaaacttctctgtcttgattctcaatctcttgagtaatgactatgtcttgtggagccctctcttgtgggaaagttaaagatggcctctgctgtccagtgtgaagagggagtcagaagaagagtttctcctaggggacttcatttgaataagatatctcctatgatagaacaaattatctagtttcatgttactttgattctacatagtttgtcagtaaagtgttgctttaaaattcctgctttgtctcagctgttaaacaaagaaaaggatttttttaaaacccacatttagatcaaattgacttaaaaagagtacctgtctgtccaaaggatgatggtagtgagaacaacaatgagaaagaccctgaaaaaaagaattctgcttctcactgatctctctttcttcccttattcccctaaagtcatctccaaattaggagtcagagggatcttgttaacatctgtttaaaggtctttgtttaataaggcaaagccactagtaagatgaatagagctctgagtccccttctgtttcatctccaactttttcccttattctccactttgctacttcactccagccaccaggaccttcttactgtccctccatgatggcaggaggactttttgtacctccttcatgtttgctcacatgctaccttctgaatgaggtctttcctaacaccacttaaaattccaccacccaccacacacacattcgttaacctcttctctaatacacttttcttcatggtatttatcacaaaatcttccccatacatatttttaaatatagatatataaataaatatatatttctatatattacatatatatataatatataaattattttcatctttcactcccagctggaatataaactccacaagggtagaatttttgtctgtttcattcactgctgtatttttttttacagtacagagaagaaagctcagaacatagtatgccttctgtgataatcctgagtgtgaacttgagtggatggaaggatacaaagtattgatcctgggtgtgtctgtgagggtgttgccaaagaagattaacatttgagtcagtgtgcagacccactcttaatctgggtgggcacaatctaattagctgccagcgctgctagaatataagcaggcagaaacatgtgaaaagaaagactggcctagcctcccagcctacatctttctcccatgctggatgcttccttctctgaaatattggactccaagttcttcagttttggaacttggactggctctccttgcttctcagcctacagatggcctattgtggaacgttgtgattacgtgagttaatacttaataaactaccctttatatatatgtgtgtgtgtctatatatatatatatatatattccattaattctgttcttccagagaaccctaatataccttgtcatatttattgaatcaactttttaaaagtctaatttctgtgttctcttgaaaaatcagaaagcctgccaaccctggcctatattttcacatgataacaactgtgaggagctcagaagtcactgcgcatgcaggtgaggatatatctataccctccttgcccaggatccccctgccttctccatttgaatagctcctggctcctgcagatatgtgagttgtgacctgctggaagagtcctgaaagggagagtgacaggatcaaatgaagactttcagtaagtcacctggaaatagtgtgtaggattaatttaacgagtctggaggttgatgcctgttagtatctgctgtcgaagtcctggcatgaatggatgaggacctatgtgatgtgaactcagctgaagaatgaaagacaggggaagtagagtttgaagaaaggattaattgaacctgaggatggattggatattaaaaatgaatgaaaagaaaaagtaatgatgactaaaatttctagactggataattaggaaaatgttaatttctgatgtaaaagggaactcaggaaagagtcaacctaggacaaaaatcaaaagacctacatatggaaagaaatatactgatttgagtgaacccaagcagagtttgaagacacagattcaaaggtatttgacaacaaaaaaaggactttgagatcaatgccagagatggggactcaattttgcatactgcttatatactgcctacgtaaaggcactttatgataaagaacatctcaaaaaaataacatatagaacaaggggcaaaaataggggataaaagagatgattcccaattattggtcaagtggttggagtgagaattaaaggcaaaattcctcttctccccctcaaaattacacacaactacacaaacatatgtgttaatgattttagtgtgttgaatctggctgcttccacactgcatgcatcctacctttctccattcacacctgagataatctcattctagtgaagtcttacattataaatgacaacaccaatatttagggacgttcctcttttttcttcactgactttgcctttccaaacaatatactttgtgaatcctctgagaaaaaagaaagtagtttgatctgctggtttttaggacaataatttttaaaggacttgttatttttggttcagacaccatgcaaaactcatcttcaatcaagggcaggtgccaggtacagcatcaagaaagtaacaggtggtttctcttcctctcctttcctctaaaacatgaataaaacaaaagttttagcatttcagaaataatctttttaattaaaagtggaagataaatgtgataaaagttttctttgagctcttgaaaacaagttcattctataagggttagaaatagtattttttatctgtcactagagccattgtactgtggggcctaatgtttcagattttggatactcatttctttcgattgaaggtgtcatcaggtgttttccacctttagtgatctcaagtggttccccttcagttgctaaaatatactgtgtcgtttgagcagtccaagacccacagagatctgctatctatattggcagataaatgacagcagatggaattgaggctgtgttctgtctcatcggcaagcctgcagccttagaagaagagatgtgcccctgaagcattatgcaggttgctcatccagaatcagtgtcactgtcatagtttgtgaaagggaaattggcaaatctctatacataataggcaaaatgcaaccctctcaattctcaaaggcatattctcttcactcacatttttgtctttttgctgaagggaggtttctgggccaagatgttctgacagcctggtattttctttttttgcccaatgtgtaagaagataattaatgttaccattaatgcatgcaatgacattagtatcaattcccttagtgatatatatgcactaggaaatgaacacaaaagttaattaacaatttattgagcatatactatattacaagtttactatacaattgtgctttattactattggtgaaaataatgaaagatggcacttttctattcttcaccatatacaaggcacagttccaaggatttaaaatctatcaactttatgaatctttacaacaggaggagccaagatggccgaataggaacagctccggtctacagctcccagcctgagcgacgcagaagacaggtgatttctgcatttccatctgaggtactgggttcatctcactagggagtgccagacagtaggcgcaggtcagtgggtgcgcgcaccgtgcacaagccgaagcagggcgaggcattgcctcactcgggaagtgcaaggggtcagggagttccctttcctaatcaaagaaaggggtgacggatggcacctggagaatcgggtcactcccacccgaatactgcgcttttccgacgggcttaaaaaacagcacaccacgagattatatcccgcacctggctgggagggtcctaccccacggagtctcgctgattgctagcacagcagtctgagatcaaactgcaaggcagcggcgaggctgggggaggggcgcccaccattgtccaggcttgcttaggtaaacaaagcagccgggaagctccaactgggtggagcccaccacagctcaaggaggcctgcgtgcttctgtaggctccaactctgggggcagggcagggcacagacaaacaaaaagacagcagtaacctctgcagacttaaatgtccctgtctgacagctttcaagagagcagtggttctcccagcacgcagctggagatctgagaactggcagactgcctcctcaagtgggtctctgacccctgacccccgagcagcctaactgggaggctccagcaggggcaggctgacacctcacactgcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaatcagagcgcctctcctcctctaaaggaacgcagctcctcaccagcaacagaacaaagctggatggagaatgactttgacgagctgagagaagaaggcttcagacgatcaaattactctgagctacgggaggacattcaaaccaaaggcaaagaagttgaaaactttaaaaaaaatttagaagaatgtataactagaataaccaatacagagaagtgcttaaaggagctgatggagctgaaaaccaaggctcaagaactacctgaagaatgcagaagcctcaggagctgatgcgatcaactggaagaaagggtatcagcaatggaagatgaaatgaatgaaatgaagtgagaaggaaagtttagagaaaaaagaataaaaagaaacgagcaaagcctccaagaaatatgggactatgtgaatagaccaagtctacgtctgactggtgtacctgaaagtgatggggagaatggaaccaagttggaaaacactctgcaggatattatccaggagaatttccccaatctagcaaggcaggccaacgttcagattcaggaaatacacagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattctcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaataaccagctaacatcaaaatgacaggatcaaattcacacataacactattaactttaaatgtaaatggactaaatgctccaattaaaagacacagactggcaaattggataaagagtcaacacccatcagtgtgctgtattcaggaaacccatctcacatgcagagacacacataggctcaaaataaaaggatggaggaagatctaccaagcaaatggaaaacaaaaaaaggcaggggttgcaatcctggtctctgataaaacagactttaaaccaacaaagatcaaaagagacaaagaaggccattacataatggtaaagggatcaattcaacaagaagagctaactatcctaaatatatatgcacctgcaggagcacccagattcataaagcaagtcctgagtgacctacaaagagacttagacttccacacattaataatgggagactttaacaccccactgtcaacattagacagatcaacgagacagaaagtcaacaaggatacccaggaattgaactcagctctgcaccaagcagacctaatagacatctacagaactctccactccaaatcaacagaatatacatttttttcagcaccacaccacacctattccaaaattgaccatttacttggaagtaaagctttcctcagcaaatgtaaaagaacagaaattataacaaactatctctcagaccacagtgcaatcaaattagaactcaggattaagaatctcactcaaaaccgctcaactacatggaaaccgaacaacctgctcctgaatgactactgggtacataatgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaagtaaaagaactagaaaagcaagagcaaacacattcaaaagctagcagaaggtaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaacgatcccacagaaatacaaactaccatcagagaatactacaaacacctctatgcaaataaactagaaaatctagaagaaatggataaattccttgacacatacaccctcccaagactaaaccaggaagaagttgaatctctgaatagaccaataacaggatctgaaattgtggcaataatcaatagcttaccaacaaaaagagtccaggaccagatggattcacagccaaattctaccagaggtacaaggaggaactggtaccattccttctgaaactattccaatcaatagaaaaagagggaatcctccctaactcattttatgaggccagcatcattctaataccaaagccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacacaaatcagtaaatgtaatccagcatataaacagagccaaagacaaaaaccacatgattatctcaatagatgcagaaaaggcctttgacaaaattcaacaaccctacatgctaaaaactctcaataaattaggtattgatgggacatatttcaaaataataagagctatctatgacaaacccacagccaatatcatactgaatgggcaaaaactggaagcattccctttgaaaactggcacaagacagggatgctctctctcaccactcctatttaacatagtgttggaagttctggccagggcaattaggcaggagaaggaaataaagggtattcaattaggaaaagaggaagtcaaattgtccctgtttgcagactacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaacacctaggaatccaacttacaagcgacatgaaggacttcttcaaggagaactgcaaaccactgctcaatgaaataaaagaggatacaaacaaatggaagaacattccatgctcatgggtaggaagaatcaatatcgtgaaaatggccatattgcccaaggtaatttaaagattcaatgccatccccatcaagctacccatgactttcttcacagaattggaaaaaactactttaaagttcatatggaaccaaaaaagagcctgcatcaccaagtcaaacctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaacggttctgggaaaactggctagccatatttagaaagctgaaactggatcccttccttacaccttatacaaaaattaattcaagatggattaaagacttacatgttagacctaaaaccataaaaaccctagaagaaaacctaggcattaccattcaggacacaggcatgggcaaggacttcacgtctaaaacaccaaaagcaatggcaacaaaagccaaaattgataaatgggatctaattaaactaaagagcttctgcacagcaaaagaaactaccatcagagtgaacaggcaacctagaaaatgggagaaaattttcgcaacctactcatctgacaaatggctaatatccagaatctacaatgaactcaaacaaatttacaagaaaaaaacaaataaccccatcaaaaagtgggcgaaggacatgaacagacacttctcaaaagaagacatttatgcagccaaaaaacacatgaaaaaatgctcaccatcactggccatcagagaaacgcaaatcaaaaccacaatgagataccatctcacaccaggtagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaacaacgatagactggattaagaaaatgtggcacatatgcaccatggaatactatgcggccataaaaaatgatgagttcatgtcctttgtagggacatggatgaaattggaaatcatcattctcagtaaactattgcaagaacaaaaaaccaaacaccgcatattctcactcataggtgggaattgaacaatgagatcacatggacacaggaaggggaacatcacactctggggactgctgtggggtggggggaggggggagggatagcattgggagatatacttaatgctagatgacgagttagtgggtgcagcacaccagcatggcacatgtatacgtatgtaactaacctgcacaatgtgcacatgtaccctaaaacttaaagtataataataaaaaaaataaaaaaataaatctttacaacattcctatgagtttagcatttaccaactgcattttagatatgagagaaaatgctaatagttattattcatagtaataccaacaaaaataatagctaacatatgagtatttgctaagttttaggtaccattatgtatgttacataaatatgcatgtatgcatatatacaggttgagcatccccatccaaaaacctaaaattcaagatgctctgaaatccaaaatgctccaaagtctaaaactttttggtcactgacatgagatagtgactcctttgctgatggttcagtgtacacaaactttgtttcatgcacaaaattatttaaaatattgtgtaaaattaccttcaggctatgtgcacatggtatacataaaacataagtaaatttcatgtttatggctgggcatggtagctcacacctgtattctcagccctttgggtggccaaggcaggagaatcatttgagaagaggagttcaagaccagcctgggcaacatagagatatcctgtctctacaaaaattttaaaaattagctggacatggtggtgcacacctgtagacctgcacacctgtagatcgctggagcccaaacgttcaaggttacagtgacctatggtcatgccactgcactccagcctgggcaacacagactctgtttctaatacatatattagagactatctatctatctatctatctatctatctatctatctatctattttgatcccatgggggagatcactcctttaataatgcaagagagtgaataagatgggggagggtggcgtgcaattgagagatgagctttatactggaataccaagtttatggtgtggaactctggggtattacactgaaatgttaggggttctcagtgggttatttgtctctttctattaaactccatttacatttagctctgctgatgttgctcttgcagcaattggttttctcaattaacagaaaagggagagggaacagcttaaagccttggctgttgccgctcagcaagggaactgtgctgctctggagagaaaggtctggacattgtgagtttctgtttatttactttgtttctgacacacctgtctttcaggaagcctggcagtcctaagctgaatgaatagcatgctggaaagcccttcttttgaactaagttcagggcttttcttctaaactgaggtgccctcacaacacatgttctgccaaccacccgaaggtcaaaaagattttctggatgtttttgagacaaagggaattcaaaatctgcaaggaatggcctggggcatgataattctgagagacaagattctccaggctatgcacagaaaaccaactttttatgttagtatttaactcaagtagaatcaacaatggcatggaaattcgttttattttgcttttcctaaggaggatcatctcgtttaaagtgtgaattcaaaaactcactattgtgatagagtgacctcttttcatcctaattattttccataagtatcctgcttgctagtgaaaagactgaaagtgaagaatactagttataaatcatctttagagtgagagctgaagtgagataatttaacctgaacagcacaagctgtccctgacatctgcaacttcactcatcaccagcagtgaatctgctggtctgattggccaggtgtacatgtctcctctcccgaacggtcaggggtagccagtcacacttctgccaataaagagcacgacaagtccctactctacagttagtgaccatgttaaacctatcaaagattaaaggggaaatggggtattccattcaaatgttaaaaaattccaatccaagatgtctacctattatcatgataatcaacacaggacatttatatccagaaatttggttgctttggttccttttatatttacaaaataattattaaactaacccacacaccccaaattgtatgcacagggcttagaacaagttgcaggagtcttttgtgccaccctcttcataaggctctcaaactatttttttttaaattccatatttctaactgactttctattatgaatgatgaagatttcacactctttcaccatttcacctctctacttccctctttctatcctcccattacagttatataacaattattggctaaataaacattcagtgttctattgtatcatccctgcaaagtaacgtttactgataaaccaaatgatgtgccataattatgttttatttatggaacaactttttgttttttctggagttatatattaccttctttatttgattatgtgacattatcaccaatttttctagacgtctccaaaacataattttttaaattttaaatttctgttggtacataataggtaggtaggtagacagacagacagacagacagacagacagacagatagatagatagattgattgatttatggggcccacgagatattttcatacaggcaagcaatgcataataatatcagggtaaacagggaatctattactgcaaacatttaccctttaagttacaaacaattcaattatattctcttagttattttgagatgtatgataaactactgttgactgtagtcaccctgttgagctatcaaataccagatcttatttgttctatctaattatatttttgtacccattaaacatccccacttcttacttcctcccatccactacacctcctagcctctggtaaccatcactctaatctctatctccaggatctcaattcttttaatttccagctcccttaaatagtgagaatacgtgaagatgatctttctgtgcctggataatttcatttaacataacatcctccagttacatccatgttgttgcaaatgacaggatctcatttctttctatggccgaacagtactccattgtgtatatgtaccacattttctttattcattcgtctattgagggaaacttaggttgcttccaaatcttggctactgtgaatagtgctacaataaatatggaagtgcagatatattgatttcctttcttttgggtgtatacctacctagaagtgggattgctggatcatatgggagttctatttttagctttttcgaggaacctccaaattgttctccgtagtggttgtactaatttacattcccaccaaaagtgtaggagtgttctcttttctctacatccttgtcagcatttgttactgcctgtcttttggataaaagccattttaactggggtgagataatatttaactgcagttttgatttgcatttccctgatgaccaatgacattgcacaccttttcatatgactgtttgccatttgtatgtcttcttttcagaaatgtctattcaggtgttttgcccatttttaattggattatcagattttttttcctacggagttgagctcctaatatattctggatattaatcccttgtcagatggatagtttgctaatattttctcccattctgtgggttgtctcctcaccttgttgactgtttcctttgctacgcaggtatttttaacttgatgtgatcccatttgtctattttcgctttggttgcttgtgcttgtggggtattactcaaaaaatctttgctcaggccaggcgcagtggctcacacctgcaatccatgcactttgggaggcctaggcaggtatatcacttgaggtcaggagttggagaccaacctggccaacatggcaaaaccctgtctcaactaaaaatacaaaaattagcccagcatggtggtgtgcacctatagtcccagctactcaggaggctgaggcacaagaatcacttgaacccaggaggcagaggctgctgtgagctgagatcacaccactgcacttcagcctccagtctgggcaacagagtgagactctgtctaaaaaaaaaaaaaaaaatctttgctcaggccaatgtcctggagagtttccccaatgttttctttcaatagttttatagtttgaagtcttagatttaagtctttattccattttgatttgatttttgtatacggcaagagatagaagtctagtttcattcttctgcatatagatatccagttttcccagaaccatttattgaagagactgtcctttctcaatgtatgttcttggcacctttgtcaaaaatgagttcactgtacatgtatgaatttgttcctgggttttcatgccagaaccatcctgttttggttactatagctctgtagtgttatttgaagtcaggtaatatgattcctccagttttgttctttttgctcagtatagctttgagtattctgggtcttttgtggttatacatgaattttaagatatttttctatatctgtgaagaatgtcattggtattttgatagagattgcattgaatctgaagattgctttgggtactatgtacattttaacaatattgattcttccaatccatgaacatgaaatatctttccattttttgtgttctctttaatttctttcatccgtgttttatagttttcattgtagaactctttcacttctttcagtaagttaattcctaggtattttatttgtagctattataaatgggattacattcttgatttctttttcagattgttcaccattggcatatagaaatgctactgatttttatatgttgaatttgtgtcttgcaactttattgaatctgtttaccagttctagtagtgttttggtgaagtctttaggtttttccaaatataaaataatatcatctgcaaacaagaataacttgacttcttcctttccaatttgaatatcctttcattctcctgtctgattgctcaaggggtaatggacatccctgtcatgttacagatcttggaggaaaaactttcaatttttccccattcgatatgatactagctgtgggtctgtcatatatggctttccttgtgttcaggtatgttccttctatcctcagttttttgagtttttatcatgaagggatgttgaattttatcaaatgctttcccagcataaattgaaatgatcatatgtttttgtccttcattgatatgatgtatcacactgactgatttacattatgttgaaccatccttgcttccttgggaaaaatcccacttggtcacgatgactaatctttttaatgtgttgctgaatttggcttgctagtattttgttgaggatttctgcataaatgttcattgggagtattggcctgtagttttctgtttgcaatgtgcctttggtctgtttcggtatgagggtaatactggccttgtgcaataagtgtggaagtactccctcctcctctatttttcagaatagtttgagtaggattgatattacttctttaaatgtttggcaaaattaagcagtaaagccatcagatcctgggcttttctttactgggagacttttcattatggcttcaatcttgatggtattggtctgttcaggttttggatttcgtcatggttaaatcttggtaggttgtatttgtctaggaatttatcatttttttaggttttccaatttatttgcatatagttgctcctagtagcatctaatgatcctttgaatttctgtggtattgcttgtaacgtctcccttatctttccttatctttccttccccccccccccccccatagagtcttgctctgtcatccaggctggagtgcagtggcacaatcttggctcactgcaacctccgcctcccaggttcaagcaattctcctgcctcagccttctgagtagctgggattacaggcacgtgccaccacgctggctaattcttgtatttttagtagagatgggatttcaccgtattggtcaggctggtctcaaactcctgacctcatgatctgcctgccttggcctcccaaagtgctgggattacaggtgtgagccattgtgcccagcaacatctcccttttcatctctgattttatttattagcatcttctttcattgttttaaattctaactctcttttgttcttacttgataattttgtatagtatccttttgtttcattaatgtgataacttgtcatctgtctagggctacgaagtttattttttctgaaacgtctatttgtttcttaaactctttttatatcaacctaatcatcatcattattttcatttgtttgcattaggctttttgttgaagaatttcctcagagttttgtggagacttggctatctattcatattcaacagggagacactaaaatactgactgggagccttgaatgatttaactggacttgtagagtcttggggttcattatagggtggtgttccttgaatgtcccctccaattctcatgttgagatgtaatcctcagtgttggaggtggggcctggtgggaggtgtctgagtcatgggagtggttcccttatagctttgtgagcaagttctcataaaatctctttgtttaaaggtgtgtaacaccttccttcccgctctctctcttgctccccctattgccacgtgagatagctgctctctcttcagcttccaccatgattgaaagctccctgaggcctctccagaagcttagcaaatgctggcattatgcttgtacagcctgcagaactgcaagccagttaattttctatttcttcataaattacccagtctcagatatttctttattgcaatgccacaacagcctaatatagaagactggtaccaaggagtggggcattgctataaagatacctgaaaatgtcaaaatgacattggaactgggtaagagacagaggttggaagaattgggagggctcaggagaaggcagggagatgaggaaaagtttgaaacttggtagagactgattaaatggtcatgaccaaaatgctgatagtgatctgcaaagtaaagtccgtgctgacaaagtattaggtgtaagtgaggaacttattgagaactggagcaaaggtcacccatgttataccttagcaaagaacttggctacattatattcatgcccagggacctgtgaaagtttgaacttaagagttaatgacttagggtatctggcagaagacatttctaagcactgaagcaattgagatgtgacctggctgcttctaataacctatgctcagatgcagaagcaaagaaataacctaaacttggaatttttacttaaaagggaagcagagcttacaagtgtggaaaatttgcaacctagctatgtgatagaaaataaaaggccatttttggggaggaattcaagcaggctgcaagcaatcatttgctagggaaatttgcataactaaaagagaacaagtgctaatagccaaaataatgggaaaaaggcctttacagcatttcagagatcttctaggcagctcctcccaccacagtcccagtggtacaggaggactaaatggtttaggggataagcacagggcaccactacactgtctacctcaggaggctgctccttgcatcatggtccatccagtccagccgtggctcaaagagcctcaggtatggctcaggttgccactctggagcatgtaagctgtaagcctttgtggcttccttgtggtattaagccttcagatagaaagaatggaaagagtgatcctagtctctgcctagatttcagaggatgtatcagaaagcctgggtgtccaggcagaagcatgctacagggacagagtcctcacagaaaacctctactaaggtagtgcagaagggaatatgggattgaagccctgcccacaaagaatcccccctggggcattgcctagtggaactgtgggaaggaagccattgttctgtgggtcccagaatgtagatccactggcagcttgcatcctatacctgggaaagccgtaggcactcaactccaacccatgagagcagtcatggaggcttcaccttgcaaaagctgtagaggcagagctgcccaaggccttggagtctacccttacatcagtgtgacctggatgtgggacatggagtcaaaggagattattttagaactttaagatttaatgactgtcctgttgtgtttcagacttgggtggggcctgaagtcatttcttttggctgatttcttccttttagaatggaaatgttggccaggcatgatggctcatgcctgtaatcccagcactttgggcggctgagacaggtgaatcacctgaggtcaggagttcaagacaagcctggccaatgtgatgaaaatccccatctctacaaaaatacaaaaattagctgggcatgacagcgggtgcctgtaatcccagctactcaggaggctgagacaggagaatcgcttgaacccaggaggcagaggttgcagtgagccaagattgcaccattgcactccagcctgggtgactaagcgagactccatttcaaaaaaaaaaaaaaagaatgggaatgtttacccaatgcctgtacctctattgtaccttggcttggaagtaaataacttgttttaattttacaggctcataagtgggaggaactcatttccagacaagattttgtatttggacttgggacttttgagttaatgctggaatgagttatgactctgggagactgttgagaagagatgattccattttgccatgtaagaaggacatgagatttagggggccaagggcggaatgatacagtttgggtgtcccctccaaatctcatattgggatgtaatccccagtgttggagatgggccctggtgcgtggtgtctgggtcatgtgggcagatcccttatggcttggtgagtgagtgaatgagctctctgagatctagttgtttaaaagtgtgtgctaactcccacaacccccttactcctgctctcaccatttgagacacctactccccttttgtcttctgaaacaactacaagttccctgaggcctccccagaagctgagcagatgccagcaccatgcttgtacatcctgcagaactgtgaaccaattaaacatgttttccttataaagtacccagtctctcaggtatttctttatagcaacgcaataatggcctaatacatggggtaattgaggaataaagacccttggcttctttattgggcaaccatctaatgccagtactataggtcttttctctgggtggtaattccatttttctgaagaagaattcttcttggttatttttatttttaattttaattcttatgagtacatagtaagtatatgaatttatgggtcacatgaaatattttaatacaggcatacagtgtgtaataatcacatcaggataaatggaggagccatcatctcaagcatttatcatttctttgtgttacaaacattccaattatattcttttagttgcttttaaatatgcaataaattattgttgactgtagtcaccctcttatgctatcaaatactagatcttattcttcctccccactacccttcccactctttgataaatggcatcctactctctatctccacgagttcaagtgttttgtttgtttgtttgttttgtttttttcttgagacagtctcactccatcacccaggctggagtgcagtggcacgatctcatcacaacctctgcctcccaggttcaagtgattcttgtgcctcagcttcccatgtagctgagattacaggcatgcaccaccatgactggctaatttttatatttttagtagagatggggtttcattatgttggccatactggtcttgaactcctggcctcaagcaatctgcctgcctcagcctcccaaagtgctaggattgcaggcgtgagcccctgaacctggcaagttcaagtatttttattttagttaccaaaaattagtgaggacatatgcagtttatctttctgtacctggcttatttaacataatgtcttccagttccaactatgctgttgcaaattacacaatctcattctttttttatggctgaatagtactccattgtttataggtactgcatgtttttttgcatccatttgtctgtcgatgggacacttaggttgcttccaaatcttagctattgtgaatagtgctacaataaacatgggagtgcagatatttttttagacaatttttatagaaaaacaatttttctatctcctctcttggcattataaggctaactgacagagttcttattcccaggtgctactagagaagtcagaacttcactattcagttgatagactttcatttactctctcaccttccaatgtgcctagtatccccaggttaagacttctcttatttatttttatagcataaatttccattctaatgaggataaagtggcactggtctcctagctgagcagggtgagaggagaacctatggaggactccccttcatatgcagatttctcatccaccttcccccctttttaagattcttggttcctcaattgccatctttcaagattttgacaaagggaatggtttgctggttttgccctcctctgtgggcactttgtaattagcattctcaactttgttgattttttcctctcctttccatttcctaaattggtcctctcacatctctagttgtttcttctcgtcaccctttattactgacactttattgtcttctattctttaccgtcatttgacaagagggctttcaaaggtagcaaataaaaaagactgtattaattttccagggcttccataacaaaataccacagattgggtggcttacacgacagtaatacgttttgtcagtgttctacagtttggaagtccaagatcaaaggcgtcaacaggtttagtttctctgagacctgtctccttggctttcagatggctgccttcttaccatgtgtttacatggttgtctctgtgtgcatgtgtctaatgtctctttgtgagtccaaattccctccctttataaaggtatcattcagattggattaggggccactctaaagacctcattttaatttaatcacctctttaaagaccttatctccatggttacattctgaggtaccaggggttaggacttcaacattttgagaggacacaattcagcccataaaaaagatcacatttaaaacattttaaaaaattcttaacactacgccaaatgtattgcaagtattctctatccttttacttaatgacgctgggaccatctatctaaatgaacactgctctctgaaatagcactcttttcattaatggattcgctcacttattaaatatcaattatcgtgcatctatttttgcaaggttcttggtttatcagcacaacaggatacagaggtaagccagactcaatatctatatacaagagggctttgttgagaaggataagaacaggaggctttttatttctgtgatgaacttttataggatactttaaagcataaaatatttgtcaactccttaatggtggttattctgaaaagaacttgaatgttttcaagggttgtactaatgcagtcatcttttacattaaatgcaacgttttgtacttttattttttttaagtcacttctgttacccagaagtcaggcacttataaaggctacttctgttactttctcttgtcaccatttcatttcaggaaatctaacagctcaactttcaattgcagaagagaaagtgaagaattgaacaacataaaaagcatactcccctctgcggtagttacacatccacaattacgctctgcttagggcaagttgggagcactggagtgggggaagaactgattatagaggggagctgagggtctgtagctcatggcacggctcccaacaatctggcccatggctgttcttacttggcaagcacatgaaattgaagatcactgctgcatctcatgcttctacagggtattgatccatggaaaatattaatgattaacttaagcaatacaatgagaggttgttactttgtactggcaatctttgacttgatcccctatacaaatcacatgcagaatgagtataaagcaaaaagaaaatgattgtttcatttactggtaagttattctggtccttcaccaaaatatgggaaactattttggtctaacatgagactactcaatgagaagtcataactgatatccctgaattttttataggtataaggttaagcttaagatgataatttatccgaagtcttctgaactctgtttttcttaggcagttttctgtatcttggcattgctggtactatattatggtagatatgaaatcagccaaatttaaacttgtctatcttttgttagaaagcatttggaggaaaattatctacattttaggattttccagttataacactgttgcctgtggcaattgcacttgctattagactcttcctgccctttttcaggaaaaagaaactcaagtgtcatttgttattcttgataccaatgctgagtgacctaacaaaaaatgccatggttggctgggcgcggtggctcacgcctgtaatcccagcactttgggaggccaaggtgggcggatcacgaggtcaggagatcgagaccatcctggctaacacggtgaaaccccgtctctactaaaaatacaaaaaaattagccgggcgtagtggtgggggcctgtagtcccagctactcaggaagctgaggcaggagaatggcgtgaacccgggaggcagagcttgcagtgagccgagatcgcgccactacactccagcctgggtgactgagtgagactccatctcaaaaaaaaaaaaaaaaaaaaaaaagaaatgccatggttgtcttgttgcaggtattctgtatttgcctaccatactatgcagtgtccttcttacaaccacctaacctttctccctcccacaatccctgaacctgggtacaattgcatgtagataaagattgacagatggttagcacatatattgatctaggcagataatctcacagatgtgatatgcgggaaataataacatcaaacagctttggaaaagatgtgtaaacactgtgaattttttgcttctatcactttaagagttggactgatttgggaaggactcaaactcttcaagtctagagtcttcatagataaaatagggacattttcaacttcctcctagaatgatgctttcttgtggggactgaatgaatcaatacacatgaaagtgcctctctcccttgatatctacaaatacatgtgcacacacacaaatatacacatacacacacacatatatatatctgtgcatatctgctcagaattctattatgcatttgtttcagtccagacacttgcagtctagtttagaaatcaagcatgaattgtatagcaatccaaatgacaacaaaatcttacaatgaaagacattttagaagctacatgattacatatcctatgactgtactgaaagtaacagagttcacgtgctccatctgaaccctcactgaatgccagtgcacacgttattcttaatactcaagatagttctgcaccttatgttttgttactgtgatttcaaagatatggaatgtgaacctcagagagggtaggcaacttggcggaaaacagaagaaacagatccacttggaccccaagcctggcctccttccatcaggccacccaatcctgaatttgaaacacagtgaattgcatcatgctccgcagtcttcatcatggaagagggagggactggaccttgaagaaagggtagaatttgggcagatcaagaagaatgcagggacacttcagaagaggagaggatgcgagccaaggcatggagacacaaacattggggacatatttgtgagacagtaatacaccagtttgtctataccagaggatctgtgtggatgaaaagcaagagaaggagccagaagagtcaagtggagctaattctgaaggcctggaatgccagacaaaggaatgtcattcactagctcatacagaaaatgagaaactgtcaagaaaccactgtgctctgttacagagatatcaagatatcgaacaaacaacaaaacaaaacaaaaataacaacaacaaaatagtctgtgtagggcttagagcccatgtactcctatatgtggactaggactctggggctatggcagaagtctgtgtggagggccatgacagcacaaggaagggagttgtcatttggatctggcatggaagttgtcaaaaaaggtttcacagaggacatggatttatgctggaagtgacgggcagtgaagaaatagtttgaactgtggagagtatgataaagataccattttcagaaaatgaactcagtagcagcatccagagggcataatgtggagtgatggctagagtctggagactgaggctaattaaataggagatcattgcagctatccatgcaaaaggagagggtagtggcagtggaaatgaagtcacaggaaagcatgagattttacagtgtacatctcagaggacttgaccttctggcagataaagctgatgagggagaggaggattcagtgatcactctaaggttctgagtttaagtggaaaaatagcaatgtcctgaagaaaaatacgggattttcttcaggagagcttcttcaaggaaaaaggtgtgctcaggtgaggaaactgaagcataaaaagagaaaaaacttgcccaggttggcaacaacttgccaatacagtcagtgagtggcagactctgagttcaaacccagataatctaaatatgaactgtctaatacggcagccaatggccacaagaggctgttgggcacttgaaagggggttagtatgactaaaggactaaatttttagtcttacttaatatttatgaattaaaagactgatagttgatttaataatactatatttggaacaacttgggaagtgaatctatatttctaattgtaaatcttatgagatctaaatgtccaataaagatccagtataattgaggacaattgggcatccaaattaatatgtgatgtaagtaaaaaatacatacaggatttcaaagacaaagtatgaggaaagaatgttaaatatctcattaataattatatatattgtttacaagttaaaataatctgatacagtgagttaaataaaatatatccttgaaataaattttacctatttctttttaccttttaaatgtggtaccagaagacctaaaattacgaagtgtctcataatatttctatactccagcgttggtctatatcctgagaaatacataaatgagaggtcacctgcatgagatgagtgacgtagttaatgggataggctattcctttcctaactctaaatctctattttcggaagatgactgaggagaatgccaacattgtcttaattcagtggcacagtgggccctgaacatgatcacattgttaatctccctactctcttgtccgggtcaacaatttcacagttgtcagaaaatgaacaactcaaattcccctttcttggtatatcttacatttttttatgtctcaaaggagaattatttcattcacatctgtttctgtctttcaatgaccagctctatcttcacgtcagtctcaatctaaagccaattttatcagagaatcccagagacaagcccaaagaggacttcttggatctggcctgagaaaatagtaaccagaaaaccaggggctattcaggatctgggtgtagcctgtatgcctgaatttttttccatgggggttcgttcgtagtctgatagtgaaatccaaatggtgtgtttgagaactgttgacaataatccagatgtttgctctactaagagtcatatgtgtaataaactaaaggtggacaacttcaattgaatggaataaaaggtcagagctaagcacttgtaactctctaggtattgcaggaattcgggtagtatcatttataaagaaaaagaatctaaaattctaccaattttcaggcattcagtgcatatgaagcaatgtgtccccaaagttagatcatccagatgttttatgttaatcagagtaaacatatgattcatcacagattcaacaaagtcaaaggcagaaaattcacatctacttgcaagctaaggggtgtagtgctttttccattttctatgccagctctcttgacatacttagcacttacccatagaataattgaggtcattggatttataataaaatgccattacaagaaatgctaataaaattatatgttctgtacatatagatgtatacatatacatatattttatataattctgtgtgtacatattgcatgtatgtacatacaatacatatatgaagtatttcacccaagagatattcccacttttcgaaatattgtgtatgaagtcttagtacaacagataaactattctactttactcctttttaatttctaggtattattttaacatattggctgtatatcctttgttaacaattctctataaaagaaaacttaagcaaaaattatctataacttttcatttatacattatatttggtatatatcatattaaaatgtacagaatgctaaagtactatatctattgattatagcaatgaggtgctcacaccgataaggcaaataaaaagtaacatctccagccaagagcattggggaagagataaagaaatccattacaaaggacattaaatgcatttgaaacagcttcaataaaatacccaagctcctgggaaaataatgtatctaaagataaaatggttttcagaactactgaaagggaataacacacaaatatccatgtctagccaaacaaaacaactgtacacctattgaacttccagtaagaaatgtttggttaaaaagaaaaagctgttaccttttttttttttaataaacaaacaacataatgaaaaatgatagagcactcaagctcatggctaactttcactgtgtggccttaaacatacttctttccagtgacagagtactagtactattttttgttggtttcttctctgttctcctctacaattccaaaattatgtagttctatccacagccaacaaatctctaacaattatgccaaactttggctgatttctggcaattgtaccacttaaacattcatatttattgctgaggatgtaatagtagggcagatcagtccatcacaatgtctctagcaaacattcgccgctatctactttattcctagcatggaccattccacgttaggccctaattacctgcactttttgaaaagcaaaaacaacaacaataacaacaaaacgctttacttttcctgataggtttgcatttagccattgcagaaacatagaacttaaaagaatacaaaatttaatattgtaatccatcatcttgtattagttaccaccttattacctgcaaagcaaatgattgctataagtcccctcattagtctccttactctagtcttctggtattccaaggtgtgtcttcattgctgccacttcattctttcataagcaaagctatgatcataggactccctctcttcaaaatctttaatagctcaccttagtttagaaaatattcctttgcttaattttcatgaccctaaaaatatagtctcattctccttttcctgttttatctcctatctacatgattgcctctcaagttcaataaattctgaccacactcaattttttttctataaacgttcatgtattttcctacatccacacctttgtgagattgttctcccagcctgaaatgcccttcatcttcaactctgcataactgaatgcaagctgcaagaccaaatgtcattttatctacaaagcattctctgatactcccagttgaaagtaaattctcccttctcagagctgccaaaatattttactcctgctttctccatggtacttaacagaacacatgggacaatatttagagaacagatgactggtgcctgggtcccaactccaggatttacctaacaattttttttttgtttttttgagacagagtcttactctgtctcccagggtggagtgcagtggcacgatctcagctcactgcagccttcgcctcccaggttcaaccaattctcgtgcctcagacacaagagtagctgggattacaggtgcatgccaccacacttggctaatttttatttttggatttttagtagaggttttaccacgttggccaggctggtctcaaactcctggcctcaaatgatctgcccaccttggcctcccagactgctaggattatgggtgtgagtcactcactgcacctggccacatttaactaactttatggtcttcagtaagacctttgaatctgctgggtctcagttttcttatcagttgatgtgatagtcaaaggaaacaatatatgactatctactttgcaaactgcaaagtgctatgtaatgtgagttcattctctgccagccaccctctttttaggcactgcctttcaggagagtacttcatcctctttcatgaccttatttgtaagataatccctgaatagcccagctggtggtaggtgtttggtctaatgtactcctagaggactattaaagtccttatgtagttataatttatttttccctttgaatttttgtctgagcagttcgactttgatttttttgaaggctaagaatttttctctctcagttttgcattcctagctgaaaattttgaaatcagttcctattcagtaaatgtttgctgcacaagtgaatgtatgagtgaattaaatgaatgaatgaatttactgatatcttaatgttgtggacagttatttatgtttagcacttatcatctgtctttagattttaagctccatgagggcaggttctttgtatgatccatgtttgtatccttatagttacatgtgcattatataaaataaatacttgcagaaagctgaatagaaaaaggtagctgagctggatgacatggtaggaggctcctgtgcatagagtttcctgtacaacagtttttttactgacgtgcatgcaatcttaacatctgtttaattcacaaatgaggctaatatttattattgacattgaaatttcttttcaaattgaataaaagaatgtctgtaaacatagatacatcttttgatggtagagtaacacaaacttcagtggagtcatctcttagattatgtggcaagaatctgacatagtcacttttaccgtggagaaccccttgaatcacccaatgtaaggcaaaatgttcacactcaacagttcaccaaaggaactgagatgggaagagtggtagatccacatctcctacctcaatcacacttactagtgaacatagatccattgcacgtggtggcagatggggcatctggaattgctctattggaatttttatatctcccttgctctatctctcccattttacttagcacgtgtatttgaatttgcatcggtaagtccttggatggtgaaactgtactgaattgctcttttacagtatcaggttctcctcagtcacagtacgtgtaaaatttctcaatagcttagaaagattaatgggtctgtgtaaatctcattatcccttaagtaatttaaccccaatgatccccattgtaacccaaatcctagtctgacttggagaatccagtgtggtaagtaaaaatggcaatttacctttaaaaactgccagtgatgtgcaggttaacactcatcttcctactttattttgagatgactttgaacatatactgaagtcagagacaacagcaaccccagggctggaatgtcctgcttccacaggactcatcatatgggattcccagcatctatcagccttagaattcaagtgggtttttccccagagggaagactttgctgacgaaatgaaacatcagggagaagcaaaatctcttgcaaatcaaaatggccaagaactcccttgctagcagagtatgaatcctaccacaagcaacagaaggagaaaattagattgtgttactcttgatgtcatagccactggattactgcacaagaaaaaaaaaaaaaaaaacaagaaaagaaaatggaaacttgaagagaacaaagagctgctggtattcacagtgttcttgctatatacatgatggattgccatggtaacaccagtatcatatgaatcatcttacatcggataccggcatacattgttcaaaaataacagcacaaaccagagcacatattttcagtcagggtagcagggggcaggagggcgatttaggaaaactgtttacctatcataagggtgagttaaataatttattatcgcacaactgactttgagacctccgtacgcgtatgtgtttgtgtatttctaacttttgcctgaattaaaaatcaatgagtaaatgccgtatgcttcagtaattcctcatagactatgacaaactgaagtttatacattttgtgagctggtttattgtgaattctcatacaatcacaagcttggatttcaagaaatcttaggagaattttgaacgttttcatcatgaaaattaggcaaattcattgttttttgattcaaccattgcttagaaagaaacatcagagcagtagaatttgtatgtttatactcgaggtcaattataaaacacagtacgttttagtgtaatttactagtactgcagaaatgtgaatattgctatagcaatgaaaaccaaccaacaaacacaaagacctttggggtggattatatgaaaaccagcaatgtggagatcacttcagaggctcttacagtagttcacatcagttggcaatattaataaagacagagtggaagggactcatataagaacattataggtaaaagaagacttgatgatgagagacagtgttaagataaaggaagatgactaaggtgactcctgtgtttctagtttagataactctgtagtaatcaatccaacaaagaaatagaagaaaaagaccagatggtaagagtaagatgatgagttcaattttggccatgagaacaactgaaataatttccaagcagttagtaggagtctaaaggggaggagtggtcagagcttgagatgtacatttggaagttgctgaaagaacttttttttaaataaagaactcattgcctgctaatggaatgaatttaatgtttctccaaaagggtacacatatatttactgtctgattacttttgtactctcagttgaaaaaaaatgaattttacaagaatttattgaatatctattatgtaccaggacccagacaaagcaccagacacataatggtttaaaacataggcttcaaccttgtttccatggtcctatgattgaacgtgggaggaagcccttaggccaataaaatacataaatatgtaattgcaattgtgacaactgctcaaaaggagacaagaacccagtaagagtacaaaaataggcacctaacatagtctgagcgtttggagaatatttccctggggatgatgaggcctgaggatgagtaacaacatgctctactgagaaccacatgaatgaagcactgaccatcttttcaaattcaatgcacattccatcttgtctgaggagctgattaccttttccttagacacctgtaacatccttctcatcaaatttcttcccttaggggcccttctctccatcaccactaaactattttccttcctagagcaaccttcttagggcaatatgaaacacaacattatgggccaagtccaaagtcctgactattgtttcaaaggctgttagtagattgttcaccttcttttgcctttgaaaggtgccatcctgagcctggaatgctttgtcagcattcgccacttcatttatcatagtttacaaagtacgataaaaggtgataacagaagctttccgtttgtagttcatccatgtaataattttcttcaacttaagagcaaagccatgaaaaactaaaaagaaagttccaaagaattattaagtaatttaatgtctcttattggatatagaaatgggactatcatataaaggtcatcaagattgtgtagtgtcttgtactttgctgacagtaaacattccaagtactctaacaattctcattccactccttttggcaagcgagaggctgcatggttgggtgatggataaatgctgaactgattgcagaacaaaggtcaacatttatgacagtttttattaaactctagcagttgggaatagatttgaaaactgacctttttcttttttaaatctcagttggaaaatattacctattgtttatttcaatgttttaaaaacctcaatgataaataagacacaaagaatatgtttttaaattgcattgccaatgaataaattaataaataatcacttgtttctctccaaaatgaaataaagaattattgggttaattagcatgtaagaaaacagtagtctcccctactcatcttctccagtttatttttgccactctcctctctgcctcattacacttcagacaccttatccttttagtttaacacatcagggcttcattcatgtggttctcagcagagtatgttgttactcatcctcaggcctcatcatccccagggaagcattctccaaacactcagactatgttaggtacttatttttatactctcactgggtccttgtttccttttgagcagttctcacaattgtaatcacatatttatgtattttgtaattgtaatgaaattgtccctgtcaggatttcacactgcttccttctgttggtgtagggattcattcttttccattccaattaatgcagcattccattgccaaattttttctgaaacaactctttccatcatgccactcttagggaggaggaaagatagaaaatatataaattaagatttattatgatagtgcagtaacagacacagaagaaaagaaaaacagctagttaaggaggcacttccatttggaaatagaaaattatgaaaggtcttctaggaaagatctgtggaatgatgggattcatcacaaaatgaggagagaatggaactctaggcaaaaaataggtatagctagtagttatttatacctaaaatacacagtatacatgggtgacaagggcaatttacaaggatgcagagatgtggaagggaatagatcatgatggctgggaatgtaacctttttttttttttttggtagccactgaaaagctagtggtataagcatggaagcgtcatgatggcattttagaaagtggatctgtggatgacagtcaggaagaggatgttgatagaacagagactagttataaagttagcggttttcaggcaagataacatgagggttggacccaagatggtagcagtggagatggcatcaaagggtgaggtgaaggaggaagagtgtacctgcaactggatagtggtagagtggttaggctgagggagaggaagcacttaggaggacttccaggtctgggccataagaaaaaaggacatgggagatggggaaggtccctgggtaatttttgtttcaaatctattgagtttggcagcactacatagagaagagaatggggaactggagatatacattcaagttaaatctgttactgctaataatttttacccagaagtagggagaattagaacaaattctgaggataatttgaagttttgtttaaagtgaaaggaagggcctctcatcaaagaaagtagtccctttgttttcaaagtttttccttcataaaacgtgttctttgctgtattcgtctgttctcatgctgctatgaaaaatatccaatactgggtaatttatatagaaaggatggttaactgactcacagttccacatggctgggaaggtctctggaaacttacaatcatggtggaaagcaaaggggaagaaaggcatcttcttcacagggcagcaggaaggagaaagagtgccaacaggggaaatgccagatgcttataaaaccatcagatttcagagtactcactcactatcacgagagcagcatggggaaactgcccccatgattcaattacctgctactagggtccctcccacagcatgtggagattaagggaactataattaaagatgagatgtgggtggggacacagccaaaccatatcatttgctattaggatgagctggttatgatgaaaacacacaagtagtcacacattcacaatcgatgggtccatgcatttaggcaagagttcagcagagcttcacataccaggccaacaggatggtcgcttaatatatgtaagtgtatgtgtaattttgcctagtattttcaccactacttgaaaagcatatctcaatgtttattacctagtctggagctacaataatgtatttgatcatttattcagctatctttaatgaaatcttagtagtctccctactgaaagaataataagccctgaaaatgcagtaaagccacactaattcagacaaatcagaagacaggatggtttgaattactgaatgctttatattattttaaaagtgtagcagttgtccatttttaaccaggcaagaaagtgttatcttgtgcttaccacaagaaaggtaaaagaaagtattttcatgaatacctaaaaaatatcaatcatctagatataaataaaggtcttaaaaaagctctgaagttctccctgatttaattgattcacataaggttttttccaccttagcactactgacattctgggtcaaataattttttgttgtgagaggctgtcgtgtgtattataggagatttaacatccctattctttacctacttgaaatcatcagctacttcccacttattacaataaaaaaagtccctagacattgccaaatgtcccctgcatgagaggtggagggtagaattgcgtcagttgaaaatcactacacccctcaataataattttaatacctccactcctcttgataaaagctataaaaaagcaaatgttagtctaggccacgtttgaatgattatagagttcaaaataaggtggttgaatttgataaagatttattgtttgcaatgtgtacttgtttttctttggtacagaaaatgggacgtattcttctccgcaatgcctccctcgtgcaggttcatgcccattattgagtccacttttatgaacatgaagccactaattattcaggattcacagtcggattactatctctctccacaatcattattagtaaatcatttcatgagcacaatttgttatgggctgaattgtgtctaccccaaaatttgtatgctgaagccctaaataccagtatctcagaatgagactatatttggagataggaccactaaagaggagattaaaatttaaataagcctttagggtgggccttaatccagtctgactgatgtccttataaaagcaggaaattttgacacatacagagatcccagcgatgcctgcgcacagaggaaaggccatgagataacacagtgagaaggtggccatctgcaagacaaccagagtcctaaggagaagccagacctgctgacaccttgaccttggatttcacagcttttggaattgtgagaaaacaaatttctgctgtttaagccaccaaatctgtagtattttcttatgaccgtcctaacaaattaatacaccatttgagtaaattaatagcttgatgattggtcataaatctaagtgcatgaccttgtgatcgttccacaagaagagagcaggctggtttaccttcactcacacttactgtattccttcctgtcttctggatcttcgtaccctgctttttttctgatcccagcgataatagggagagcaagcctacctaaaggatttagaaaaacagaggccagagagtataccagaacagctgcatcaccagaaagagggagcacagagcaggcagcaagggaaggaccctcaccagcactcccacaagcacccccctaccaccccaccctgccccgacagtaatggtgtcaagccaccaaaatgcagggaagaaggcggctgggtgaggtaaaacatgacacccggctgtgaaaagtagtgctcaagggcacttgctttccattgccttggggtgccagtggctactgtctcaccacattcactgctactagtttttattttccattttgattaaaaaaaaatgtgacttttacattatagcaagacaacagaactggggcttatatgtcataatttttataactgattttatgaaattttgtgcttctatcaaatttcttacattttcttacagttgcagtattgtttccctctaggaaattcccctctgccacctcccacagtgactttttctcctcctttctacaacttgaagctatacacacacacacacacacacacacacacacacacacacacacacacacacattacatatatacaaatatatacttttatgaatacagaagtgaattatttcaggttctcctttgctgacctggtaatgacaaaatgcatgatccccaaccacttaagccagtaatctaaagtcagtgctacatgcagtttctacagggaaacaaggaaagggaatttaattgatccaaatgaataacagaagcaaaaatcttgccaaagactccatactgtggcatacagggaagtgattttatacacacacacacacacacacacacacacacacacacacacacacacgcccctatgccaaaatatgtaccatgcattttctaatcatttatttattaaacaaacatttattatttaacctgttctgggctctatgctggacactggggaagtaacaacaaccaagacgtgatccacacactcaaaaactttacagtccaattgggtgaggatgggttagaagagccagattaaatctgatttttaaatctctgtatgaagggccaggcttgattgctcatgcctgtaatcccagcactttgggaggccaaggcaggagggtcatttgaggccaactgtttgagaagagcctgggcaacacagcaagacccagtctctctaaaaacaaacaaaaaaattagcctggcacagtgacctcaactacttggtaagctgaagtggatcatttgagcccaggagttctaggctgccctgatctatgattgctactgcactccagtctggccaacagacacagaccctgtctcaaaaaaaaaaaaaaaaaagaaattgctatactaaaattgagacataaaagcttcataaaattgaaagaaaattatatttcttacaaaagaaaaagtgggacagtacaatttacagaggctaccaaaaattaaaaggaaaacatttttaaatcgcaaatatagaaagtaattataatcacagatggtagggttgtcattctcgtcaacattgagtttacttaagatttagtatgttaactgctttcttgatgtcttcattgctgctcttgaaataaaaattgagaccaattaaatgatcatgtggtcatgtgtctaatctaggtgattttctaataatttgggaattatttccctgttttccaagaaaaacatgctgttctttcaagaagtcattattttataaggatatacttagctttaaatcgagctatgttttgcacttatgcatttgatttcctacttcattttctctatggattttcgtgaaaagccaattttttttatcttttattttttgtcccgcaatctctgcttctttgggtaggctgaaatatcaactcatagctactcttctttagatgtctttccctccctcccttccatccttccttcctcagatttttttaagtaattagaaaacaattttctttctgccaaaaaccacaaccgagatgatatgaaaataaacataaacatgctactttagataaatcttagtcccagcaagcattctgaaaaagaaccattcaaaacttaggtagattttagtgaatctaagatgatgactcaccattccaagtgtattgttttctcaacagattcaaaagaagttgaggttttaaaatttacaacttaagaaaatgagtaacagaataaaaagacaacctctatgatttggatgttcttccattcattcatccacccctctaactattgttttcattacatgtttgttgtcatatttatcctttcgtagaatgaaagctccagatgtaataagttaactttttatataaaatttatttaattgatttactagccataggtaagtaatgtattctactgaaagaaaagatggatctggtatttttacaaatcccaagacctatacaattaaatactaattattgtaaaatgcctttcaaatatattttcttgtaaaatacactgtgatgcccaattttaagcctaaataggtatatgtctgaaattttctgggtctatgcatatacacaatatacataaaaacataatttgactgacttgtacaaaaagttgattactttaaagcagaaaaattaaggtaatatgaacagggacattagatattcatgtggattttgcaacttgtatggatttgtagtatcgtcccaccaactaaagaagggaatgaggtaactgacagcaactgagccatgttgggtgtcttaggacacacttttctgaatgtattttaaaatagttgcttggtgctgctagccggtcataaagtcaaatagtgatagagctggacagaaaagccttgatactctggagaaaagaataaaatattgtctcacaaaaatcagaaagctttctgaaggtttagaaactttttaatcacttaaacatcccttcatgtttataataaggtgaaatctggcaaaatgcatgctttgtgagtttgtgtagatataattagaaaaagaaaagtagaagagtaagatagtaatgacagtttccaagtaaaatacattgcttttagaattttggattttcattatgtggattcataaaattagggagaaatggaattttcacagagagaatggaacatctttataaatgcttctgaagttcattgttaattgctgaagaaaatgacgttgtataaaaccaaaattgaggggtgacttttggacatattagttaactatatcatcgctattctgatactacataaaaagggtgggtcgggggtagaacacagatctaaaatgacaacttttttataggaaaaatacataaccttgttcttccctccctagcaactacaggaaaacaaatgtttttgtagaattataactcatttattgcattaatgtgttatgatgcattaaggaatgtcacatgtagattatgagttactgggcatctggtataaacagccatatagccatcaataaatatatccattatttggctaaatcctctttcaaattctcatcatgggtgattttgatggcaatacaagcactgacaatctctcaaattcttaaaatctacagaccttgaaaccagatcagcttttgctaaatagctaaactatttccagctttcctctctggttaatttttttcccaactatccagtgtgttgaataaaaactaacttctcaccctgaccctcccatttcagcagacatccaaagcagttaccaaagggcaacaaaacacattttcactgacaaacaactagaggaaaggaaagcagttaccgtctcctctgtggcttaatatcaattggcatgttgatcgcgtatggtgatccatgaacataagcgcttcggaatctagccaccttccccagagtcaggtactcacagctgcttggcaaactcattatatccaaaaggcaagaagtaaaagcaaatctgagtagtcagaccagcattcctgggaaggctggaaagaacatgtcagataatagatttcagacatatgctgctcactggttgcccggtgcttctttgcttcaaaagtaaacgcgtgtttctcggaggctaaatgtactaccttgttttctgttcattctgttcatggatacaagaagctttttgcttatttctaaccaggctcatgctctgaccaattattggctgagtagataaagcagaaattctgtagctccacaaaagcctatttccactcagaccaaatctctgagtaggcagcaaggttttatccatttttgtctaacgttgaaaagaacatcaacctaatgtaatagtagtttggtaatcagagttatttacctgtaaacaaagcatgcatatctgataggaaggaaataattatttgctatattttcgaagagggaatattgttcactaaactgttatagatacttagaaaatgagatgggtatatggaaatgttatgggcggttttccaattctctggtaaaaaaattgtgggttcttattcataaattactattcatgatagaactgaacttagcctctcaggaacataaaaacggtaagcaatgtctttattcactaaaacgttgatgatgatacacattttttttcctcgtttaaaacactctttgagaaatgcaccttctacctgcactttgaacgaagatctatggaatcattgatagtgaatgttactaattctttgtaagctgttttttcataacagtgaaaaataagttggagaaattagaaaggatattaaataattctactgaaggcagcagggtcttagagaaatgctgtatctttatcccacagtttttctagcctttatgccatttgctagagttatagcaacaaaaccacaagtgttcagggtaatgagagtagcaggtgttcagagtattctgtgagataatttttattttgaaaaattatttcttatccaggatttgaatagacacgccagtttatttaagcatcctgggacctgggtaaacatacagtgtgctgaaaaagggctacattttattcttcagtagccaaattcagacactgtttgggtttaaacagcagacactgttaaaatccagaaattttaagtttgaaagagtagataattttccttttttttaaatcttgtattttaggtttgggggtagatgtgaaggtttgttacataggtaaacttgtgccatgggggtttgttgtacagattatttcatcatccagatattaaacccagtacccaatagttaccttttctgcttctctccctcctcccaccttcaccctcaagtagaccccagggtctgtgtccttccttgtgttcatgagttctcatcatttatctcccacttgtaagtgagatcatgtggcatttggttttctgttcttgtgttagtttgctaaggataatagcctccagttccatccatgtccctgcaaaagacacgctctcattcttttttatggctgcatagtatttaccatttctattcaataattttctttcttatattttaggtttcaattacaaaattatacatgctatttttttaacatgccaaatgacacagaaatgtgaagataaaaaagattgctgtcttttcccttccttggtaggattaatgggagggaaaagacagcaaactttttatttatacaaatataaatataccacacacaatacacaaaccctcacacatgtatagggattctccttcctttttgaataaagtgggctcatactatgtataatcctttattaatattaagtcaatcatgaaaaaattatttttgtgaatgcacagagacctagtgagttcttttcaatagttatataagattccatggcataaatgtaccattatttattcaatgagtcctttattgacggacatataattttggactcatataaacaataaacacatttgctaatatattcttactgattggtgcttgtatttctgaaaatggattgctagcttacaaattgtgaacatttttccctttaataggctatggcagttcatattcccacagtcatgttggaagatgtcaactcctccacactcctgccaagactatccattgttattcaagtttatttctttatagtatgaaaataaggtaggcagctctctgaaatatccagtgattgcatacagttccttgatgaaataaaactactattaaggtgtcgcaaaagtaagaacagcctttctgaactgaaatatatattgggacataaataaacagcttagaaaggctttgcacaggtgtacaaaaggcagaagtctggagtctcatcagaatgagagaacactcaatgcaaagttagtaaatagtaaataatttttattaatttgcataattatgaagagaataaatatagcaaaaattctgttatgtttttactcttcagtatatttttcttaatgggaataatatttcataatttgggagaaacatcactaattttacaatatggatgtaatgcctaatgactgccaactaattgtgatgtatgactggggtgtaatttgtagattttgcataaagaggctctttggacatactccttcatttgagagtctgaagaacaaaagctcaatgaagcattttcacatgccagctaatttaggagattgcccagtagaagagaataagatttgcttcacataagaatttcctaggaggggtaacaatcagaaattgaagaataagatataaacctctatggtagagacctatgtgtcctatgatgggtaaaattccagagttttcttagcaggggcatttttgcttgtacccaggtaattatttaccaaaagcctggcaggggctcctggggattacctgtacttaaatttggatgagagaggattactgttaaactccagcctgccaagaattcagagtctgtgagaactctggccaactagcaggaggtggcccttaagggaagaaaatggaatctttctatcgtcaacaattccctttctctggggctggagagaggtagttggggacttgatctttaggaaaataagaacacattggagagtttaatttcatctaaagattagagctaccatccataccaggcctacctccaaataaggctcaaatcttattaaggaatggccatgattacccatctatgttttgtttgtttttgcatactgggatttctatggaagacaggtatagagtctagcaaaaatctcacttatcatccccatgattctatgctcttgagaacattaaaagaaaaggagaactcacatgaaagcatctggaacatcaattttcatcactatgctagacgttgcaacgttaataatgccctgcacagcaattaaaagtaattgccagcaagcagcaatttcaatccataggacttttcttctaataactggaataatacatattaattaaggttctttcagcctttaactctaccctggcctacgtttagcaattttaaatgctggaggaacttctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgttcctaaagaagtctcatctttaggatgaggttatcatctgttaatgaccacatcagagcataagaattgactgaacgatttcccctggcttatggcttggaagactccttccctccccaaccctcgtgttttctgctcatacctggactggagacccacaaaaattggggtttgcatctgctctcaattcttggagttgttcttgattttgatctctacacttactggtcaatgcatccaatgaattggctttaaatattctttatgtgctgaaaaactcccacctctttattcagagttcacatttttctgctgttaccatcagctgcacatgagaaaattccacttgtaagttccatagctagttcatttgagcatttataatgtaattcaaatcaactgtgttcctcccctcctccactccctctccccacatttcttcttatattccctagtactggccaccattcagccaataaccagacaataactgctaatcaggtcacaaaccctagagacatgaatactattgatagtaacaataatattaatagtcaatagataatagctaacactgatcagatgcattcaatgtgctaggcactgtggttggcaggttgactaattctcataaaatatgagttgggccctattattatactcatttttcagatgagaaaaacaagacactgagggataagatatatacccaaggtcacatagagtgttaagtggtggagtcagagttaggaaccaattcatctgattccagagaccagactatatcttctacctctctacacattctttaatctctctcaattatctttccccctatgttttgcctagagttaatatttccattttttcctcctcaaatctatccttcacttacctaccaagattatcttaaaatggaaatcttagcaaactcatgcaaggacatgaacatgtgagtcctttgcttgaaattatccaatagttccacattatttagtaatgaagttcaaaatttaaattccaatactcagcacagagatgctctattgttttgctctcccttcctctcctgtatcagccacaaataacacttggtagtgtctttcctgtacacagtctgttcttctggcccactggggcttcccaaatgataggtactctggcaagaacatttttctctttcttctctggctggctaattccttttaagcgtaatctcttccaaaaaacattcttcattcctcagttttacttagaagcctctcatctattttgccaactcacatgactttaccacactgtttcatagctgttcatgcatttacaactcttccccatgacttttcttgagggcaggaattctgccttctttgaccttgtaatccaggaacctaaaacaacatttgcttattgaacaagatagctgaaattgtaaggtcctgatgctccaaagaactgtccaagtctttcctgaactcccttctcagttactttcccaagaataataattataaatatttgacaactgaaatacattggaagtagtggagctattcatcatatgcaatcaaacagaaatactttgcaaagagtgcccaaaggaacatgagagcaacatcttttctcaggaagcaagggatgaatgtggattttaattagaggtgttggagatgtgcctgcctgggctatcagtttcagttcagtaaagaaaagttatccaaatacttgaataagctcagtataatgccattatttaatcaagctctgtgttttgagagtgtactggcaaattcaaaattaattaaacactcttctattaagggtcagctacttatgttcatacattagcttttcttgttaatctactcttaaacactgcatatattacactttgcagtcttacacacaatggctacagtcagaaggaaataacagtgcaaatgaagatttaactatcatgaaggtcatcacagtgtcttacaaaataataaaaagatgtaaatatctttaatgcccaactacttaaaataaggaatagccaatcaatgtgaatatcatgaatccattaaaataatgatattgaaaaacttccttggtatttatctaaatgagttgaaagcttacatccaaacaaaagtcttcatcaactgaaacaaacatactattctagtaaaagatgttaacattcagatggataagtagtttctcagaaattttattagcatgacctaatctctcagattgtaaaaactgttgagactgaattgtatgtcttcttcgaagttaaagaacataaaatcccataaatcagctagtcagcaggcccacttaattttataacaaggataacttttgatcaaatcaatcaactgttttgtttttataagcaggtaagtttgagatgaatgaagcataaggtctcatctttttaaaaatgctttattctccagctaatggagcctctttgagagcggtttctctcaaaatattattttactattaactgtcattgcctccaaaacccaacagaaacccgttggtcacataaaggcaagtttattaaacctacttaagtaaaggagaaaaccacatggacggataccttagaagaggaagttagtgaatcaggtatctaagtaagttttgtttgttctgctttgttaaatacaaggacagtaaattaggcctggtccaagtgccatttaacaggtaccggaaattatgctggtttcaattctcccatccaacaaaagcccttagctactggtaatcttatctcaacaaacctattatatatccaaagtttaggctgagctaaagcagcaacaaaaccaactgaataaaatgatgctcattcattgaaatttcaggtaggcccacacaattcatatttccaagctctttataagctgtttgaatgttaaatggagtggcattttgctttagaatgtatagaaatggaaacaaatgagtttaatatacacaacaggctttgacaacatgacttcttcgacagatgtcctatactacttcccacactttcatccttaaaaagcatagtctacttgccaagatacaaacggttgccaatattcagctgcaaaagaatttccaacagtaggaaccagtggaaagaattaaaacactttaaacttatttccaaataaccaaatgtatcattataaagttgtaagataaaaaataatcatgctgcaagttcttactctgtcaactagctagttcagcaaagaggaggggtctttggcaaacaaggctctatatttggttgccagatgacttttttaaatctatcaattcatttttctaccccaaccagccagccagcattaattgagcatgtactatgtatacacacaagaagtagatggcataactcctatctaggaaaaaaaaaaagcatacaattcatttgatgtgcaattcatgcatcaagacaggactgatttcaattgacaatattatgagatagaaataaaagtggtacagcatcagcgtattagtctgttctcatgctgctatgaagaaatgcctgagactgggtaatttataaagaaaagaggtttaattgactcacagttttgcatggctggggaagcctcaggaaacttacaatcatggcagaaggcacctcttcacagggtggcaggagagagaatgagtgccagcaggggaaacactagaagcttataaaaccagcagatctcatgagaaactcactatcacgacagctgcatgggggaaactgctcctatgattcagttacctcccaccgggtccctcccacaacacatggggattgttggctgaactataaaattggaactataggaattatagaaatgaactataattcaatgggaactaggattcaagatgagatatgggtgggtacacagccaaatcatatcagtaattctgttggaaaccttgtggctggctaacatcacatcaagcttaattcagcttgcaccatcatttactgctttttattgtatttttaatgttctctgtcctaaagtgaattctgaaccacaagataggaagatatatgacttgtctttaaattcaccacagtgccctgtacactgttctatatatattgctacagtgcctagtatgtgtctctgaaaatagtagatgcaaggtaaatatttattactaaaaagatgtgcaagcatattttacgtttgtcgagtttttaaactaggggactttactcttcagtttgtctgaatagtatacagctattgccctggaatgatgattaaatagtgcctccttttacttttgcaatattattgcttggattataaattatctggttatcttctggctctggaactgcacacttacaatgttgcctcaaccacttctgaatgcatctcagaggcaaagactgaggcttactcattattgcttctccaaatctatttctgtactccacctcttctagggtctgcatcaatgatccaaggaaaaaaaaacaaataatagagaaactcataataaactaaatcagattgaatacatctagaaaagaaacaaaagtgatccacatggagataaattaggcaggcaaatattgacctgaatgttctcctaaatgtaaatgatacaaaagttgtctccttgtatttaaatccatacagcagtgaaatatcattgtcattgtcaaatatctctagatccctgagtttattcagcataatttcaaagttatttgcttgcagggagagatcaagaatgaatatgttggggctgggtgcagtggctcacatctgtaatcccagcactttgggaagccgacgtgggtggattacttgaggtcaggaattcgagaccagcttgaccaccatggtgaaacctcgtctctaccaaaaatacaaaaattagctgtgcatggtggcacacacctgtaatcccagctacctcggaggctgaggcaggagaattgcttgaaccctgggagccagaggttgcagtgagtgaagatcgtgccactgcactccaacctgggtgacagagcaagactctgtcaaaaaaaaaaaaaaaaaaaagaatggggatgttggtttcagagccaagtgactttgggtcacaatgctgcgctgccataaatggcttcggtaaccctggggaagaaataacacctttctggtatcagtttccatgacacttaggccttattcactcattcaacaaatatttatcaagttactattctaggctctgggtacccagtagcaaatagaacacatgcaaatattcctgcctttatggagctgacattccagtagagataggtaaatggacatagtaagtaaaatatataagagaaatgataactgatacagaggaaaatacagcagggaaggagcccaaggagttcagggatggggtgagaagagggactgctttgctgccatggagcccttggggttgggatataggggacataggatgactgagaggctggtcttcctgtgatgactgactcaaaaagggataaaagggtagaaaacactctgtagaggtaagcagctaggtgcaggcatgggcagtggttggtacactgcttgttaaataaattaggaagtgagtgaatgaatgaataccttcaatagatattagctgccatcctaagatgtagcaaatctgtcacctgagaaaataatccaatgaagctaacgtcacctagagcttaaccattaagattctgtaagtttctaaactgaaacatctctcttaattaatgaaagagattcattttttcggtcatgattcattcctttcttgatagactattgctacgttatcactagataatttaatatatgcaattgtgatttagcagtcacttaaagttttcatattaaatttgatgaattaatcccaaatctaggtaacatagaatgtaaaggcaataatggaaaacataaagtggtgacaaattaagagtaaattagttacaagtagcctaagaccttactaactaccttaattatttagcaacagaaaccggtgctaacattttaaacacctttacttattcccatccaaaaaataatcagttacaaatgcatagaatagtcactactgataacaattacaactaatatctattgaacatttacttggtgccatcaagcactattctaagaatttttcatgtaacactggtcgcggtggctcacacctataatcccagcacttggggaggctgaggcgggcagatcatctgaggttgggagttcaagaccatcctgaccaacatggggaaaccccatctctactgaaaatacaaaattagctgtgcatagtggtgtatgcctctaatgccagctattcaggaggctgaggcaggagaattgcttgaacctgggaggcggaggttgtggtgagccgaggttgcaccactgcactccagcctgggcaacaaatgcgaaactccatcttgaaaaaaaaaattttcatgtaacagatcctcatagttaaaaggttcattagaagccatgggaaattcagtcttcccctaatgcatgaacagccttgaaggaaaaacaaatatctggttctggcatgaggagccctgcttcatggtatgcttatctttgagcagatttaaatgcttatctttgagcagatttaaatatcgaaaatttaaatattgaaaagtttgaagatttaaatattgaaaagttctttgtatcaaactaaatttcacctttctaaaagtgctattctttgatcatagtcattcaaaaacaagcctgagtcttatttatttatttagaagcagggtctcactctgtcacccaggcagaagtgcagtagtgtgatctcggctcattgcagcctccacagcctgggctccagcaatcctcccagctcagcctcctgagtagctggaattacaggtatgggccactgcacaagctaattttttaaaaatttttaggagagacagtgattcaccatgttgcccaggctggtcctgaactcctggactccagcgatacacctgccttggcctcccaaagtgctgcgattacaggcgtgagccactgcacctggccctgaatctttttaatatgaaaacctcagattatctaaacaggagtttttattctctcccttttccaggccacatcagtctcggttcttttggcagttccgaagacatcatgattcccagatgcttcaccatcctggcaacacccttctggactgattgctccttgttgatttcctcttaacctgtggtatctgaaatgaatcccacaccccaggtgtgatatgacgattgcagggcacagaatgtcagtcagcttaatttctctgctgtacatctatgaataaggcttaagacagaattcctcacatattcttcatttacatgccatcacccttgggcctctaccatccaattctaattaactgtgcacttgaaattgcagtcatttttattagcaagcttaaataactattgactctgactttgcattccagtgtatttactatctctttatgtttctgtatatttgtttgattggatgaacggtcttccatccaggcaaatatttagtctttactcagtattctttatctatgttgttcaactaggaaaaaacacacttaatagtatttttatccaattcacacatccattatagctaccacaagatacttttgcaaatattttaccaaaataaaaaatacactatttatacagcatattcctgagttaccagacaagtgatagtgagattatggctagttttgtgtaaagtgggaaatgcaaatgataacaatgggctttgggaccattttttattaatgaaagataaggctttgtgagagagaagtaaaagaaattataggcagtatcttggaagatcattcagatattaaattgactttgtaatatagaaaaccaatttagttgagaccaaggcagtgtaacttgtggggaacatcaaatagtgaacacagactggggaatgaaaatgtggtttgacaacatccaagttttcataatagataaactagggacaaatcagcaagttaacagcttaatacaaactcaaggaggtcaagttgcaacatcagggtctttgagctcattttcccttgaaagagattaaatgagagctcatactcactgtgaagagtgacacccagagaaaattcacaggagcacataatgtgagtgaacaaatatttaaataagttggtacctttttgcctggaggtaagaagacagcggtgatttaacaacatgttttggagactttctgcaaaaattaatgatgcctattacattctaccttctcttaggaaatataaaagtatgtgattttaaagaaaagcagagggaataggtgcagcaacctaggaaggttacctggcagtagagggtcattaagcactgggttcttgttggggaaattttcaaaatatcttcaaggacccatttgtccacacccaattgccatagaagttcacagaggaaaagcccaagctaagagtatatcatttatatcaccgaattagttgttggtagaagtcattggcccataccatcttgctacgaaaagcaactctttttaaccttttcccaccactatacaacattaaaaagtcaatcacttaattctaatttattttgaccttagaaaaacccagcagagtgggaaatttcaacagatacaagagaaaaataaaatggcccctgtcctcacaaagcttacaatactttttagaagaaatgacttaaacacaataaattctcagtcaatgtgagatagtacctactgtgtggctcaaacataaaatgttataagagttcagggaatgtaaaatcaatgctcgcatgaagtaaactaattcagtttacacaacgactcttttgctaatctcattccaggcagacgacagaatgcctgaaaaaaaattgattgcgtagtttctagaatatgaatttgacaatctgatcatttttcttatgaatagacacaaagaaatagataaagacagcaaatgttatactcaaaggcttacataatgttaccttcaaagatggcatatgtttgcactttattttttatttccataaaagaaatggcagaattcctgaacagcatgttccatttagaaataaaagcatgtactctctcgttctcctttccaatactggaaaatcaatagtgtgattatatggagacagaaaaggccgggtcatctgaactaacaatatcattgctattattaataataagagtgcagtatctagaatttatttaacgtgattattttgccatcatgaacaatgttaatccccacaagaacagatggtacaaccatattttaaattattcaatgaagtgtgttttttaaatcacaaatgtgtatgagcagagtggatgcatttgaaatttaacccttgcttatatttttgctgtcatacagtctaagagataaccagtcaatggagaagtggccttttctctctcttgaccttttggatacaatgatgatagaaaataggtaatgaggggaaaaaaaatcacagaatttcatatggaaatttttttaaagagagaaaacaagagaaataaatgacttgtttagggtggtacaagagggtaacactaaggtggcagtctcttctcagtgagctagtaaacattaaactattgagatcaaacaggaaggtatctaagcccactctccagtgcttttctgcaacgacacgctcttcacagggaactataattttagcgagctccatgaatacttagaagatcatgatagtcagggtacttgtcttttttgctttgggctattcatacttacagcatagtgagaaaacaagagaaagcttctctggggtttttctaaagatatcacatgcaaaccctgggcttggctacagaccttgggccttgctcatagatatggaaaaattggaatatgacattaatgccgaaagataacaaaggaaaatgctatgacctgaaaggtgtaggatagagtgggtaaattggtcctccttggatcaaatatggacagcaggcctgagtttgtccaacatatttttaattttgtttttccttttgatccaacatttaaagcacacagaaaatgtcacattaaagttgagatttgggcttcttttgaatgtttaggaggtttaaaaccttcagttcccagtcgggcgcggtggctcacgcctgtaatctcagcactttgggaggccgaggcgggcggatcacgaggtcaggagaacgagaccatcctggctaacacggtgaaaccccgtctctactaaaaacacaaaaaattagccgggcgtgatgtcaggtgcctgtagtcccagctactccggaggctgaggcaggagaatggcatgaacctgggaggcggagcttgcagtgagccgagatcgccccactgcactccagcctgggtgacagcgagagtccgcctcaaaaacaaacaaacaaacaaacaaaaatacctagagttcccctccctacatattgccagctatctccttcagatggggcaagcattctccagtttgacaatccccattcaagttctgtaactcagatacatttcttcctggttctgtaagtatttaatctgaaggcctttcaagtaaaactgagttaggaaaaagtaaatctgctaccacctggtcaaactcttaaccaaaacatctctaaaaccaagcacttttagagaatgtcctgtccttcccaccacaatttacttacctaccaggaactattttcaactctttacgaagcactaaacctgaattccaatcgatctggaattacctcatttgttatgtatcaaaaattctctaatatattatgaaaaaacctaggttttatttaccaatgtatgcctatatttaaatcaagataaataagtcaattttagtgaaggaagaatcattcagtaccacatttttcatgcattcaagaaacatatccagtttatgctggcaaatactcccccaatggtactgacatatattgttcatctggcttatggtgacatatctgaagtttctgataattctgttcccaacatttatatggtattaaattgaccctatgcaggctgaactgcctgaaaatacagattctgttgcaatttgtctgtagttgtaaagaaagtcgattatttaatcagaatttaagaagacttctacatgaccttgataataccaatgatttagtcaaaattatttgacataatacagacaaaaataacacagttaacagaatgtagcctttttgagtagtttccggcaacttgtaagcatagtttaaatccagtcttaatcaaatgcttcagattagcagaaattcatagtctgggaattatgtcatgttgcttatatagaatttatttatttatttatttacctacctatatggggaaacaggatataattcacttttgaaaaatatattactgccatctgcctcacaatataatttctttttgatggctagaaatactaaagaagaagaaaaagcatgatacacatcagtgatttttaaagcagtcttttgtctgccccatggtcatacatacctgagtgttgagtagctataaatgaattcccatggttggtttaaagatagagtccccagtaactaaataactgagctaatataatttgccagttttggcttctgatataacagaggcaattgtttaagaaagcgtaatgtgaaaatgttttaattaaaaatagctgcaaagacaatttaatttggtcattgtgctatatgtatacacatatattatataacatatacaatcttttatgtataaaaatatatagacaaatatcaatggatcattttatttatattcattataagtacttaagtaacttgataattttaacacttataagtgttacctatatagtaacaagagtgattcttcaaacatgtataccatatgcaaattcaaaccaatgtttcctaaatatttatttcaatgaaaaaaatatagtgaattctattaggattaaagacatttttgacattctctttgggaattatcattacagggcacttccagtgtgcataagaaaactgcctcttaattttatagttacttctcattttgactcaaaatagcattcgctaactggatcatcaactttaatcatcaggcttaatgccaaaggacttttggcagcttcatagaactagataaaccttcaacagatggagatttgtcatcaatgaatttcaaaaacatgtagcaaaggctcttttgaaggtaagttcaagaggggaatccctgaaatgtttgaacaatggcaatatccttgagatattactagtacggagctccccacaggcatcattgagaaaggctcaaactccattacattaatgggtaagttctgctgtgttctagccagtctttctgcctcttttctcttcggttcatgtgtgtttttaaaatagtaaaacaaaatgtgtgtaatttccagagtcaatgtcagaggttcacgctctgtttagactttttggttgtgcagattttaacataattgctaaaatgtctcatcagaaataatgaaaaatagttatcgctttcacattcctttagtgcacattcctttgcagcatccatgcaggtgcattagagatttgatttttggggaacctaatgagggtcagactggtcagcctgtgggtgctacatctgcagtttactaccccaatcctctggtgctgtgagatgggtcagacttggcagtggccaagattgatgttatgtagactttcgagttcatgaagcaaaatccaagaatcttaccttcactcaacatggctacaactgaatctatcagctgttcttccctgatttacctccctgtactttctcatctggtaaccttctagttattcttcaagattccactgtgatttctactccatgtgcaagattgcttgctggaatggagaaaaggtgagtgtagggaaggtaaagaaaacactccctcatttagctattaattcattaattatcaataaacactttttagggtgtccattgtgcaccaatcacacacttgggtctcatggatgaatatcacattgctcctgccctccaagggcccaccactgagggaaggagagagacaagtaaaccaagcacaatacagtgtacaaattatcacaggatagatgtatgggcttttaaacacagctaagaagaaaaggaatagtaattcatcggaatgaggaagtaacattagatatagctttgggacagtgcacagaatgtatgtaaaaaactttaagtacttttgtaattaatttgaaagaatctgattgtgttattgtaaaaatgtttaacagctttccaagcccattattgtgccaggattatacttcctgccccactgacaccaagctgatcttgcaacccactttggccaatggcatgtgcatggaagagatctgtggcatttctaaacagaagttttaaaaaatcactgtgtgcccctgccatctcccaatttcttctgccttctcaggatgggcagctcatttagggttggttccagaacaaaacgaacatatcaatatcatccagccaagaacaagtaatgagagcaagaaataagactgtggctgtagcaactgaaatatcagggtggtttgtaacctcagcctaattagtcaaaataagctgaaacaaagaagctcatcgtagtcaggggcagattttaagaagacgtgtatttctttattcaaagcaggctgacacacggatgttgagctggtaaaggctaaagtattttgtaaaataaaatggtaccttctctaacctttcataaggtttttgacaataagctttaagattctctggctgccaagtgaggtgggactctccatgccatgccccaatattccctcaaccacactgatgaggagattttgcctatttcccttctccatgttcatttccctggctctggggtctgttctcacacctgtctcttcccattgttactcccttagtaagcagtgcttgagagtgcaggttgagctggcaatgaagtcttttgaattttcaatacatctgggtattacttcaagtatcattataacaataatacactaaagtttgcaacagaaataattgcagccacaattcaaagaacactcttttgcagtggtaagtctcaaatgtgttttgttttgtttctgtatcaatatggagagtaaaaaggaagaatgtagaataatgtagtagaatgttgtagttttggaatatccctttttggcgggggaggtggaaggacatccaggctagagtgcagtggcacaatcgctgcaaccttgacttcaggactcacacgatcctcccatttcagcctcctgagtagctgatactacaggtgtatgccaccatgcccagctaatatttttttaaattttgtagagatggggtcttgctaagttgcctaggctagtcttgaacttctgggctcaagtgatcctcccgccttggcctcccaaagcactgggattacaggagtgagccaccattcccagcagctagggaatatcaacaacaacaaaaaactgctccccaggtgagtctgttataattttctgcctcccatccacatgttgtcttctgaccccaaatccagattgaaaggccctgcttcacatatgtgagagattacaaatcaaagaacaatgcttttgatgcataaaagcataaaaataccattagcagtcctgtgttccactgtgaacagcattaatgcccttcacccagagtgttccagcatcttcctgagttacctgagatcatcctgctttgtacatgttgctgggtttatgcctgtcttcttgtgaagttagtaatagtcccccttttactacttgagacagcaaattatttgatcactccaaatctaggttcattaccaagaaatgttgaggcccaggaaaagtttgtgctggaaattttccacagtgctccctcacattaagcagatatagtttttctcccaaatcgattccttctaacgtcgttataaaactttaaaaatgctctacccagtaaaaccttgaacccattgtgcaaaagtattccttatttaaccttggagcctttatatgaatttttcatattaaactcccttacttaactccctcttcttacctgccacaaatatctttactcatagcattcatggcttccttcataggacagagaaatgtatcaaatgattttagtttaggaaccaaaagaacaacactgttttcagcacgttaaaaatgcctatattctaacattggttaaattatgtaggttttctcagtctgaagtcttatgttggtgggggatatggcagggtgtgtaattagttaagagtggcaggaaaaaaaaaaccacctactttatggtccacccccattcccaatctccactacaaaacagggaggaagctccacagaactatgatttccttgaatcacttcaatttgtacaacactatatgcagaacttttatgaagcaaagatttgaactattaataatagctaacattgcagctacccaagggcacacatatctctaccaaatggaagctgactagcagaattcagtttctatgtgtttgccatttagcagttatttttccaccacttgggttataatgcaccatactgacatccagagcaatgccatttctgccttattttaagataaaatgctaaaccaaaagctctattctgactatgtaaatgatcgccttgtgccaactgattagcatttttaaggcaaaaaatttcaaagagatagcatgttacacacattacacttagcgtgaaagcaaataatatattggctaatgtttttgtagcaccacagtctttctctgacctatgaactataagtaagatggaatgtgttatttaagattttttctctaaaataagtttcaattcataacaataagttcacaactcaatcactctgtcagtattggctggtaacaaaaggaacctggtgggtcagcagtttagcactgagtacactgtgtccatctagtggccaaaaggtgactgagtgctctaaagaggtttcacagcataaagaataaaaggcaaggtggctggttttttaaaaacaactttaacccaaacactgtgcacacatttttaaattctaacaactattaatcaaatcactttcattttctgcaaagactacagcaaacgtccttcttctttcttctcaaatacttgagtccccacttcccacacacagcagatgatattcctactcaaagagaaaatagtaaccatcaaaaaggaacattctccatgtccagccatcaaaatgacaaacacatctactcccacagtcatcatttccattttccctcctgttaccaactcgggcaaatccttccacctgtgctttggttctttgtccttctcacattctctgatacgcagcttcatccatttttcccttactcttttcctcctctttaccaaatcttttccataagcacttatttttcactgtacaaaataagatccctctcaattcctacttccctatccagatacttcttacctcctcctcactctgagcataatttcttgaaataattttgtttatattcactatcttgattctccctttgtacttacacctcaacccacttcaatctggtttatgctcctactatatggaaatttctcccattgggtcaccaactgacttgtgtttcactaaaccaatgaacatttctgaagctattggccactccctcctttctgaaacactcctttcctttggcttccatagcacctaactttcttggttttcttcttaagtctctgttcatgtctttcatttcagctttgtcttcaaatattggcagttcttaggcttgagacaggactctcttgttctcctaatcttgcaccccctttagttgattttattgactcaaataacttctatgaccatctgtagatggatagctccccatcaatttctttggtctgcatctgcctcctgagctccagacacatacagcgcacctgactcctggacagctctccctggggataaccgacatatacctgaagttcaaccatggaactcttccttctccaatattccttctcactgtgattagaacctcagctacccagttgctctgttttgaatcctgaaaataatcctaaccctttcctcaatcttgtttcacagagtctctcaattaccaagacatgcagactccacctcctacctctatctctcagataagctcactttcctccattgcctctgctatcattctgctccataccaacaccgctgtctgtaataatcttctaaatggttccctgcttgcatcccaagtaattctatacaatgcagccactgactttaaaaaacacaaatgcccatgtcattccactgtaatgtcttccaatgagcttgacagccctcaaacattcttgaccttctttctcttgtatgtcacattccagttgtctacatctttagtttctaaaatatgcctcattttccttcccattgcacatgatctagaaaaaccttgtccaatccatgaggcccaggacggccttgaatgtggcccaacacaaactggtaaactttcttaaaacattgagattttttgtttgtgattcttttttttagttcatcagctattgttagtgtattttctgtgtagcccaagacaattcttccattgtggcccagggaagacagaagattggacacttctgatctagaatattcttcccctctccattgatacatttatattcacacttgaggttttagcctaaattttactttctcagtaaaccttcattgactacttctaacataagatccgcctctgccactcctatcaaggctttatcaaacagcttccgactaagctaaaagaaacactctatgcattttaaaagtagtgtatttaatagatctgattcattgcactggtgatggaagagttgaaatgccaaataggggactgtgaggcaacttaggggttagaaacaacaggaagcaactaccgcccctggactagagctaaaaaggagggctgatgtatgcaaggattagggtcacctagctaagggtgaagccatggaggagacacagctactgcctgaggtgctgcctcaggtagagagagtaaaacactctggcttctctctttctgcctctccccaaatgtccaccagtgcctccaatgtgctacatctatctaacaaaggacatggaagtcttgagaccacagccttcagagcgtagcctccaactataaagggcagagaaagggcaatatgtggtctgagaataaataggtaaaaggccaacacaaaaacattcatcacatttaatgtctttactcctaaagattttcttccagtccaaactgtaagaatcatgaggacaaggactatggcttaacagattttctcttttaaatagcaaagtgactgaaacaggcatatctcattttattgtgctttgttttgttgtgctttgcagagatggctttttttttttttttaacaaaatggtttgtggcaaccttgtgtagagcaagtctatgggtaccatttttctaacagcatgtgctcacttcatgtctctgtatcacattttgataattcttgcaatatttcaaacttttaaaattattttaatacctattatggtgatctgtaattgctgattgttgatgttactattgtaattgtttaggagtaccataagccatgcctatataagatggcaaactcaattaatgggtgttctgactgctccaccaactggccattccctatctctctctttctcctcagtcctccccatccctgagacacagcaatattgagattaggtcaattaatacaatgacctctaagtgttcaagtgaggtgaagagcagcacatctcttactttaaataaaaagctagaaaagattaagcttgcttagtaaggcatgtcaaaagtcaagacagacagaaagctaggcctcttgtaccaaacagccaagttgtgaatgcaaaagtaatattcttgaaggaaataaaaagtgctactccagtgaatacaaatgataagaaattgaaacagccttgttgctgaagtggagaaagtttgagtagtctggatagaagatcaaaccagccacaacattcccttaagaaaagcctaattcagaacaaggccttaactctcttcaattctataaagattgatagagatgaggaagctgcagaagaaaaggttgaagccagcagagactgtctcatgaggtttaaggaaaatgccatctccacaacacaaaaatgcaaagtgaagcagcaagtgctgatatcaaagctataggaagttatccagaagatcattgaaactacattaaacaacaaatttcaaatgtagacaaaacaaacttttattggaagaagatgccatttagcactttcacaactagaaagaataagtcaatgtttggcttcaaagattcaaaagacaggctgatcctcttgttaggggctaatgcagctgagggctttaagttgaagccaatgttcatttaccagtctaataatcctggggccattcagaattacaccaaatctattctgcctgtgcttgtgcctgaaacagcaaagcctagatggcagcacatctgttgacagcatgatttactagatattttaagcacactgttgagaactactgctcttatataaagatttttaaaaatatattactgctcattgacagtgcacctggtcatccaagagttctgatggatacatgatatggtttggctgtgtcgccacccaaatctcatcttgattgtaactcccacaattcccacatgtcgtgggagaaacctggtaggaggtgattgaattatgggggacaggtctttcctgcagcattctcatgatagtaaatgagtcttacaaaatctgatggttttaaaaacagaagtttccctgcataagctctctctttgcctgccgccatccatgtaagacgtgacttgctcctcctagccttccgccatgattgtgaggcctccccagccctgtggaattgtaagcctattaaacctctttttctccccagtctcaggtatgtctttatcaggagcatgaaaacagactaatagagtaaactggtaccagtagagtggtgcagtgccgaaaagatacctgaaagtgtggaagtgactttggaactggataacaggcagaggttggaacagttaggagggcttagaagaagacaggaaaatgtgggaaagtttgaaacttcctagagacatgttgagtggctttgacaaaaatgctgacagtgatatgaacaataaggtccaggctgaggtggtctcagatggagatgaggaactttttgggaactggagcaaaagtgactcttgttatgttttagcaaacagactgctggcattttacccctgccctagagatctgtggaactttgaacttgagggaggtgacttagggtatttggtggaagaaatttctaagcagcaaagcattcaagaggtgacttgggtgccgttaaaggcattcagttttataagggaagcagagcacaaaagtttggaaaatttgcagcctgacaatgcgatagaaaagaaaatcccattttctgtggagaaattcaagccagctgcagaaatctgcacaagtaacggggaaccaattgttaaccccaagacaacgaggaaaatgtctccagagcatgtctgaggtcttcatggcagcccctctcatcacaggcctggaggcctaggaggaaaaaaatggtttcatgggtcaggcccagggtcaccatgctgtgtacaggctagggacttggtgccctgtgtcccagccacttcagctgtgactaaaagtggccaaggtacagctcaggccatggattcagagggtgcaaaccccaagcttggcaacttccatgtggtgttgagcctgcaggtgcacagaagtcaagaattgaggtttgggaacctctgcctagatttcataggatgtatggaaatgccaggatgctcaggcaaaagtttgctgcagtggcagggccctcatggagaacctctgctatggcactgtggaagggaaatgtggggttggagcccccacacagagtccctactagggcactgtctagtggagctgttagaagagggctaccatcctccagatgccagaatggtaggtccactgacagtttgcgccatgtgtggaaaagcagcagacactcaacaccagcctgtgaaaacagccaggaaggaggctgcaccctgcagagccacaggggtggagccgcccaagaccatgggaacccaccctttgcgttaacatgacccaaatgtgagacatggagttaaaggagatcattttggagctttaagatttgactgccctgctggattttggacttgcatggggcctatggcccctttgttttggccaatttcttccatttggaatggtatttacccaatgcctgtacccccattgtatctaggaagtaactaacttacttttgattttacaggctcataggtagaagggactccccttgtctcagatgagatgtaggactgtggacttttgagataatgctgaaatgagttaagactttgggagactgttggggaggcatgattggttttgaaatgtgaggatatgagatttgggaggtaccaggggtggaatgatatggtttggctgtgtccccatccaaatctcatcctgaattataactccaacaattcccatgtgtcgtgggggaaacccagtgggaggtgattcaattatgggggcagctctttcctgtgctattctcctgatagtaaatgagtctcataagatctgatggctttaaaaatgggagtttccctgcacaagctctctctttgcttgctgccatccatgtaagatgtgacttgctcctccttgccctccgccatgactgtgagtccttcctagccatgtggagctgagtccattaaacctctttttcttcccagtctcgggtatttctttatcaacagcatgaaaacagactaatacaatacacaagattcatgttgtttttatgcttaacacaacattctttctgcagccatgattcaaagagtatttcaagtcttattatttaagaaatacatttgggaaggctactttctacagtgattcttctgatgtatatggataaagaaaattaaaaatctggataggagtcaccattctagatgccattaagaacattcatgattcatgggaggaggtcaaaatatcaacattaccaggagtttgagaaaagttgattccaaccctcatggataactttgaagggttcaagtgaaggaattaactgcagatatggtagaaatagcaagagaacaagcattggaagtggagcctgaagatgtgactgaattgctgcaatctcagcaacaaagagatgagcagttacttcttatagatgagcaaagaaagtggtttctcaagatgaaatctactaatggtaaagatgctataaaaattgttgaaatgacaataaaagatttaaaatattatataaacttagctgatacagcagcagttgggtttcagaggattgtctccaattttgaaagttctacattcggtaaaatcctatcaaacagtatattacatgttgcagagaagtcttttatgaagagaaaagtcaataaatgtggtaaactttattgttgcctggttttaagaaattgctacagcttctctgaccttcagcaaccgccaccctgatcaatcagtagccatcaacgtcaaggcaagacttcccaccagcaaaaagattactacttgctgaaggctcagatgatcataagcactttttagcaaggcaatattttaaaattaaggtatgcacgttgtcttctagacatgctattgaatacttaatagactatagtgtaaacataacttttgtatgtactggaaaaccaaaatgtgtgtgactcactttattggaatattcactttattttggtcatctgaaacccaacctaccatatctctgaaccctatacttaagagatgttcaggaaaagttggctgaatgggtaaatgaacacaataccattgttcacatttgcagatggtgcaaatgagacctatagaattcacgtctgtaatcccagcactttgggaggccgaggcaggtggatcacctgaggtcagaagctcaagaccagcctggccaacatggtgaaaccccatctcaagtaaaaatacaaaataaaaatggctgggcatggtggtgggcgcttgtaatcccagctactttgggaggctgaggcaggaaaatcgcttgaacccaggaaacggagtttgcagtgagctgagtttgtgccattgcattccagcctgggcaacaagagtgaaactctgtctaaaaaaaaagaaaaagaaaagaaagaaagaaaaacagaaagacaaaataagacaagaaaataacgacctacagtcccacagctaggaaaatgtgaaccgttaatgtgactctaatctgactccttattcttgttactggaccatattgacttctgatctgctttcttattattttgccttctaatacactatgatacatggatttaaaaagaacactcagccattctgtggttttgatacatagtgctgaaatcacatctttgattcttttactatttatgcacttaatgaacatttattaaacatgtaataaatttgataaaccaaaaactgtgtagaaagaaactattaattttgttcatcattgtattaccagaacttgggacatgtcttgcacatcataagccttcaatacatatttggtgaaagaatcattgcataagtaaatttcaatgacactaactgcttaagatacagagagagctcttgacattaaggaattctcagtgaaacctcactggaaatagtctatgaattaattaagagatactgaaggattttgaactgcagaggacataccactgaaacaaagtaggcgctacttgcctgctttctgaatctgctttgtttgttctctcaggctctgtctgtggctggaatccctacaccttctatcgttgttgaactgctttgcatgttaaaaaataacacattttgggaattaactgtacgattggttaagcaaggggataaaaacaaacccagattggtaccttgttaacctacaacgatttctggaccaggtaaatcctcaatctctcctctgccaaaagaaaatgacaacgcataaaaataatgcagaaagcttaactgacatagttctgtcagtgttactactctggatctgcaatgaaatctgattgcttgcacttacatgaaactttctcatggatattgcagcatccttccccaatctcatattttattggcaatgcaagaagacataatttgcatgagatgcagaaagtggtaaattagaaaaattaactacgaagttgtttgccaatagaggtttatatttatcttagtataaataatttaatgtgtattttccttcatgattgaatttataatgaatattcgatgattaatttatttttatagaataaaaactgtttttaatggcccttttaactgtactctctagctttggtttcagtgttatcaaagcagaaacatttactccatttctaagtattttgagaagataattctgttaaagtttaaacaatagtgtttttaaaaaccaggtgaactttttctccttaccctgtcttatgtactgaaaaaaccaggttaatttttaaaagtattcatttgggaagcaactttctgagaggcgaaatattcttacatcagaaaagacagaagcagaggctagtgcctggaatgtgtttgtctctatctcggtagttccaacagtgcttacctgtttcacattctatacattttggcttcaaatccagtggttgtcaactctggatgtaccttgccttgaaccctaactctggcaatttaatagaatcaaaatctctccaggctggggccaggtatcagtattttaatattacccaggtgaagctaatgtccagccaaggtttcactctaacaggaatttgagacagcttgtttggtcagatgatcctatgatactgaaatcatcccaaaggtagctagcagatattagtagtccaaagccctgtattagattttgactctaattctaataaactttgtggagctaatgaggcatccacttaatttactcaatctgttcaattcttttagttacggaaggaagctaattcagtcctgtgtggttgttaactaatcacagatctctaatcatctgacaaagttagagacacacatgccagaatactaaacatttctacaaaattttacatggcatcccctagagcatgtgaagtcagatatcaattcctctaaggttcgaggaggggatgccttgttaagacataaaaccaagaacaataactgactttataatgagtcaaactagccatcagtataaggaggccttctaacaattagaactgccctgtaatgttaagaagacattaaatgtgaaaaatgatgtccatatggaaaaaatacagaaaatagacataagtagaaagaaagtagaaaacagacaaaattatagtatatataccatatatgcttgatatatattgtatatacttttattaaatgtatatgttatatgattataaatgggaaagaaatattacaaaatgaaaaatccataggaaaatggattaaaactttactgtgaaagtattttaataaaagtataacaaatttttaatgtaaaattaaagtagacaaacattatgctaattaaaaagattttatcatcttccctttgtggaagacatagcaggataagacaatactaaattacttgggaaaaggcattgcagaaaccaactgtgttagaaaattaaacagttgtcacccaaccaccagatgatgtcaagatatcacatttgttactattcaaggctactcaggaacaatgatttaagcaagagaacaccatgagtggtactgtctgaacatgacctagatagctcatgctgggtcgtctggacaatatgctaacagttggcagtgtcccccagcccatctggagaggcctccctgaaatacagcttccaagaagacgggtgactgccttttcctggaaaaagggagctgcagctttccatgcttccttaaggtctccaagcctggacagctgactttcctagacaattcctataaagagttgacatctaaaccccaacagtctggtaaccaaaaggtttatctgtaccccaactgggcagattcccctttacattcaccctaaagaggagagcaagaggcatgatgcagggtcggggtggtacaagtctcctctcttctagccaacacttgattagtaaatcactcaaatcctgttcctaccccatactgtgtgctgttgcagcacatgtgctctgccaagatatgtgtcagccatgaaggaacacacttgtcctcaaggcaggatggagaggatgttagtttcctcaagcaaagtcaggaatgaatttactttaccattatgggctactttcaaatatctaagagtcctcttggggagcacgctgctttgttctgtttacaacttcatagagcaacatgtactgacataaatagctaagaaattttaggtaaaaaaaaaagtttgtttaaaagcatgttgtaaattaccattttagtaaaaaagattatatatatttacatgtatcaaaaatctaaatatgtatacaaaaactcttagaaatagttatctaagagagaagcgaagattataaacatctaagttatatttctgtagtgtttggatttttttttacaaaatgattataatatataatcaagcaaaaataaaagaaacatcaaaaaattaaatcaggttctctttagacacagttttaaaacttggtttcctaagggacactataaaacacagtcatttggtaattaagaaattatctctagaccatctggctacctaggtaggccaaaatgttttgacctttttgcctgtaatcagttaagaacaatgcaagttaataaaagcctagacagcttacagcctgaacttcataatttttccccaggagttgactaccagtgtaattattctcagttcagtcaaaatgttgtaattggtttatttgtgtaggcttcaactaatcattgcctcaaagaaaaccagatttttttcctgcttattactctttagacccccaatttatttctcctagtatgccatcctggaagttgaacagatttttctggaatctagttgtcctttccataggctctcagtagaaagggactccttctactcatgatatatctggcccttacttattgtccattttaataggtcttaatgcaataatagatttaatgtttaaaatttaatgaacaaaattactagcattttgttaacagatactggcctatgtgactggtagttgcaaactctcattcttaagaagtattcttagctattctatgatagtcagattaagtaatggaggcaaataacataagacaatattcatcacctgtttagaatgatcaaattaatgcatcaaagcagtgattttataatcaattgttcttcttctaaatgtgaagaaaacacttctaagaatagcaaatagaacaacttagcctaaattatctccatttcccttcttcaaattattttagtcttcattatcttattatatcatccaccaattgtgtcacttgcaaaactatttccttggattctaccaatccaccctggcaaaattagctagggtctctaggtagtaccaagataccccaggtgtgtcttggctcaagttgttggccaagcagatgatagggtggcatacatcattccaaaggacatgcatgctggtcctctaatttcctaagtagcatctccaacacatcagtatagttctgagcaccctggggttttgtgagaatcagatgagtacaaccccatattatcttatgaccatcttagttaagcagatcaatatttcttcctaaacatcaaaaatataccaccagcaacacttttctggccacagatggagggcccttgcaggtgtttgacttgtttagtccagcaaccagcatgaaatctactaaatggagcagagagcaaataggaagttgggctgggctggtaaatcaaagatacgtcttaggatttaaacccttcaatgatgtaatatttaacagtagaatgaactgtgtctttcatatgtactattttctgacattccattactgacagtagtatgtcataacagtgtttcaaaacaaagggagcagaatggaatgagcctaaggggataataacttgtaaaaagttaattgtaaaaaaaaaaactgcagacaaatttttcttttatcattaagtatttatttaaacttcatactgagagacccctctatttattcctgaatcctttacatataatcttgtaagcagttgcaatgactaaaatgtccttggttagtcattaaattcaattattgactgtatattgagaaggtgtaaatcatagttcaaggttaatttaggggtctcttattaggagttggatgaaatgaaatatatgtgttacataaattgctgactgagggaaaaatatacagttaaaataataatttggatggagatgcattcatatcatattgaaacatgacgtttgtttgtgaggacacaccatatggaaattccccaattccttatactttggttataaatctttactgattatagtaaccactgtttcaggtggttaacctagaaagcttcaagaaggaatggaaaatgagattaaactcacatacatagcatctccaaataaggtttcttaccagcgaaagaaaatcaaagattcacattataaaaattcattactgatgcaaacctggttcccatgatgtttctaggattaagagaggtaacagtccccgcactgaatcacatgctcattaagctttcccttaaagccaggtggccaaggtttcatctctgctaacaaaggtattcaaaggaatttatgataatcattctattgtttgaattttccattgctagataatgcaagtgctcagtgcagagagatttccttaaaaaatgtttctgctaggtcaaattagcacctgtacttggatgttcaagtcaacatttctttctaagtgtcactgatttagaacataagagtatgttagaatattaaaagatctcgggtgtggggaaaagcaagagagatcagattgtcactgtgtctgtgtagaaagaagtagacataggagactccattttgttctgcactaagaaaaattcttctgccttgagattctgttaatctgtgaccttacccccaaccccgtgctctctgaaatatgtgctgtgtcaaactcagggttgaatggattaagggttgtgcaagatgtgctttgttaaacagatgcttgaaggcagcatgctccttaagagtcatcaccactccctaatctcaagtacccagggacacaaaaactgcggaaggctgcagggacctctgcctaggaaagccaggtattgttcaaggtttctccccatgtgatagtctgaaatatggcctcgtgggaagggaaagacctgaccgtcccccagcccgacacccgtaaagggtctgtgctgaggaggattagtataagaggaaggcatgcctcttgcagttgagacaagaggaaggcatctgtctcctgcccctccctgggcaatggaatgtctcactataaaacccgattgtacgttccatctactgagatagggaaaaaccgccttaaggctggaggtgggacatgcgggcagcaatactgctttgtaaagcattgagatgtttatgtgtatgcatatctaaaagcacagcacttgattctttaccttgtctatgatgcaaagacctttgttcacgtgtttgtctgctgaccctctccccactattgccttgtgaccctgacacatccccctctcagagaaacacccacgaatgatcaataaatactaagggaactcagaggctggcgggatcctccatacgctgaacgctggttccctgggtccccttatttctttctctatactttgtctctgtgtctttttcttttccaagtctctcgttccacctaatgagaaacacccacaggtgtggaggggcaacccaccccttcactcgggtcatgcaggaatcatatgtgcaaaaataatgtgataaaaacacacctataaggtgaaaaacatctacgtatttgctataaatacacatactttgaatttctatattctggcaaaagcattggaggacaaaaaaaaaatcttttcaaaatacaaatttgaatatgtatgggcctcacttttccacccactaaagccaacctggttagcaggatatttcgaggattaagagcggtagcagtccctgcactgaatcacacacatccattaagctttctcttaaaattaggtggcttcccattgttcttagggtagaagacctaatatgtctataaggttttgctccagttggcctctgctctcctctctagcctcatctcaagttactggcttcctgttagctctcttcatctcagcctcaccagccctcccttggtaaaccgtactgtccattcagtactgtttcctacatcaggactttgcacatgctgttcccagacactcatctttttatttatttcattctcttgcttctcctaccaccatcaccacctacaccaccactaccatcaccaccttaaccactattacttttggaacacatatccatacatgtgcacatacacatatgtgcacacatgcatactctgaaactctcctcattgttacatcctaggagaaatatttcctgacattttacacataccctccctgttataaaatctcctggtactgtgtatatttactacacaacactgattttttaaaattttatacatatttttagacttttaatgtcaatttctccattaaagttggagttgtctgtttcttctcatcattatttacccaacatccagcatgaaaccaggatacagtggataataatacctaaacattgtttaaatggggcaatgaatgtttcaatcaatgaatcagtcacatctgcacacctctgtgatagatggattatctactgtgcaaaattcaacctgaagagagataaagaaaaagaccattcattgggctcaactattttgacatgactgggctaactgctttgcttatttaaatttaatatcagcaactgcccaaagtaggtattctgattccttttttacagatggagaatctcagactcaggtggacttagtaacccacccaaagacacgtttggtacgagagcaacatggttattctgttttgttttgtttttttagaattttctataaaattgtggcaccatgtttatatctgcattcaatgacatttacatataatttgaatttaggatgatcctattttgaagcacagaaattacttttgaatgctggctctagaaattatgaaaaatagaatataacaaaacctgaagaaagtaatacaacaaactgaaccagcattttagtgttgaaattttaatgaagtaaacatcttccatttaaattagcgtgtgtacaattagaattattaagaattaagtatgacttcagaacttaaaatacaatttcttaaaccaaaatttgttttagtttcagctcacccaatctgctaccttgcaaccacaaatgtgtttatgatttccccctccaaaaacctgcctctagttcagaagactcttcactgggtaattattttccacaagcccaaattgttttctgtggtatgaggctgggttcaatgctctttacacttttgcccatttgcagagatcagcatttcctttcgccagaatgctcctgctgacgagaatgctgttgggcctcccagaaagaaagcagagacagttcatttgaccactgcctgactcaaacctctgctactgtttttttctgtccagataagggagctaaagtcagcaataattggaaaaagaggctctcatttggtcctgttatgctactttttccagtaatttcaaacaacaaatatgtagcatttaatattatatgccagccctctaggaactgtgaatgaagtaaacaaaacttgaaatatgatcaatccttatccttgatgaacttgttagggaagatagaaccaatatacatggaagaatcagagaataatgaagtgagaaactaacatgggctgttacggggtgaatcctatacccaaaattcatacattgaagtcctcgtacatatacctccaaaatttgtacgttgaagtcctcgtacctcagaatatgactatatttggagacagggtttaaaggaggtgattaagttgaggtcataagtgtgggccctaatcaaatgtgacgttgttataagaggagctaaggacacagacacatacagaggaaagaccccgtgaaggaatagagagaagtcagccatctacaagctgaggagagaggcctcagaagaaaccaaccctgctctcttgacttcagacttccagcctccagaactatcagtaaatcaattcctactatttacgcttgcagtctgtggcactttgttatggcagcctcagaaaattaacacatggattctattaaaaaatgattttagggcaggaataaaccagtctgtgttcaaagacttgaggaaagctttgtacatgatatagggtctgagttgaatatagacaaaaactaaataaagcagagacagagggatgacattctaggacagcaggaaactcaatgagataagactagtaaatgggagagagaaatgatttagtaacaggtaatggtctctgaaaccttttaacctttgctatttgttcatcttaaatgttaatgtatttttaataatatatttactcacattggatagataatctcaatttatagtaaacaatgtcttgttactaaaagggctatgctgaagttaacagaaacatactatttaccatatatgtttaaatctcgaaatccacggccatataaaaaaggactatgaatttgggcaaaatgccattgaagcatacgtacaattgtattttgtatgttatttcatatgtacacaggaattgtacatggaaaatgagaaagagaagacataaaacatgaaataaattatgtttgagttcactggtatttcatttatccagattatacacatttattgtcaaaagctttatggatttttctgggtgaagtttatacatatattcatgatcatatgttacaaagcatttaagtatatagcttcatagctatacacatgaaattaaatattaaaaatactggtttttttttctaatttaaccctcttctagaaaaagatcaaaaaaaagttccctcagcatgtgcacatctgtttccattgaggattttaagaaaatgtttaaaagctgcatttaagtgaataatttccagcctgggaatggtgagccagctcagaaccaaaggctgttcatctaaccaataagcaggtgtaaatgaatatttcatgaacactgtctgtaattttctttttacttgcacggcaacaatccctccccaccctccccgcatcttcctgtactgttagtcctctctccaaaaagagaggggtgtttgaatgccacttaaaattcttaccagtatctggtatggtgtcattctttactgttcacattattttttatcttttggattttgctttcaaaagccatttgttctacatcaggcagctgcattttctttcagcattaaggaagaagaataccaaaagtacttacctaaaaaacaaaacacaaaaaagggaaagattaaagtatattcatggagatgcttgatgtcttgacaaagcaccaaagtggggatgaaaacacccatagcacctaatggcccatggcaaataaagcatgtaaagccaccaaggaatgactgtagaagttgcacccttgtctgaaacttaagacagcaaaaggggtatgccttggttattttaaaaatgaataggtaaagcaaagttttgattttcttttattttcacttttttaaacaacttacattatctcagactgtaatccatcacgtctctgtccttcaacaggttctaactgcctacaataatggcttttatcattatgagccagaagactttaatcataggcctaacttagagcttcaatgcaaccataggcctaacttagagcttagagcatcatgaagagtgcattgagatatgccagacactggtggctcatgagagaaacaagggctttgctaacagttgtcttcctaactatgaggcctcctgcaatatgagacattgtagtgttggtagaagggtctgctttcttagacatttttgcggtactaacatagatataaaaactaacacacggccaggtgcggtggctcatgcttgtaatcccagcactttgggaggcagaggtgggtggatcacgaggtcaggagatcgagaccgtcctggctaacacagtgaaactctgtctctactaaaaatacaaaaaaattagcagggcgtggtagcgggtgcctgtagtcccagctacttgggaggttgaggcaggagaatggcatgaaccaaggagacggaccttgcagtgagctgagatcacgccaccgcactccagcctggttgacagagtgagactccatctcaaaaaacaaacaaacaaacaaacaaaaaacaaaaactaacacacatagtcagatgtggcatacaaaagagaaaagtaatttttgtaaatatttaggaaaaaagaataaataataagtggcaaacatcagtagttttcatcaatgtgccatctgtgtatagatacgatgtctttgactgtctgctggtcacagaaagccctctacacaaggaaggcaggggatggccttgaacagtgctcctgagtgacagctctggaataggtgggagaaggcacagtgcatacccagcgaagaaatctgttcactctgtcagttaccaaaagccaaagaaaaacttcctccataggaaatgatttccccattccattcttgacaagcaagagctaacaaaagaaagagtcccaaaagaatatgggacttttgggagagtagaggagatctcatttacgaagaggagagaacatccacgtgctgatagcagcagctaatagagctgcctgatctggtgctggctgggcaaaccaacgctaaaggcagaagcacaaaaaggcattgcaccacaatcatctgggtgacttggtcaaaaccaagaagcacaaaaaggcattgtgcttcttgcttttgaccacgccagaaaggcattgggcgacttcgtcaaaaacatgatgttctcagggcccaccaagatagcatctctggaggtaagattttggaatttccatttttaataagcacccctggtaaattttatgtggttagctgggcaccagtctgcacacagagttttaagaatcacatgctagaaggtgtgggtctgtctcctgtaagtgctacctgtcagagactattctctgagaatgctgagtcacataatttggtcagaatttaatgaaactgcagggacagagatagggaatgtgcatttctcttccctatttaattctgcctcaccaacaaactgctggtaaggaaaaaaaaaatcacacaaaatatattatttgaattggtctgtgccactaaccaatgctgttgtccattcctactgtcccctggttcttgttaataagataacattctgtactcctactcatagagggcactattttcttgtcagttcatgctgttgcagacagttggtaattccaactaccaaaataccataatttcatcagtgaattaagccgagaaatagttttgaatattacagagtatatagtaagatcttccataaacctgagttgactaatttctagcatctcttgaccttcaatttcactaatactgtttagctagttcttgagctatttttatctgaataatgtaaattgagaaattgatttactttgtttttcaggaaatattttaattaatttataatatttctctgctttagacatttagaaatatttattttacttacaggatagatgttgtggcatatttaaaaggataaaaatgtacttcagaaaagttcacaaatttaattctatatataaagagatttgttttttcctaaggtgctccactattaaatgaaatataacttaaaaaaaatcagtcctaatatcagcaaactgtgaactgacctcaaagttaatatttacactcatcagaagctaaatggagccgagtgcaatggctcatacctgggatcccaaaatcccagcactctgggaggctgaggtgggaggattgcttaagcccagcagtttgagaccaggttaggccacatattgagaccctgtctctactaaaaattaaaaaatacatagccaggaatggtggcatgcatctgtggtcatagctactagggaggcagaggcaggaggactgcttgagcccaggaagtcaaggctacagtgagccatgatcctgccactgcactccagcctgggcaatagagtgaggccctgtctcaaaaagaaaaagaaaaagacactaaatggaatggaatgactttaattgcaggtgagcctgtattgccattttaaaagatttttccaagtctgtcttgacatagcattcattttgtatttcataaatgagaagactgtgaagattaaatcaaaaaagctaacagtgctggtcaggagctagaaaacttggggtggagcttgaggaaagaagactatgagaatgatttttaaaacatcatctatatcttagagcataaaatggggtaaagataaactattaactgacacagggtgcaaagcaccacaaagcagcacaaatagctttatagcttctgtaaatcctaaggatcttcctaagactcacatccctctacaccccttcaaatcagattattcatttccttttccctctctgctgtacaagtgacaacagctacaaaatgcatcacccaaagggaaggtcgttaaaaaggcctgaagaatataaagtgtcaagcagtttggctttaactgtggcctttgtctagcagcacatagagtgttgtctttttgttttcttcatttttaaggttgtagtataatatattacagcccaagaccaacagttacagcttccagaggtagctactccgtgattaagagaactcatttacagtatattccatattttttatataaaaaaattaaactgtacttgccttattccacattcaaatggttaatatataacaattatggatatgacataaatagccctaccagaggcaggtcagaatatatatgacagtagggagatgtgaaaaacacagagaaagagaagggaagagccaatttatgcaaaaagagaaatcacaccttctgctattactacatacggtcttggaaatataatattttattaaagtcaaatgaagcatactttgttagagtttagccagttcaactacaaagagtaaatacaaatctaaagtaaatatgcttgctgaccaaagcatccaatgacaatcttatttgaaatcataccacatattcgtatgactggaagccaacttgcatagcgctctttatacgcaaagactgattttatgctgggcacaggaaagaagagagagtggaaaggctggaagagaggtatgtcacatcaaccaacctcctaaacccagatggttttcatcatcataaatcatttccccaaaggcagcaacccatttcatttgctaacattgctcttgaacaacttgcctggcaagtagctttctcattaactttcaaagacatcctatccatgtcattcatctcctgcgaatatacgaatataacatttccattaccttgacttttaatttccccttcaaaataggaattttatgaattgatttgacaggtcatataagtctctttatactattcataaaacttgccttccaatatgctttgaaattaagattataagccagttccatattaacatactaatgcctacccaaaattatgctggagacagctggctaggcacaccaagcctaattaaagagctaatatttttacaaagggattaaaagttacttgagattgaataatacatcttaatgacttaaaaaaaagaactttggactagaaatgctctcaacataggaggaaagtaagggctaaaagcagattgtaggaaaaagattactttcttacttacataagatcctctctctttaatcccatcagacactataaacaggaggaagtttaatctagcaataagagcatgacttttattgtcagacaaagctaggttcatggcctttaatatagttatacccagtttgaatcattctgctttctcatgaaaaaaaaaaaaaaaaaaaagagaaaatatggaaagaaagaatgacctagaaaaaagtctagaatacaatacatactgaaaaaagactgtttcaggtcttttgctttctcacataaactagctcagtaaaccaaaatactctcatagtttcaactatactaatgcctctcaaatatatagtttagactctaatttctaatcaaagctttaattcttaatttcgagtggccagaatagagaaatcacataacttatcacattattacaataatgtttacaattcacctgggaattttaaaatgatatatacactaataattatatctaaagcctgtacttaattatgtcatttagaagactgtagacaacaccaagccactccatataatccaccaaaggtacttttccttcctataaaaaatgatcaggaagatttgatcaataattcttttatttttcaaggaggagaatttcttgtttgttgtggctaccatctcaaaatgccttatagtgtctctacttcaacaagaacatccctgtaccaatgattttcaatgtccagattcccagatgttattattcctgacaatgaatctgcatttgtttcagatgcatttaagaaatttgtgaagctagagctcatctaacctgtcatcattactcttcatcaccctcaagcaaatggtcaggctgaaagaatgatgcagaccactaaggaagccataaagtaaactatcagaagaaagtgactgaggagatttgcccagcttttcatcactcaacatatcagtccaagtgggacaacagaagtcagttctcctgaataaaaaaggcagcaacattgcaactgtgcctttgacagttcccatataaagcttagcttagaatttatagacaaaccagaatgtactctgggaatagtactcattcttaattcatttttctagaagaatttgtgttgactagaattttaaatgaaacagaaaggggcatgttcctatttaactaaaatcacggtgtgtgtgttattacaagggctagactgtagatggaactaagtggcataacactaacaagagcaattcagtgttatgttcaggttttttacattcctgctagtattttatttcttttaagttcattatatgccactgtgtacttattttaagttcagatatattatatgacaaagttaaccaagaatattttctttcaccaaaaataagactcaaaccctctttttctgcttaacatcaatcaaatctccaaaaagttaggagaatttggaaaggagtacagaaaagagtgaatgtgtctaccaaatacttctagctttcctttttctggtcacatggtaagattgcccttagcctcccctttggtatcctacatgaacatgggatatactttgaccaattattttaagcaaaagtggtatgtgtcacttctaggtgaaagttcaggcaacctgtgacggattcattacatcatttttccctggtgaagaagcctgagttgagataaagcatcaatcatcttgggtcccaggtttactacaataagtagagcctcttgccaatccctcttgggtatgtatgaagagaacaagaaataaaatttgttatattaagccacttagattttggattactgcagaataacctagactatcttgacttacataaaattaatcaaaataataaaatattaataactgaagtcataaaaagttttatgcaaaaaagttaattttttgcagtattaaattcaaaaatgaaaaccaactaagggtttgacttaattactatctacaactgtaggaacagtgttggttgggttttttttccccctaaaaaggtgtttaccattttgcaaaaggaatatttctgttaaacaaaggaaaccagcatgaaccaatataattttgagttggaagtaagagaaaataaaggaatcttcaagtcatgaaggaagaaggtgaaaccaaggaagggtaaaggatgaagacagtgtggtctccttcctagataactgtaataaggaccatacttctatcactcctggattatttccactggcaaccgttagagaattttagactttagaataaagctgagggatcctcagagggaactgtgcattagcttacggggcctgcaaacggacaaggccagtggctaaattatgtgtacctaggtacacctttcagagaagacatatagctttattcagattctcaaaggggtctctaaccccaaataaggctaagaaccatggttatatattaaccccacttgaaatagggtattataaagcataatctcagttttctacaactgtcttggggataacaaatctgtagtcttactttcactctcaagtcaatgtaggagatggcaagaatttttacttttcccaccttaaactacctattagttttgcagagcaggaaccataacttgaattctaaccaagaaattaatcagagttaactttaagaggtttagagaaaatatcttaaaggggctgggggctctcagttttttaccctatccctaaggtccattcttgtctcccagtaaaaagattaacaacaacaaaaaggttggcttagcctcttacacagtgcttttttaggctttcagaatctaaactttccagactcagtcgttgtagggctcaggcttgttgactgctgtatgcctcaatgtccccaagctcccagagtcttcccactgactactcatggcaaaaaggaaattagagggcaggcttgtctttaaaatttctctttttttcccctccacaattctgtttgtttccattttattattaataccatataaaatagagttatacaatgaatatgtaaagaacacaaactgatgttttcaaaaacttttccaagcatgtcactcaaagacagaaagcaaggttcttaaggcatgattatgttgatcataggctagggaaagaatcagaagcacgagtttcctcccaccaacctattctcccttccctctattttatgaagaaaatagtggccttaaaatttaactgagttctgtttctggatacagtgaaattgcttatggaaaagcagcactctcaccaagaacacaaaatggtaaaaaaacaaaacagacaaaacctaatcttatgtgatgtggtgggaggggactggggtatggtaccagggacttctgggagaattgacaatgttctatttcctgatcaggatggagattacatagatgtgttcactttgcaggaattcatcaaactgtaaacctataatttggtactttatgtaggatatatttcagtaacatatttatctttaaaaaatgctaacttattttagcaggcctagtgaatacctggaaatacatcatttgtaaaatccaagcatatgtacattttctctgagaagcttaacttttagacattctactgcatgtgttcaaatttactcccactgtaattattctctcctggcagttttacataagccttagtgagagatagtctcctttggctggtaagttcatgagcaacacaatcttgcataaagtaatgcccatctgacactgcatttacctttaatatagattatggttatatactttggaaaactgcattgcatgtggtcaaatgtccatctcctcccatccctataactcatttatcagtttcatgatggcagaaaggagattttctatctatccaaaaattacaaaataaatatcctgttctaaattttaagtagacaaaattttgaaacattgcttgcaaactacacttattaatagcattacagcacgtaacaataaatcactttggaaggtaattgaatctcataagtttcaataatttataagaaaatatccagagataatagtaacacatgaaaaagaacaataggaccaacagtctacaaataaaagctagggaacacaaaaatgacacaattatcaaattcaagaatttgaatttctattcacaattgacagaatatataaaggcaactgtaaaaaccacctacaaaaaattaaaatgagaatattagaaaaaatttggtagtgatactgagtaaaggatttctgtaacttgtttaattgtactgagcagcagcagctattacattgattttactcttataaaacaatttataaattttattcttaaaaaacaaaaggacatattagtgctataaaatattaactaacctgcacaatgtgcacatgtaccctaaaacttagagtataataaaaaaaaaaaaaaaaaaaaattaaagaatctctacaaaatatgcttacttatatacctaataaatcaatgagggctaaaataaaagtgtatgtaatttaataagatgaaaaaatacattggctaggttcaggtaagaaactcttagatattttaaaatactacatttaggctattattaaaaagttaaaaaacaacagatactggcaggattgtggaggaaattgactgcttatacgctgttggtggacatgtaaattacttcagccactgtgaaaagtagtttggagatttctcaaagaacttaaaacagaggtaccattcaacctagcaatcccattactgggtatatgcccaaagaatacaaatcattccaccaaaaagacacatgcactcatatgttcatctccacactgttcacaatagcaaagacatgaaacccaccctatcagtggtggtttggataaagaaaatgtggtacaaatacaccatgaaatactatgcagccataaaaaagagcaaaatcatgtcctctgcagcaacatggatgcaactggaggccataatcctaagcaaattaatgctggaacataaaaccaaataccacacgctctcacttgtaagtgggagctaaacaccgagtacacatggacggaaacatgggaacaacagatactgcagactactagaaggggaagggagggaggagagtttgggtgggaaaactacttattggatgctatgctcactatctgggtgacagagtccatactccaaatctcagcatcatacaatatacccatgtaacaaacctgcacatgtgccccctgtatctaaaataaaagttaaaattaaaacaaaacactatacttagttgataacatttaataattaccatcatatgggaatatttacatctattttttcaggcattagtaattcttgccagagtattatctaattggaaatggtaagaatttgtatgagcacggatttgaggtttataacaacattacttttttcagatagattgtaaacatctagacttaattcagaaataagatttcagaggaaatgtagaaattatctaaaaggacaacctgtttttaagaacttctgaagtttctgtttatgtttgaaaaatggatacactaaccacaaatcattgtatcttctttttaaattgggtacagaaagatcctctatttgtcaataatttaaatatcttaattagttttctaaacgttcaaaatccttttagaaaacagttcatcaattacataccacagacactaaatctacagtttttgtgtatgtgtgcatatgttcaccaatttcaattaaaatctatgacaaaattaaagaaattatttttggttttggaagacataaaataactgaggattatggaagtctactatttaaataaatataagtattaaaaactatctatttgacttagttaactagatttctcctgagccacattcaactagaaaagtagcacttaacatataacctgctcctgtcaatgaattcttcataaaattttcaataaatcacagtataacattttagtaataagtatcttaaaatttgaggttcaatgatgtgcataactgtatgctcatagtaacctctgttattcaaaaatatctgttgcttttgggtgatacacaagaaacacgtcataaaatatgacaaaaaagcattgttaacatgacaaaagtattcagtgcacaaggcaaaggcatctactcagagttgctattgatggtttgggtcctagcttcatattacaattacctggggagtttcttaaaaatactgatgctcaggccccatgctcagagattctaaatcacttggcctagagtttccaggacttttgcatactttacaatgctccctggagagttcctaagcaccgtcatggttgggaggctcatgacataacagcttttaagtagctactgtactacatccacagtctacccttactagctatggttaaccctaaacaattccagataaataaataactagatttcagactagttacctttatctggcctcagaagaaagaaaggtgaaatcatacgtattttctattttttaatccttccaacctggataataattccaaatttcccatttacatttttgccttgagtctgcatatttcaaacagagctcatgaccaacaggaaggttgtgaaacaaatttcatgtgttgtgacaaactttaaaacaaacagaatagagatcatcacatgtatcagagatcatcacatgtagtaagagtaagcaggattttgtgaaacttttgtctcagttgaatatacatatatgtgtatgaatacatatgccgagtggtaaaataaaccgtatttttacaatagattgttgggttctcagctgattccagctgcttgtccttttctcactgtctgaaaactgatactcttcgacaatgtcatgaaaagaagtttatttagtcataagcttaatcaagacagtactgaactcataaaaaatcttctgagagaataatcatggcatatatcttgtaaattcagactacagtggggagagtatgcacattaacttataatttctatgccaagcatttttttttggctctttctccaaacattttactaatatcttacggcatacagattggtctcttggtctcccaacttacaggagacattttttggaggttgtatttttaattttttttcaatattgaaaaattttataggcatgagcatttcaataacttcattaaagaagaaattctccaagatttttgttcatgaatattatagtactccaagcttttttttttaattcaaactgttcagtaatagttttcagtttgcaaagttatcaaaaaggatagaatagtttacattagaataaatgtaacattagaataaatgcaacattattgttcatatacatggaaagtatatatttttatttgaataactatcctttcaagaagatcatattacaatgaagataatgttcccacgtactctctgaatagtctgagatttaataaaaatgccatctgccaatgtcacagattacctcccttatctatttcccactaccacccaacacccaggttctggtccaacccagaccactcaagagtgcttctgcttcccttcattcacgatgggcactgtagtcacatcatcatggcatgtggccatgttgggtcactgagattcactgagaggttaatgggtccaatatgccaggatgggaataccccatgaagccaggcattattttccaatatgacatttttcttaaattactttgtatctttccaataagtctctttttacttgatccaattaataggtttctgttcactcattcatttattgagcagttactgtgtgccagacaggtgataataaccaatagggcagtgtagttcctgcctttgtgtcatttactttattacaataaaacttgccctgattaaaacaatttatgttattctcctcccttgaaatggattttaagtcaaggccaatcggctttagtgtttgcagagtaaccaggacagcaatgaccagggcagtgtcatgcacatgaacttggtgaccacttgcacagcagaatgttcctgaaggctctttgtctctatttgcagtagaagtcctaacaaggccaaggacaaaacaatagatggcaaatattcctacactctggagttgctgcaacatctggtaggacttgcaaaggcgcagctattctgaccgttagcttataccccacatacagcctttaaaagaggtcaaagggagacaaaaaatcctagagaggatttctttttagagtcccattggcatgctaagacctaactctttattggattttaatgacagtggagggaaaggcaaatgttttctgactttgctgtatgagtcttgcttgttcaatatggcagttaaactttttaatagactggggagtaatacaatgtagtccaaaaaaaaaaaaaagttcgagtcaagaagcctagtctgcagttggtcaccccttagccatatgtcctgaatatatcattcacttctctgagactcacctgcttcatctctaaaatgggagttgaattagacccatggaacccttcaagtggaaatctccataatttctgacccctattccctgctctatgggtgcatttgggtggtggtaaggaaaggctgctccagcggtagagttttaaaatcccggaacctgcctgagtctccacacttctgtggtctcctccaacatgaagccttcatgatttgacttttcttggaaatcaagacctttggtcatttcgttgttcccatcactgtcattattgaccacagtccctttgttgaagccattcatcatctggctcttctcatttcccctataaaatttttcagtattgaaaaaaaaattaaaaatacaacctccaaaaaatgtctcctgcaagttgggagaccaatctgtatgccgtaagatattagtaaaatatttagagaaagagccaaaaaaaaatctttggcatagaaattataagttaatttgcataccttccccactgcagtctgaatcaaaaagcatggtttttctctacatcctttgtgcttacaaaacccacttcttcaggaaaaaagaaaaataataaaaaaaaatttcttttcaactctcacattttaagtacctgccttagacctaagagtaagtctctaggctagctacaacatccccttaacattcataccctctccagcttgtgaattaacaaaatgacagatattttttcatagttgaacttatttggcttattaggcttctcctattctagagcattacatattttaattccttaatacttttggaaagttgcttcaattaattaagtgatgatgtgtttgttgaaacatgctggtttaaccattgtctactggtctcttctttttaaaagaatgtaagggcaatgagaagagccacttattgtggcattgttcttttaaatactgcctttaaaatgaccttcttttacagttgtaaagtgctaaagaaaatcattttgcaatgctatttcagatattcaggcaaaatcatccctgtagtgataaaagaatatgcccttagaaattcaagatttttcataaaaaatattcaacagaagtcaaagaaataaaaggaaaaaggtgattcgcccttgttgtgtctgaaatggacccatagaagttattgtgatgccttagtaaataaggattatttttagaatggtgtacacatcattatcataacagggcaaaattttttgattcttgcttaatggtcattagcaataatggactctaaatcttcaaatcacaaatttccttcttatgctcctctctaataataaccatcatttttctatttcctacataaatctactattttacatatgaataaatatacatggtgggatgattgattttatgtgtcaatttgactgggtcactgggtgcccagatatttaattaacatcatctggggtatgtgtgtgagggtgtttttggataagagtaacatttgaactggtagactgaggaaagcggttactctcctacatttggatggccctcatccaatcagctgaaggcctgcatagaacataaaggctgaaccttccacaagtaagagaggattcctcctgcctgcctgagctgggaggttggttttttcctgcctttggacatgaactgaaacatttgctccttttgggtatcaagcctgccagctttcagactggaacttataccagcagctctcctgggtctccagcttattggctgcagatcttggaacttctcagtctctgtagctgtgggagtaaattccttaaaataaatctctttctatgtatgcatatatcatataggttctgtcctttgaagaaccctgactaataaacatagaaataaattttcaaatctattaaataagtaaatatgtatctcacatataaacttgagcccatccccctctctggaattccataaaaaataattttcatagcctttaaaatcctctacagttccaaggacctgcccagggcaaggagactgaaactttttatttttaactctttttttcttacaattttattttttaggggtgtatttttaggaggagctaccagcagaactatatcccagcattgctgatactaaggtaatgcccgtttactttcctctgttttgtgtggctcattgcaaccagggactggaggtggtggtggaggagcaggagagtaagtgggggttctggatggtaccaaaatgaccacatacaaagacagcacaacctgctaaggctgcaacctgctaaggctggatgtctggcaacagtggcctctatccacacagtgctcaggatgcaagttgctttttagggacacctttgctgctccctttacctttaaggctgagtgttacatttccagaaagaggtataccctcttcttccatattaaagctaattttaactaagtgacaaacatcactagcataaacataaaactgaataaatgcagcaaagattattatggtctctgtttgaagagacagtgtaactacaacttagcagaacacaatttattgtgacttggggaaaggcagagtatggtttttgcttgggccccacctgggcagggctgactcccagctcctctggttatgttctgcttcccaatatcatcaactactgagaatcccaactatgtaaaacatccctggggaattccactagggtctaggcttttccatgacaggcaggttcttagaaacaagtcaaaactatggtttttgaggggcttcccctccaagccaaatgttttcatctaaataccagcactaactggtgattcagtatctgatgaataatgcttatgtttttatgctcaacttgtaatggactataattgtctacagacaaccacttagcatatctttatctttgcagactggctctgtaaatgtcatatctttgtgaatacttgactcccctatcatttgagtgtctgtgcctattaagttctgtatattgaaaaattctagataatctagaccagttaaagcccccactgaaacactgtgtggagccagacctcatttccttattttccttctagaacaaacaaatgaagcaggtgcaatgatgtccgttccccttctttcatcccaccctgagtcaatggcagcagcaaacccaaagttactgcaccttcattcctgtgataccgattttaatctcactacatttaatttcactacatttctgagacaaagtaacatacatactagcaaaagctgcagactacaagttagcagcctgtagtttaagcttcaattctgacagtaactgtctggctctagtgaaaccatttagtcatttgtttcacattttctcatctgtaaaatgtaatgtgggtcaactctgaatttctctgagagttctaaaagtctacgattcaccaaccacaacttgacaaccagtaatatccaccatgatgcatgagactcaagctaataaaccaattagttaagcaatccccatggcaaaatcagatccagttttggatcacttttttaaaataattccaagaaaccccagtctcctagggaagactaggatgtaatagattctgaaggtcatagagattaaagcaaattatattgtggtactatctgcaatatctggtgggtttttataacctacctagccactagcacagtggcttttagaagacacagtaagtagttacttgttatttgactgaggaacagataaaaagatgatgactctatcatctattagtattcaggaaactatgaaatgaatatacagtgcatccagtgatttgtgcaatgtgtcagccatctgggctttattttcactgtacgccaccgttatttattaaagagtagaaatgattaacacagagacatctggccctgcttatatacccacactgcaagtttttaaaaaaagatatacccaggaaattaacattcatatttggatacaaaagtctggattgaattttgttttttagatttatgtctctaccagtaaggttttacaaaataaactctcttctcaagaatgatgctttgaagaaaggctactaccaaacttagcagttacatatttttaggtttattatataaatataaatatatataaacatatacaaatgtaaaataagttatacacaatcttactgcagaatagtttttctagaagaaatgccctgattggaaccaagaaggtaaaatctctaaatgctttcattttgcataagattagagcctacactgtcagaaaatgattaacactcagacattctcactactgtcaaaatactgcacaaagagagagaatgcaggattgccaggggcattcccagctccctgacgtcaattcagatcaaattcagataacttactatgccagctgcttgatttttccgttttgtgaaaatcctattctctttaaaatgagtttgctatctaaataccatcaaagctactttgaaatattgggaaaagggtttaagcttttttttaatgcttttcacctccctcctcatgacaacaagcttgtagagaatgatcaactccttctgattccttcaattattatcactatcatgatataaaatattttttctggactctatagtttgatgtagagtgaaagacaatctgcactctgttaaaatttatcttgtataggttcatggatatggtttggttagagactttgtaatagatgtggcacctctgggcttctgaaaagaatgtcatctaggaaaccacattatttgattccttggctccaccctcccaactcctgtcctcaccatcctgttgtcttttctctgtggcactatctaatgccacaatagacttcccatggttgctctccagaaatagaagaagcttttggatatttgaaatacataccatcttaactactcctgctctaacagcaacaaacttttcatcttagttgcaattgatgtttttctgtgccttcttgtatgaattctttacaggttaataataacatacaacacttataaaatacttcccatgtgccctattgcatgctttatacatgttttatttcagttaactatcacaatacatttattaaatagacattattattatccccattttacaggtgaagaaatgtagacccatagctgttaaatgactcgccaatgtcatacaacatgcaaggagtggagctgaggtttaaagatgtactcaggttaatatgttcttaaccaccagtgtacattacttccctttctgagcatacaaagtacataggagacatggcctatggagcgttaatgcattaaatatacaatgccctgttaaagtgactgaaaaatactaggtttttattaagcatttattgtaggtcaatacttgacatgcttgtattattgtgggaagtaaaatgaaaatcataaaatgttttctccctgcatcaagaacttaactttaagaatacaattttattttgcaaaaatagttaataggccttcttgttttagtttccagcctaagagttgtctatcaggaatgcatagaagtagaagataataggaatcatatgtccatcatttaaatatgtaagatcatctttttaacacctgtgatctaaactgaaacaagcaaacaaaatcctagtcagtatggagatgggggagaaacaaatttctagattgaaaacagaaggcaaaggagcgtctaagaagagatgtaacaatgatgctttttcaggataagaaatgcttcatgagaaggtatttcaagcatcctgggaaaggtgagcgaaacttctactgggagtgaaaggcaggggaggaatttcaagttgataggacattaactgcagagaaatagaaatagctaaagaaataagcatttgaggtttttttcgtgttcagttaagaggaaataagtaggtaaaacttgaaaatactgactgaaagccaagaaccagactcacagcacaagggacttgctgagtgaccttggacaagctacttaaattcagcttcctcatgggtcagacgatgctatcagccctatcattttcctagttagttattagtctatttgattaaatgcacagtggttccagaaagcatttaaggcagtttataaaaatacataaactaagatagcactaataaaaagtaatcaggaaggagagcaacacaaaaaacatgccggaaaggaggctaaaacaaaaaggcacatcatgaagacttagtccctggctatgaatttgactctgagtttcaaagcaacctctgaattagtgaaatctggtgagttacagacgttaggaggagaaatagctcccttctagcactgaaagcatccagtgagatcccgcatgtaacaaatgcttatttccttctcattcctcttttccatgaaatggcaggaagtgccagatccctttagagagctaccacaagtgactgtctgccatagtatttcttccctgccttcccctctgcacatcagacacacagtgtgtacacagagacacagagacaccacactcacaccccacactgcagggagcattccagagctgactactaaggcttggggtctaggtgctccctagttccctcagttttcaccccggtcactatttacccgtggagacagacatcccagataaatcttctgacatcatcaagagccaaaaaaaaaaaaaaaaaaaaaatgtgtaactgttgaagcaatgtaaaatataatgaattttaaagtgttgccatttctaaggcctgtaggccactcaggctgtagcttcgtttccttttttatctcacattttcatgctttaccagtgccaaacaatttgagctattcagctgaagcaagccgagaaagaaatagaggagagatgtgcatcttgtaagatttggaatacagctatttaatctatcagaaattagtttggagtagataagctgtttaaatacgcatttgaaataccattaatagggacacttctctttttctctttgctctgtattgtggttcttttaataaaattggcaatggtgatatcagtgtgtgcatagctgtgcacactgtgcttagcaaacagttacttaaagccaggatattcatttttatgaaaaagaactagatatatattcaatagaacaataaacctttcaaaaaatataaccactagagataatcttctttttttttttttgagggggggatcttcagagagctttccaagtacagttggaatatttcacaatttcaggagacttgtatgcatctaaatacaaaaattgaatgtattttcatggtaaaatattgttggatgtattaggattggcggtttagctggtaagtaaaattttagggagagtgggagcaaggcagacgcataaaacatctgtgctttccaactgagatgagtcaaataaggagaaaaatgacaaagttctgtggtaaatgagctttgaagtgttctccagttcaagccaatttttaaattttaatattaataaggattgttggccaggcgtgacggctcatgcctgtaatcccagcactttgggaggctgaggagggcggatcacgcggtcaagagatagagaccatcctggacaatatggtgaaaccccatctctactaaaaatacaaaaattagctgagtgtggtagtactcaggaggctgaggcaggagaatcgcttgaaccctggaggcagaggttgcagtgagccaagatcacaccactgcactctagcctggcgacagagtgagactccatctcaaaaaaaaaaaacaaaaaaaacaaaaaaaaacattgttgctgtggtccctctgtaatactgctctcttcctgaggcttctacttgcttgagctcttttgtttcttacaaaagcacaagcatctagaagacagtaattagtttctttcttgatatatcagaattattccctaattaaatgagatttaaggtgataaatggaattactttgtcttttagacctccatatttctctggagaattaccttacaaggtttaaaatatgtatattaaggaagcccacttggaaaatacagaattgtttggctatttaaatgaaagcagatacatggtgtttcagtattcttattgtctttatggcttcaatgctctcaacatttgaattaataagatttggggtgccttagctgcatggaagaatccttatttgtttccttgtgcccacattaaaaagaactcaaaatgactcattaaggaaaaaagaaacttgcaatgaaagaactgttgtgtgggtgagtcccaagggagacttgacaatatcatgcaattttcagttttctccctatttctttatattttaataacctaccagttttctatagagcacatctttctccatgccgttgttttcttacacatatagtaatgataatagttatctaagatttcaactttaaaaaagcatgtgtttaataagatctctggtattcctctagagatagtaaaattataatatcagcactgccttaataacaacattttaattgtttattacttccagtatagtaaaaatatcatttcgcaaatatttgcttagctctttggactctctcatatggctacaaagatgagatacccttacaattatctcattttacaaactgattttctttttctttcttctaaagcaactgtggagtaagtatcctcttaaaataaatttcatatgctaagtgattttctaaaaagtaggtggttgaacttaaacaaaaatattttaaaatatttaatatattggctgtttctcaaccctaccactgcatgcaaaatagcttttcttttcaggtgaccatagcaaataagtactaagtagcttctttatactaattgctcagtcaaatgctttcatatgctttcatcaaatgcttttatctcattttttaagagtcttatgagataaatattatgatctccactttgaagatgaagctggagacataaataacagctatagaaaagaaagaaaaccaactaaaaacagtttctgaacttaaaaataatccatgcaggtaattcatgttcatacacataatgtaaaccacttagaaatgtagtatttctttatatgttacatgcctcatttgtcatctttgtgcatcccttcagacatctgcatttgtgtactgcaatgactaataatagtaaattaaagtaaaataaactattataaccaaatttatcttgttcctttgatgtggtacagaaaataattaaacaggtaaagatataatacatttttatgtgccagaatcaattggcaactgacgtggtaccacgaaagtaaaaggctcatttctcccactatagagaaactctaggcaatgtatctctatccagattaagtcttcagggagtacagaggaagtatacatagtggagggaaagaacatgagttccacgatccacgtatagacgatcaaatcttagccctacttactagcagagtgagattggccaagattatttctctctgaacctacctttcctcagcttgaacacatatggcctaacatatatttcaagcatatctgcaatatttatatttaaaatgatatgaagcaaactttacctataatgacattagttactcttgggagatgattatgtatgtgattttatattgccctgtgcacttttctctatgtttaaaacatctcattattctttttaaaaagaataaaatgagtaagtaaataacataaagttgataatagctacttccaggggagggttcagataaactgaaatcagataccatatataaagcagatactgcaaagtaggtaactctcaatttttagctcccttctttcttgttttcttggcaatgcaccattaccttctacctcatcaatttcattcatgagattgagcagtgactttccagtaaagcaagttatcatatttgatgtcagtggtgattgatacaatgctaattaagtagctacatcacaggaaaaccacataacattgaaagcatatttcatttaaacattttggaaagctttctctgtagtctcattgtgaatagtaactgatgccttggttatgcaaaattcaagtattttcctcagtatttctccagaaagatgatataaaaattcaccatactttcaatgtcactatttaactatatgtatattcacacagattcaaaagaatcatgaataccttatttcttacttaatctaactatctaataacaataaatgttatagttaaatataatgtataagatatagaaattgctctttatcgctatactcttcctggtgagatagcagggataatggataaattttaggttgcccaggcaagaagcagataggagaaataagaaaaagctgtagctttatttactaaagttaggatgttttgctcaaatatgcaacccagatacccattcaggattgaggcattcattcccccagcagctgggagtcttctcagctaagtctctctcctggaattgcctttatccaaagagagagaaatctactgcacacaggtgttgatcttaagagaaccccacccccaaacaaatttcttgggcctaaatctctgcctccaagtctgttttctagagaatctggcttacggcatgttgcatcacctctttcttccttgaatgcccatgaaaaccttgaatacaagtatccatgatcctgaacatggtttggttttctaaaaaaatttactgggactatcccatctgtacattcactgacaataaatgatgtagaacattcactagagaatttattcaagattacctacttatattaatccagaaataatataagaaatgctgtctgattagggagagtgaggttgctcacacttggcacctgacccaatttctacaacattttacttgtgccagtacagacctatgttgttctttttgaagagttaagtgtatatacataggaacattgctcatttctatttactcagaaaatctaattttcctccaatgcactaaaaacaaacaggaggcccagtgagattaaaccctcaaattagtgtgagaatacctggtttcttttttactgccctcaactgaatttctcatcacctggagctaattttccagggtacatgtgctgtggaaataataccagggaagtttattagtgtagggaactgataggtctattatatgtttaggctgtgtccccacccaaatctcatcttggattgtagctcccacaattcccatgtgtcctgggaggcaatcgaattatggggtgggtctttctcgtgctgttctcatgatagtgaataagtctcacaagatctgatggttttataaagaggagttcccctgcacaagctctctctttttgcctgccaccatccatataagacgcgacttgctcctccttgccttttgccatgattgtgaggtctccccagccatgtggaactgagtcccttaaacctctttttcttcctagtgtcaagggtgtctttatcagcagtgtgaaaatggactaatatgatctatatggtcaattcagtgagaggtgtccattggctaaaattgtttatatacttttaaaggcttaaaaaaattaattgtcagattggtaccaaactctgagtttttttattgcaatattttaggcattttggcaaaatatacactggggacccagaaaaaagactattctaaaaagaatgaaaacctcttattttgcaggtggccaaaatcctttgttaagattcaaaaatccgtgtactaaagcagttcataacacatctctgcagaaacatgatcagatacagcttctcaatgtatatacgtaaatgccttgcaataaggcaaaatggttaagaatgtcattttaaaaaagcatgttctaaacactggaatcgagtttactatttggtaaacagttcaatatactgtaataaactagctcacaatgaaccaacaaattaatgtaaagttgttaaagcacagtaagttctcatttttcccatctactctgtttctcaagttaaactgcctattaaataaccagaatctcatccagttatattcataaatacaagttaaatacatttttctctaacaaccagcaactcagttttagagaccaaatgataggtgtcctggtgatttaaatacataattacaatgttttaatgtataggtaaattactaagatcagaaactgaatgaataacgagagagatgtggcaggatattttaagatccatcataataggtaggaagagtgattctatttatttgtgaaaatgcattactgtttaagttcgattcatgaagctatacaaaccccaaatgtcacagcattatgggaaaaggtggaacatacgtctgagcataaaacagtgatctaatcacatctgaccacattacgaaatagtttttttccaagttataataaggattgcttcaaaaaataaatggcttactataaatgcatgataataagataaaaacaaaatgagctttggaaacttggctttgaccctagtaaccccaattaaaattagagaaatacttcctttgacagtttatgctgtgatatcaaaaatacaatgcaactcagggagacagaatgtaatgctttgggtgttgctacctggtgagttcagaccactggcaggaaggaaaatgtcatctaagctgctgaaattgtttgtactccacttgtgaatttgcaatgtgtcagatatgtaataaaggcactttctagaagtcgtatagccattaaacttcctaggcattgccatgttagtataatgatggattgcaggtctcaaaaataaatactagcaagactagaattaggatacaaattcagctcctgaacatctgttagggaaagtcagtgtcctaatttgacatgaaaattagatctgtcaacctaagcaaacaaaacaaaacaaaacaaacaaacaaacaaaaaacacctagaaatttattttctggtctacatcagttctcacaaaagtgagacatcaggagaaagttgaactgttagtcataactttcatttattttatatgcccaaacttttgcaaaaattttccttgtgattttaattaattattgcaaagaaatgttactaaggttgcacagtcttttaaactactattaactatccctaatctttctctttcaaaaaaccaagaaaattctaaatgtctagcaatagacctgaggcacttgcattaagactttgaaacaatcccaccagcaacgtaccttccccgtaaacatgcccctcaaaataatactcagtgattggtgcggactacaagctgagcccaaaccttattcctcacttggagtgttggaataaatggatgtgttctatacatttctaagaaaaaaagcaagaaaagaaaaagctagtttttaacacaggctcctgtattcaaatccccttcaagttaccccctacaattcccacctaaggctgttattttcatcaatatgctctttctaccttatccagcccagtttggccttgacttccccaccagtttcctccctaggaatcttccttgagtcttgtcctgcctttatgatattgtaagcaaactcacaaatatccttgatcacttctggatataacttgctcagctccttgaccacactgaagtcgggctttctcctgatggcacactcttccaaaatgtttactatcagaagtagtctccccacttgcatgcttctcttagtccattagctcacgtctgctcttcaacaaggttttttctttgcaagtccatcatatctacttactccattctctttgtgtctctcatttattaccccctggccctgtttctaagtttcttagtgaaattatcatcaaatttcaacaagcctcatcatcaatcctcaatctccatgtctccattccattttcatccttcataaatagagacatgaaagggatcaagatggctgagcagaagcaggtagtgtgtggctccccaacagagaaacgccagaatagtaagtggacaccttctgagcagatagtctaggagagaatgcttggatgcgatagagaagagacataaagcattagaagactgcaggggcaggagagttcccgaagccaggtttcttctgggtggcaagacatgcagctaggggcagctttgagacctggaaccagtctgcgtgtgttgctacgaaatgagaaaggttcccttgtcccccttgcaaggtgtgcaactggagaagtggctcgcttcttcagtgccctgctgctcgtacctctaggggagcatgcaggttgtgggggtcgatcccacggcagcatctaggggtggatgtttacagctcccaaagccccagtgggcatgtgctaccatgggctctttcagttttgccgtctataggcagcttgtgttaaccagctcaattagaccctccaccttatcacaaggacgagggctttctgtatcccgggttcttgccttggcgtgagggaagaattgaatcacacctgggcttggagaatgagtacaaggttttactgagtggaagtagctatcagcagatgggggagccagaagggagatggtttccccctggagtccagccgctcagcagcccgggctctcctatgactgccacgaccaaactccgcgtcattcctctgctggacggcctgccaggtggcagcatctgttggtgtgctcttccaccagcgtgctcccctcgatgtcctctccactttcagctgcttgtgtctctacccgctagggtcttggggtttttataggcacaggatggtagggggcatggtaggctaggttggtcttgggaaatgcaacatttgggcccaaaggctggagtgcctgtcctcacctaggtccgtgggcacaggcctgggggtggagccctcgccagggactcacccttctttacccagcacttcccagcatcccttacatatcaactactgggttccccagtcggcttccttgttcagttgggggacagtaacccaccagctctgaaaagtggtaagggaagggacccactcccctagaaatctagccctcggttcagtcggcccctaagggagggggatgtagccggctaaagcccctcttgggtcaaaggttgggtcaaaggaaacaggagcactgcgctagccactgaagggggcgccaccaaagccagggaatggttgtcgagaaggggtcatcgctcacctctctcatccctcttcagtgtactgttgcggactcgaaggtggctctccccagcggaaccgagagagtgtgggctgaaagagaccacttttggggcttctccagcaattccactcccactgaaggcaaacgcgctgaaggagggcactttgcagacttttccattgcttctgcccttgcccctaccttctggcgctcactcttaagtgccacctactgggctgcagcctgaattacactacaaaacaaaattacatcactacaagaagcaacgtctcagccaccgcacaaacttatctgcaaccaaggaacccatacagagccttggcgccctgaaagcactcagaaatgaagctgatccacccatacacattttacaccacagtcatacccacaagggaaaaaagaatttaaaatcaacaagctccatccaaacaatagcaaattcaaaaaagaaaagaaaaaagcatcagctctctcagatgagaaggaaccagcacaagaactctggcaatacaaaatgtcagagtgttttaccacctccagagaatctcactagctcccaagcaatgaaccctaaccagaatgaaatgtctgaaatgacagatatagaattcagaatctagatggcaaagaaactcaatgagatccaagagaaagttgaaatccaacacaaagaagccagaaaaatgatccaagatttgaaagacaacatagctatattaagaaagaaccaaacacaacttctggaattgaaaaattaactatgggaatttcaaaatacagttggaagccttaacaacagactataccaagcagaagaatgaatttcagggctcgaagactagctttctgaatcaacccaggcaggcaaaaataaagaaaaaaataattttaaacaattaataaaaccttcaataaatatggggttatgtaaagtgacattggcatttctgagataagagaaactaagcaacttggaacacatatttgaggatataattcagggaaatttcctcaatcttgccagagaagtcaacatgcacatacaagaaatccagagaattcctggaagaatactatataatatgaccatcttcaaggcacacaatcatcagactatccaaggtcaacgtgaaagaaaaaaacttaacggcagctagagaaaacagtcatatcatctataaagggaaacccatcagactaacagcaggcttctcagcagaaaccatacaagccagaagagattgggggactatttttagcatttttaaagaaaaaaaatgccaaccaataatttcatatcccaccaactatacttcataaatgaaagagaaataaattctttctcagataagcaattgctaaaagaatccatcaccaccacactagacctacaagagatacttaagagagttctaaacatgaaaacaaaaggaaaggatgatccttgttaccatgaaagcacatgcaagcagatagcccacaggccctaagcagtgactgaatcaatactacaaagcaaccagataataacactatggcaagaataaaacctcacatatcaatattaacttttgcatagtcaaaattaatattgatatgtgaggttttattcttgccatagtgttttaacataaaatattaactttggccatgcaaagttaatattgatatgtaaggttttattcctgtcatagtgttttaacactccatttaaaaggcaaaaagtggcaaattagactaaaaacaagtctaacttcaagatacccatttcacttgtaatggcacccataggctaggctgcaagtaaatggatagagaaagatctatcatgcaaataggaaacaaaaaaagaacaaggatcactattctaatatcagaaaaaatagacattaaacaacaacagtaaaaaaggaccaagaaaggcattacataatgataaagtgttcaattcaataagaagacttaactatcctaaatatatatatgttcaacattggaggatacatatttataaaataattgcttatagacctatgaaaagactttcatggccacccaataatagtggggaacttcagcacacgagtgaaagcaatagacaggcaaaaaactaacaaaaaattttgtatttaataaatttgatagttggccaattggacctaatagacatctatagaatactccacccaacaactacagaatatgcattcttctcatctgcacatgatatatattccaagattgaacacatagtcataaagcaagtcttaatacatttcaaaaaatcagaatcataccaagcatcttctcagaccacagtggaaaaaaaacagaaatcaacagcaagaggaattcttaaaaccacacaaatacaggaaactaatcaacttgtttctgaatgactctaaaataaacaaaaaattaaggcagaagtcaaactgttatttgaaacaaacaaaaatagagatacaacataccaaaacctctagagtacagcaatggcagcgttaagaggaaagtttctagcactgaatgtctacatcaagaagatacatctgaaattaacaacctaaaatcgcacctaaaaaaaaaaaaaaaacagaaaaacaagaacaaaactaaacctagagctagcagaaaaaaaagaaataactaaaatcagaacagaattaaatgaaattgagacccataacaactatacaaaggatatacaaaatgagaagtttgttcttggaaaggataaaaaaagattgatatactgctagctagattaacaagaaaagagagaagatctgaatatgcacaatcagaaatgacaaaagtgacatcacaaccaatcccatagaaacataaaagatcctcagagactactatgtacatctctatgcacaaaaactagaaaacctagaggagatgcataaatttctggacacacacaacctcccaagattaaaccaggaagaaactgaaatcctgaacagaccaataacaagtaatgaaattgaatcagtaataaaaaacctaatgtccaaaaatagccctgaaccaaatggattcacagctgaattctaccagacatacaaataagagctgatacagatactactgaaagtattcaaaaaaaaaaaaaaatcaaggaggaggaactcctaattcaaaaccagtatctttctgataccaaaatctggcaaagacacaacaacaaaaaccctacatgccaatatctctctgatgaacagatgcaaaagtcctccacaaaatattagcaaaccacactcaaccaatgagatactatctcacaccactcagaatggctagtatattaaaaaaatcaaaaagtaacagatgttggtgagactgtggagaaaagggaacgcttgcacactgttggcaggaatgcaaattagttcagccactgtggaaaacagtttggagatttctcaagaactaataatagaaccaccatttgaccctgcaatctcactgctgagtgtatacccaaaggaaaataaaccattctaccaaaaagacacctgcacttatatgtgaatcacagcactattcacaagagcaatgacatggaatcaacccatatgcccaccaatggtgggctggataaagaaaatgtgctacatatataccaggaaatactatacagccataaaaagatgaaatcatgttccttgcagcaacatggatggaactggaggccattattctcagtgaattgaaacagaaacagaaaaccaaataccacatgttcttacttataagtgggagctaaacactggaggcaacacggacacaaatatggaaacactgaacaactgaggattccaaaagggtgggaggagggaggtgagcaagtgttgaaaaactccctatggtcctatgtcactacgtgggcagtgggatcattacaagcccaaacctcagcttcacgcaatttacccatgtaacaagcctgcacgtgtactccctgaatctaaaataaaaataaaataagaaaatacaataaagagatccctctactaccctcacaggactggccattgtatcatttcttttggtacagttcataaactctaaccctttatttcttctttttttctccccttctgatcttctctctttccacattttcactttcagtgctgtatccctttctcatttttccatattatagcctcacctgctagaccaactaatttttttcttatttaaattccaaaattgaattttctaatcagattcacattatcacttttgaatctcttatacttggtcttcagaagtcctgaatgtgaaatccaaaccctctctccattcattgtattctttttaacaataacaaaattatatctttgaatacttgttagagatatattcctcagtcagtctgccttccgattttcattacaatttatcatgtagtcatttcttagtttttagttgttgtgtagcctaatctgtcagctgttttctcccaataaaacaattcaagagcatatcctttatctgtgctgggatatggagattacataatacatttggggttcagatttgtttacttcaacaaatattaagcatgactacactaggtagagtagatatattaaagaacagctcctgaccttaaggagcttgcaacttttggagaaaaacaaagacatgcacaaataatttggatattacacagcaaatacagcgacagacatgtatcagcatatgagagcacagaggaatgtattaaatacatcttggaaggcaggaaaatgaggaaatgcatccagaggcagaagaaagaggcagctggggaggaaagaggaaaatagactttccagacagaaaaaacccagcagttgtgtacaataatatgatgaagatctaaactagtgtagtcaattgataaaaaggaaaaagcttaaaaaatattcagaatataaaatcagcacagtatggtgatggtgactgattggagacactacctaactacactggggaaagactggcacagcaagagaacagggaagcgatgtgcattcatattgataggctgaggctgagctgctaattggaatgtcaagtggaatagatagtagaatgtctaaatttaatgggtaaatttatggatgaagataaaacctgaagatgcatgagaatgtttatgatagctaacattttgctcttgcttgcagtttccccaggaatttttacagtgcctttggagactcagagaaactgtcttgttctattaattcctttgcctcctttcactagtgttctccactaaattataatctccctaaagattcatgccatggtttctttacctttatatccctcctgtctcctagcatagtgcattactcttagaagagagtaagcactcagtaaagtttattattgaaaggtcctcaatagcatgaacatataactaataggtagattaaacttatgtggaacacctgtggtcaacaaaatacctatatgcagatgttccattaacagataagtctttctgagatgattaaagcaaagagaaagaggtctgacatttatgacatgactttcagatttaaagcactcaaatagttgtttaaaagaacagatctctgtttaattacctccaaccaatggaggtattagatcacattcagaaagctttaaacatggtgtctgagcaataggaatttcttccatattcttctacccaattaaaacttggggtgaatactgaaaagatggagatatatctaatgaaacataaatttaaaaaaagacattttattcactttgggacaagatcaaaaagacttagataattattttaattcaattaggaaaattgaaagcaccattattttccactcagataatttctttattccttaaggtagtgtgtgtgtgtgtgtgtgtgtgtgtgtgtgtgtgtgtgtgtgtgtgtagtttgttttatctctttttttgtaaaactctccttagggaatattgcaagaattgtttttcttgatataaaaattaaagcatggagaaattccagtgaaaaggaaaggacaaactaacatctgattccacactatttctaattctcaatcacaatatcttgataggatagaggtgttttgtaggagattagaaggctttttttttttttttgctgaaattgcttttacttgatttcttttgaagagttgatctcaatttttaaaattgtcatttaaatgctaagttctgtattaggagaaaataatctagaagaatctaaagacaagtgtatagccttaggtaaagcatcagaaagcataatttaaagagggcttgctgtggaagacccttcaattcagtattattcagagtagcaaaaaaggttaggctacaatattcctgagtgttaatttcatgctctggagctcttaggtaattttacagagtatggcaaagtgataaaagttcaggaggtccatcatctataactacttctgtagaaatataggggaaactgtaattacatcctcagaaacttatgctttcaagtaaaaggcaaataaaattagtaaaataacttcatgcaactcatggctatccagaggcagctttattcaatggaagtgctctcactgctggttcacagcaaaggttcccatgacaaccaagaatacacagtacagtggtgatgctgtttgcccagggatatcctgtcattaatataaataagtagataacgatatctagtctataggtattatgatccacagctgtctataaatgacaactgcagagtagaatggaatgctcagaactgagtttattccaagttcaattaaagttttatttccttactttctaaaaacatcaaagtatatgcttctaaattattctactgtgtttcactataattttcaagtttggtttcatcctggattatgacctttcagtgagctgggacagtaatgtggccccaggtatggtgagtaagcccacctgaaatagaaggtggtttactttcttgatatgaacaaaggctattttggagttggaactctccagaacagttaaaatgcatttatatctaaaggttcttaggtgtaaaggaacatacatatgattttaagcatatttctctactagaagtcttataatatttcttatctgttattctgtattcccatgtttcctgaaatactgtgaacttattaagacaagaacaaaatgtcatttacttttatatattgggtctaggatgagttggtttcttttatatattggggtctaggattacttgatttcttttgaagaatccttgtagaatgaaccaaaagataacagataaaaatatgcaatcaataaatgtaatagcatgtgctaaatgtcatgtgtaccagaattaacacttggcctatgagagatacagagtaatatagggcccatttgaatcctaacactgatttgtcatcctgtttatttaagaaagttacatactatagtatttcataatatagttgaacaaagtatctgttatatacatatgcacattaagccacaattcattttgcatttgtaagaaattcaatattattttgagtaatttgaaggaaacacaattcttacaatttgcataactgaggttcaaaaggaaagtccaccatctcaacccagttaaatttggctaactagtatgtaccaatcaatataaacacgtgctttaaaaaagttaccctagttctcattcctaggaaacatcagctgtgtagcaccgggattcatttctgttctcatacaatttaatttctgtaataaaaaatctatgtccattttttgatgtgtcattgctgatagctttaaagtgttatacctctctcttcccctctgtcctacatttgggaaaactgttaagaaagcccatgtgttctctcctttggtgatggtgggaaattcaaaccacaccagagtccacccacacaaaactctcagcatggcctcacccactaaaagtcataaaatctcaaaccagtcattttccccctgctctctcaagctacttcagaccttcttgggaggcctgctctgctctccccagaaaaacctcataattttataagtaatacatactttcatactttcttggtaggggtatatgtgtgtgtgtgtgtgtgtgtgtgtgtgtgtgtgtgtgcgtgcgcgtgtgtttgtgtatgtgtgtgtgtgaaagtgagagagagagaagtgtagggctgctcattagtcttaacatttgaaccatattttgggtggaggcttatctgaatccacacaatggatacaacagtttcatcttctagatcttggctatttggttctcctcttctgctcctttctttgggagggaagtaaaaagctaaaatatgcattcccaggttatgcatagaagctaacctaagggaactgcagctttaatacagcaaaaagaacccagaggagagtacagaactgatgttattattagcagaagttgaaaacattcacctgcctaattctgagttggctctggcatcaacagtctttctagaatttgttcaaacagcattattagcagagggtgctgagaagagcagattaccagattactctttttatgcctacattagattggcctcttgcagtgcatcaatataagggtatgtggtatcatttccaagatgaatgttaaggaaattcacacggacaggggaaagcaggttttctacacttaaatagcacattctcaagagggaaaatgtcaacgtatggcttattcatagcacaatagctgtttaaactacagcttagaatctactatgtgccaagcactgtgctaagcattttacattttgcatatatcattattagtgccattttactattggaaaccaaaaacagatccagcagttgtcagagatagaatttcaactcagacttacctcatattcaatgtctatattctaatgaactcattctaagacttcagatttacgttgttaagactatgaagctttttgcttcctgataatctctgaatgtctaataggcctttatagctggcaagcttaggaaagaagcacatttttttttctgctggaatgtagggagatatctgtcatagctcatagatgaaatatataaaaacactacatggtatccattattcatttcagctccattgccctaaagaaacataacaccatgaatttagatgtagcaagacaatggaataaatgcttttaattttttttcaataattatgtcaaaatagatattctgggaaccgtgagaaagtagaaagtgtagaagtcatgttgttgacttcaacatgcttacaatatacctaacatatggctcagtagtttgtctagttgttaataatttgaaacattgatttgctaaattaatataaatggtttcacattacaagtaaggtaagtattttaaaatactaacttttcaagacttcattttttagaggagtgagattcacagtgaaattatgaaggtatacagatttcccatatgtaacatactagttttcaagcattaattttaataattcttatatcctgagttagcatttaaatttattttatacccttagtctttggcaaaaaaaatgcttctgcttaaaatagcttattggctaagaatccatcattttaaagaaaattatgcataatcaacaggtatatagtttaaatagaaaacagcagggggagctcaaagacaggttggacaaattaaaagttgacttcaagagtactgaaaaattattttaataaaaatttgaagagaagaaggaatatactgttaaattatgagatgatattttatacaataatttccagcaaaatagctagctaaatggaggaatagtttcccatacagaacacttcaaaagtccagaaaaaaaaattaatgcacagaatcactagacatcagtgaagtgaaaattaaaattacaatgaaataacactacatattactcaactagaatggttaaaatgaaaaagataatacgaagtgttgacaagaatgtggagctcttagaaaatagagaatattggttggaatctaaattgaagaagctacttgagaaaactgtctgtcagtcttcaaaaaatgcatgcctcataatcaagcaattccacttctggctatatacccatcagaaatatatatgcattatacaaaaagatgtatacagtaatgttcatagcagcatgatttgtaatagtttcaaataaaaataaaacaaatatttaccaataataaaatgggccaggcacagtggctcacacctgtaatcccagcactttggcagactgaggcaggtggatcatttgagatgaggagttcgtgaccagcccggccaaaatggcaaaaccccatctctactaaaaatacaaaaattagccgtgtgtagtggcaggtgcctgtagacccaactacttaggaggctgaggcaggagaattgcttgaaccctggaggcagaggctgcagtgagacgagttcgtgccactgcactccagcctgggcaaagcagtggaactctttctcaaacaaaacaaaacaaaacaaaacaaaacaataaaatgaataaataatttataacatatttgtatgaagatgaaaatgaactacaactacatatataaagacaaatgttcctttaggcccaggagtttgagtctagcctgggcaacaaagcgagacccagtctatacaaaaaaataaaataaaattagccaggtgtggtgtcatatgtctgtagtcctagctacttgggaggctgaggcaggaggactgcttgagcccaggagtttgaggctgcaatgagttatgactatggtactgtactacagcctgggtgacagagcaataccctgtctcaaaaaaaaaaaaaaaaaaagaaaagaaaagaaaaaagaaagataacttttccaaatacagtgttgaggaaaagaagctagagaacaaagaacacactctctttggtaaataatatgaatattatcttagaaatcacaatagtagttactctggggtgggggcagaatctgaaaggtacacaaatgggggcttctacagcttagcaatatactgcctattaatctaattgctgcttacatgggtatgttatcttcatggaaatttaccacattttacatttaggtttgtgtgctttttcctcttatggtataattcaacaaaatttgctctaaaattatactggatgattgctttaaatcattaaattaaaagtttttgaggcttgaaattaagaaagcttggtcccacagggataactaagtactagaattgttttttgctttgtttgtttttttgtttttttcctgaaggcatttaccaattctttgggttccagggcaagaatctaaacaaggggcctaaacagagaaagaactcacattcagacttcacagaaagtcttatacccaaaagtcaatacctataactaggcatgctacaatctttcatgcagaacaagacttgtcttggtttcaggcagcatatttaaaacaaatatttctttcaaaaatttctaatcacaagtgtatacttgcgatatgtaatatggcattggatatttgcgtggcccaaaagttgaacatttcatttaaagtaaatctatagttagcagacatgcagttacttaaattataagcaaatcctctttcgaaaaatacactttcaacacagataatttccagagataaaatactaaagagtatgagctcacatatgtaaaaaaatatagaaaatgcataaaaaaaataaacttgcctgagagacaatcagtggaataaactgcacaggtagaccaacaagattacagatattggaactatcaaggaactaaaataaaaaaaaatatttaagctgtttaaagaaatgataaaaaatttagtaaatgagcaaaagacaataaaaatcaacacacatatttagaataaagaccaatagaacttctaaaattgaatgtctaataactgaaattagaaactcaacaaacaggtgaaacaacaaattagactctactgaaggttgaattagtgagccagaaaacatatatgaatgaaacattcagaatgcagtagaaaaagaagtggaaaatatgaaagcaaggttaagataggtgaatgacagagtggggccaacataagtcttactagggttgggatagattaaaaggaatggcaacgaggcaatatttgaaacaataatagctaagaattttccaaaataaataaaagacaccaacactcatatttaggaataccaatacattttaagtaaacttttgaaaaactcaacttctggattcattagagtgaaattgcacaacaacaaagataaaaataagaatttcaaagcacccaaaaagaaaaaagtaacactggtcagactgaaaagtgatttctcaaaagacaaggtagtatcgtatttaaagaggtgaagagaagtagttgtcaacccagtaatgcatacacaacaaaactaccttccaagtctaagcacaaaataagatagtaagaaaaccacacatgaagagaattccctactattggagagtcactagagaaacttctaaaagacatttttaaataaaaaggatggtctcagatgcaaaaaaaaaaaaaatgctgagcaaagaaaatggaaaatgtgttagaaaatgttcaccaaagatgacttactacaactataataataatgataatgtctacaatgtaatacaaatatgaagagaacaaaaatctattcttttgtattttctcaggaggacagtaaaagggtaaagatattatttaacttcagccttaagttacatatttggaaaattttttagggttattattaaaataatagaattagagtttaaaacttacaaactagaaggaaaaatacaatgagaaaagggaggaaatcactttgatctaaaataatgccagaaaagacgtgaaaagaaaacaaacattagaaagcaggataaataggaagcctaaattaatatttttgaatattataattatattataaactttataattttatattaagttataaatatataaaatataggtttatattataaactttataaattatataaacttatatataattatacttttgaatataattatattttttgaatattataattataattaatccagtgttcatgaattaactaatattttcagtttagtttcaacaatgtcaaagaataggtactatacaaatatctcttctgttaaagatgaacaaaattagaaattaataacaatgtatttatttaaaaactcattcctttggaaaacatttaaaaagtacttctaaataacacttgagtgagagaagaaatcaaagggatttataaaatacttaaaacttaataataaatatattatgcatcaaatatatgggattgtcactaaagcaatagaattaaatcactgtattagaaataaaggctaaaactcaatgcacaaagcaacttacttagaaaaaataggaaaataaacacaaaaaagtaaaggaaaataataattataaaaacaaatactaataagagaaaatacagtaatagaaattcaaaaacaaacatgaatatactaattaagtagtctggcaatttgacacaaacgagatacagaaatagaggaaaagagaaaacagcaacaaaaaaattttaaagagaaaagagaagaatgggcatagtataagagacagaggtagagttccagataggtaggtaggtagctagctagttaggtagacagaaacaaaggtagagaacatcttagtagagatagacagacatagataaaaaatagtaaaaatttaaaggaggcatgacttacctggaaaaatatagagacagaagatgtaaatgaaagaactatttcccaggtatatggaaacagcaggaaaatgtaatgcatcttggagaaatcataagggtctgagtgaaaactctttagttaagtgaagcaaaaggagcaccagtgaaaagtggtggcactagtgattccagcagataggcaaggagatctgaaaatataatttctcctacttaaaccgttttttaaaattctttctgtttcactgtaaaacttaaatccaagtaccggtgatcgtaagatttaattagagaaaaatagaatttgactcatttgtgatgcaagacaaaataaaataagattaataagtaagttatcaagcaggtcttactcaaatagcatctttttggttacaaaatgacaggggacacaaatatgattgtagaatttgacctagtaatcccagttcttaaagattattttagtaaaataaaagcagtttaatttaaaagataaggaaaacttctaaggatgtttctagagccatcatttctaatagtaacaaatgagaaaagaagcttgaacatcaaaaaatacaaaaagtttcgattaagtcagaatattatgtagtaatcaaaatgatacatgagaagactgtgtcagaagaaagagcaatatttaaggaataataatgtggtttagaaagtaagataaaaagtatacaattattattatagctccattaatatgcatataaccagtcaacattgggaaggaaaaaagaaaataaaagtggttacatcttggtagaatcatggcttaagtaattttcaaagtctttttctatatataattaggaactaataaatcttttaaatattctacttgtacttgttgactaatatgcacaatggtagcagggacagaccattagcttttacattatttttgtgaattcataagaaattcacaaaactagaaaacaagtataaaattccttaaaatgagctatataagtagagtagctatgttgcttttttcactttgataaatatgaaaatgaataataattttcaaaatatatagaagagcacaggttacaaggaagtacctgctgtatctttataatgaacagtgtccagtcaattcaatttccttaggagatagaagaataggccaagttacagcccgttggacaatatgatttcagaaactttcatacatgattagcaatctgaaaacactgaatttctgttctatggattcagcactatatgataccattctaatgaggcttttaaaaaatgtggtaatttgaggtctgaagtgggttcaaagatgtaacaaagtttggcgctccagaacataaacaaaacataacacaggtgtggatgtctaaacttttgactgtacccaatcttaacatctggtttttgtgctcaactgctcacagtcatgtaaaatgtctcaactgttaatgactcagtgttaagtgagaaaaaagaaaaattaaactctgctgttgaataccatgttgtaaaatcctcatctttagagattctaaaaatattcatagactacacccttttgaatgctgtggcaacttatcccctgaaaggagcaggctaagccaagtgacatgaagatattttctctgtttccattaaggttatattcctctctgggtcagtcaaatcaaacttgtagcacgcatgtctaatgcagaatcactgatcaatcaacgtgctcttttctgaggagtcatggagctccatatgccttatgatatttaggacatattccaggaagctaacaatcaatgaaagcttttttcaaacagacttaattaaagagaagatgaatagatgaatgaacttggggtaaaggtgttcaaatgtctctccaattttacttcaagaatgtttaaccccattgaacttatcagttttggttttatcaaaccaaaattctggatatacagatgtagggttcatctttattgaagggtttaatattggatttcctatttcaaaggaatggaaactgaaaagataatattaactcagaaatcagttgacagatgtcaaatcaaggaacatttgtaaaaaaaattagactaatgttcaagtacagatagagacattttctgtaataaaatcttatcacagaatagcaatgccactgaacagacaagtataaagtaataccaaggacaaagataaaaagttatttctatttttgaaaagaaattagatgatgtctagtttaaaaaaatatgtcaaggtataagattccaatattttatttgactatacagtttaggttgtttttcccattaatgtagaagcacattacatatcgttttcaaagtctaaatgtgttcttttttaaaaaatgataaatatgaagggcaaaatattcatcttaaaccatgagataaaaatatagaggtttttcatgccgctatctttttggtaatcaatgattgaatagtgaatattggtttacagtgcagctatttaattattaatacatttgttttttcttagaaggatttaatattatttttacattttctccactaaatatatcatttcaaaattatctacaggaatatgcccaaaagaatgatcaaagcttagaaatattttgcaactctgtatcatattgagatataaaaacagaatcaagaatgatattgacaaaaatcaggttagcacatcatctagatgataggttttcaatctcctaaaaaataatgcattacattaattatgcatatttgagctttaatgagaaaacattgtaaggatgaacaaaatcctttaacatcagagctgacagagaggtgagagactgcctagttcaacctcctttcacaaatgaggcaattaaacctgtaaaagactacatgatttgtgcagttcataaccttcatgagcaggctaatgtctcctgtattttcttctgtaccctaatatctacgtagcatagaaaaaaaaatctctttgaattgttaaagtaaaatgtcttacattgaaaggcagtacttccacatgctaaagagtaagtaagaatttaagaaaaaccatgaaacaatgtgaaagaaatcaaactgagtggtaacaaaataaacacgcttcattgtggaccacaggatttcatgaaggataatgacagtctttcccatgtttctgaagttcgctgtaaagatacaggtttaaatctcagtaagagagattgagattcaggtataaaggaaaacttagagcgaaagtcagtatactagggccaaatgatttcctgaaaggttatgaaaatgataggcatatacctattagtgaattatgctaaatcactgcagaattcagtgaaaggtatacactttaaatgaaatcatgaagcaaattaagcttttgacataggccattaagtgacaaagccaaggtaagtgtttacatttttctttttttttttttttgagacagagtcttgctctgtcgctcaggctggagtgcagtggtgcgatctcggctcactgcatgctccgcctcccgggttcacaccattctcctgcctcagcctcccgagtagctgggactacaggcgcccgccaccacgcccagctaatttttcgtatttttagtagagacagggtttcaccgtgttagccaggatggtctcgatctcctgattttgtgatccacccgcctcggcctcccaaagcactgggattacaggcgtgagccaccgcacccggccttcatttttcaatttagaatctcggtctaccacctcctcttgatagggagtgggaggctgttacaaattactaggggccccacttttctcagtggcctcaaaatcattttatttatttatttatttttacctcactaggatctaaatctgtttttagtggctttgaaaactgtttctaggactgaactactgaattacatttaagattgaactagtgaatcagtgactaaacaaaacaaattttaggaaaccattctcttcattgttcaacagacaaaaaccaacgaattttatcacttactagctatgtgactttgggctagttatttaacctccatgtacctctgtttcttcatcagtaagatgctgattataacagagtgtgtctcaaaaactagtataaaagtgagttccatgtaaagagcttagaataagagggtatacacctaattcattctataatgaaacttaaaaacattaagaatcctcaaggattacatgaagccaatctgaatcataaagacaggttaaaaagtctaaaccaaatgttagcaaataaagcagcaataaatacatatttttctatgtacctatatgtgtatgtatatttgtgtgcatatggcatgaaaggctttaaacatgagatgttctaataattcacaatgttaagagattaaaggggaaaaaccacagaaaattattcaactaaacaaccattcacgataaaaatgtatggcaaatttggaataggaggaagttaccaaaactaatcaaagatatctaatcttgatggtgaaatgtggaagcatgctctttaattgtagacacaagtaaagaatgcttgttctctccatttctatttaacagtcttttgaaagcattgctttttttggacaagtgtcctcactgtcacctgggagcttgttagaaatgcaggttctcagtgcctgacctaccactgaaccaagatcttccttttaaaaggatccctcagggattcatattttaaagtcagagaagcatccgtgcagccagtcaataaatcattttaaaaagtggtataaaatatagagtataaaaattggaatggaagaaacaaatttttgttattcacagatgatacgattgtctacaaagaatacctaaaagaatcagaagaaacatcattaaaagtacatcaaagtttgaaaagtttctaaatatttgttcgatataaaaattattagatttggatatagctgcagcaagcatttggaaaatataactgaaaattgttgccattttgtaatagcaacagaagtctacagtggatgtgaataaaaaatgtataagatcttcgtaacaaaatgtataaaatgcactgaataacactaaaggaggcaattaatagagggatacgccacaattatagctagaaaggtaaagcagaccaactgtactgatgcgtgtcaaaggtaacactaccagtcagtggaaaaatgatggatcagtcaatcgatggtgtggaaataactagttagccatatgggaaacatacaaaagtggatttcttctcacactgcacacagaattcaattccatatgtaaaagaactttacggtgaaataaaaaacttgaaaaatttttagaagggaaacattattttaactgtgattcatgaactatatgatagaatgaaaacaatgacattttatatcatctgggacattactagatgtaaaataattaagtttattgacctctaaaccagcccaatagggaaaaagggagtaaaggggagcatcttctaggcaaatgatgttcccatacatagacttgccagagcatttgcaagattccctttagaatcgatgtttggtctcttgcctatccctcctccccaggcagtcactttctctggattttttttccctctttctttagcttttccttctcagtcctggcaataggccttcaacaccacaccatcaccactccaccaattctggagggatatgattttcaaaggaacaaagtttttggagttgagttccagcactaacatatgtatggacgaagataacagtctacagctttctgttttcctccctattgctctagaagaaaacgctgccaagaaaaagctacttctaattttttcatagaaaaaaactgctactaaagtatttttttaagaatcattcttttcttcgggagaagatatttccaacacttgttgtgatcaagagaaattgcagaatatttttaaaattcttaaaaatcaatcagaaaaaagagtctggaagaaatttgaggaaggcttagaaataatttttatagaaaaagaaacatgaatcactaacaatatttttaaggcttaaatgtattatcagggaaattaaaattaattaaaaaattagtatcatgttaccactagattgacaaaaaatttgtctttcaaaaaacacgagagcttttataaactacatgtgatcacatattctttctccaatactccttgagaactactagattataaacatacatacacatacataggcacacacataggcacacacacacacatacacagtcatttaaggttaaaatacggtaaatattttctaagtcacttaaaattattgcctgtggatttttcatgtaaaatattaaactcttccaatgtttgaacttaatggttattgagaaatacgaaaaactattagctttcttgatttaatatagttaatattgcttataaaggaaagaaaaaatgcttggctacaaggtcatctcattttaagattacattgattaaacatgtagtatagacagggcatctaacccccatttcactagccagcactgaaaacttctttaaccttgcataaaatgcatgcatattctttgaaagtctttttttgtaaacgaagtattagatttttaatgtaaattataagaaatgtaatgtttactaatgccgtcaagaatggcaggtcaaattcacctggtttttaaagatcaaatgcctacttttacagtcacctttcaacctttgttttagactctaggattcgtttgtcacaggtttgcctatttgggccacagcttccttatatagggtacagagcagcattcaaaggtagtgtttaagtatatggacttgggtgctagatcactgtgcactaacacccagctcagacacttactagctgtgtgacctggggtaacttaacagagcctcattgagctttggtttcctcactagtaaaatgaagctgaaaggaggatatatttcatagggttgtagcagttacatgagttaaaatacctgagctatttagagcagtgcctggttcatagcaggtgatctaggagtgttattgttcttcacgttattcacatttaatagcaaatcatactgcaaaaaatggtgtcaatgtaatggtcattacaggcaatctaagttgcttttgctcttgacagtattttacacctttaaagtttccagtaaaaaagataatgctaataccatttataaaacagaagaacaaagaattccttgacaatttaaatatctaaatttattagttaaatcaattaattatttgttgttgctgacttccactaaaatgtgcctaatcgttttatgaatgtcttcctattccagtcagtatttttagcaggtttaattctcaagcattccaattggatgtgctggaatttggctcctattaactcatggttttgtcctagtgattaatttatcctaccagattgaataagtatatatgtatgtacttgtgtgtttgtgtgtgtgtgtgtgtgtgtgtgtgtgtataaaatttacaccagtggcaaaaatagtgatttcattttgccagtttgcaaggcaaaatgatgtttgctattgtatttcttttgctaaaaaaaaaaataaagcacgctcgagtatttttactgtctgcacactatttaacctcatgtcttattgtgtagctgagtcatgatgaatacaacaagcaaacatccttaatgttctgttttgtcagtgctgggctgtgcactatggtggctgcccaggaggaggggggcaggacatgagcactcacatcaaggatcttatatcaatttaggaagatagaactaaaacacccaaaacaacagtgagcaataccaaatggtttcagttcaacccatgatagtgtacaggagtcgaataaacaacaggaatgaaagaggggaagatggcaatagtcagggaatgtttcatggctgaaggggtcacttatccccaattcaggcattcgactaccagcttcatgattctgccatatccacatttctacatcatgatttttgttgtttctgcatcccctatatactattattaattttaaaaattctgtaatagactagttttttaaaaactgaaataaaatgtcttcatttaaagaagaaactttatatcacaactataaatggaaagtcagtaactcttgccataaatgcagcataaacagaacaaccttattagtttctatccagataatgttgccttcgaaaggcactaggctacaggccggtgttatctctgtttataagacaaagcaggtgttaataagtgttagagacttagtaaagccaacatgagactttctgctgtccttccttcttccctaccatctttcttcccttcctttcttctttcaactttcctctttctctctctccctccttcctcctcttcccttcttccttccatcctttagcaaatattcattgagcacctattatgtgacaggtaccattctaggcacagaggatacaacagtgaaaaaacagaaaaaagcccttgcccttatagagcttacattcttgttggatgaaagcagtcaataaacagataacaaaggatacagtaggtcataggtgctatgaataaaaatacagcagggaacgtcaaggtggaagaaaaagcatgaataggaaaggattactgctaaagtaacatatgagcgatgatctgaagggcaggatggaaccagccatccagatacttagaggaagagaattcccagcactgggaacaggtagtgcaaaggctgtgatgcagaacatgcttggcacattcagggaacaccagtgaagtcagagtggagaagtgagtgggtgaggcggacagtggtttgagaagatgtcagatccaggtcacttgaaaggggcggtagacatagatcatgtagaagtttaacagacatagcaagaatttgactttgactctagatggcatgccattggatggctttgagcagagagcaacacgatgtgaactaattactgtttttgtagaataactctgctatgagattagactggatgggcaaaagcaccagtcggaaaactggttaggagggtatttccattaatttaagagaaagatgagagaacagtcatgtgggaagcacaggaagtagtaaacaatattggatttgttgggcaaagtgtatccaccaccccccaaatacacacacacacacacaaatctctatctcagcacttatgtatttatggtttataaatgaggctgtttatgggcaggacacggtacctcacacctgtaatcccagcttttttggaggctgaggtggggggatcacttgaggtcaggagtttgagaccagcctggccaacatggtaaacctcatctctactcataatacaaaaaaattagctgggtgtggtggccagcacctgtagtcccagctacttcgaaggctaaggcaggagaattgcttgaacctgggaggcagaggttatggtgagccaagatcacaccactgcactccagcctgggcaacagagtgagattctatcaaaacaaacaaacaaacaaaagaaacatgagaccatttatggggatggggctgttctccctgccccaaatttgttgtcagtgactggcaatcatgccttattcatctgtaaaccttactgaccacagtgcctgataaaggtgcttaaaaagttggtgcgactgaatttcagatgagtggaataatgaaaggcacagaggaaagaaggctcacagtaggtatttggggcaagaagatctacgtgggaagtgcagaaaggcatgggcattgtggtgaggcacctctcagagaaaccgaggttcacattagaatggatttcacgtgaaagaagtagaactaagagaagtataagaggagaacgatttaagatgataggaaagaggccaagtttcatggaacctttattaaaaaaaaaagaaattccatataggttagatttaggaaatcaggattcggaaagggctaggatttactacataactttcattctgaaatccttacatttcaactatcaattcactgaataatgtcaatattttattttgctgcttttaagagataaaaaagagctgttcataactaatggaatatgtatatgcacacatacacacacacatatacatatatacacatatatacacatatatacacgttgtgtgtgtgtgtctgtatgtgtgtatatatatataatgtatatgaaattcctcaatttcaaagactggaatagaaacgttcctatagatatacaaggatcatttatactcctaggatgaagagacatgcatcatgaaggtttacttgggttaattaggtatatttcaagggtgattaaggaacaataggagatcactaaaaaaaaaaaaaatctctgctgcaaaataaaactaatggaaaactgaggcaggactaggacagcagtagagaatgatgcaccactgagaatgggggaagaggaattaaggcagatagacctggaagaaaggtggctggaggagcagatatcttgtctttacatcagtgcattcctgatgtataagggagacttggcccatcttgcataaagcagtcaggtcagagtaaaaataaaaacagatgtataactgcccagtctcttgctggaaacgtggagaccccaagtcttgtatggaagggagacaaagtcaacagctatttttgcaggtaaaagagaggatttttttgtttcctaatccaggtcatcctcatctcttgcctttacttatagacacagctttctaattggccttgcaggtcaacacttgcccatctgtgcaccattcttctcccagccaattactggcctctaaactatttttgaataaatagcaaatcttatattatctgtttcaacctcatttcctgacactctttccccactttaccccaaattgcataacttcctggttaattctttaaaagttgcctgttctaacactaacttcttcctccctccccaacccatctctacagttaagtttatgtcctcttcttatttgatcctgtagcaccttccacctgtctgttataatatttgatacacttgtaattctagatctgtcaccccagaatgtagaaaagtgtctggtacatggtaaacacttaatatttgttaaccgttgaaggttgaatgtttactattgatgaacatgaagataaaaagatagtagccgacaattattgagaatgaaagggtttttacactaatttacatttcagataaggtacagctttcattgagatttaaaaaaaactcaggtttgaaattattatagaacattgtataatttcccatgttcacaaatttaaaaaatacagtacactttaaacaaaacagagttcacataaagcatatttgataatcagctcagctccttggtgaaaaaaactaaaatttggaatagttaattgaatggctatcatttaaatattttaaatacttgttcttgaactataaataaccacatagaaatatgaggaaaattaaatttaagagggtgtttatttggagaggaattttaaaacaagtcttatgaatcatggtaaatacccttacaggtatactcagggcactggagtgcactttatgctccaacaaacccaagacttagagacagttgctagctgcacacaaacagtgtcactgtccactattttacacaaacggcaattgagtagcaagggaaggtgaattcctcagtcctgagttacttctgggtgtgcctcagatgtttaagctgcacattaactaactcatttaggcccccagagtaactattaatgtaccaaagctacaatttgagaagaccctttatttccaagagagctggaagaatcttcaacaattcataatacttgttcttattaaattgcgaattctgggcaaagaatcttgaggagtaaaattgcctatgccatttcacatgaatgatatacagaatgtgactctgaaatgtctgccattttcagagcattacacatggagagcttcctcaattttcagaggacctctactgctacagggaaaatttcggttcacttgagttagaattatccttaaaagggatagaaaaattcaggaatgcaacaacattgacttaccaagactcacaagttgtatacaccatttagaaaaagtttttagccttgaaaaggaacatcttgtattattgttaatatgaatatttatgaagcactatcagtaggcttaactcagtccctgctcaattagcttataatttaattagtcctaaatgcaaatcctctaaattggggtggttggcttttgaaatgaatgccaactaatatcattattgatggctcactatcttctgcttctctctctcatttctcttttcttcttaccttatacatacattttgctctcaaacacccacccttcctcaactgaaaggatgtaaatgaaggtacacctgcaaaagcagaagccctgtggtccacattgaactttaaaatccttattagcattttgtatctgaaaattatagggatgttttgtgaatttttatagatctaacacaattgtcaaatatcagctttgaaccatgaaaacatttctaagatattacgcaaactaaactctaaattgagttttctatttctatttgaatttcacatatctaaatttcctatgttgtttctgagagagctccatatctgtgctggagttggttcactgcacaacatttcttacaggtttagatagcacaccttgttttgtgctacattctctcttgggagacctcagttgtattacaatcatagatggttgcttactaatacagaaagtagaaaaaaaagctgcccctttgaaaactatttaataactttaataagctgctttgtaaataagtaaataaaaagatacacttccttttgtcaaagcaaactctttgatatggtctggttctgtgtcctcaaccaaatctcaacttgaattgtaatgcaaattgtaatccccacgttttgggggaaagtcctcatgggaggtgattagatcatggaacagattcccccatgctgttctaataatagtgagtgacttctctggagctctaatggttttataaggggctttttcccctccactctgcacttctctctcctgctgccatgtgaagaagaacatgtttgcttccccttccaccatgtttgtaagtttcctgaagcctccccagtcatgtggaactgtaagtcaattaaacccgtttcctttacaaattacccagtctcaggcagttctttatagcagtgtgagaacagattagtacagtcagttggtactgagagtagtgtggcactactgcagatacctgaaaatgtggaagcgactttggaactgggtaacaggcagaggttggaacagtttggaggcctcagaagaagacaggaaaatgtgggaaaatgtgcaacttcctagagacttggagggctcagaagacagaaagatgtgggaaagtttgggacgtctgagaaacttgttgaatggctttgaccaaaatgcttatagtgatacgaacaatgacgtccaggctgagttggtctgagatggagatgaggaacttgttagaaactggagtaaaggtcactcttgctatgctttagcaaagaggctggtggcattttgtccctgccgtagagatctgtggaactgtgaattagagagatgatttagagtatctggtggaagaaaattcaaaaggaagcacaccataaaagtttgagaaatttgcagcctgatgatgtaatagcaaagaaaaacccattttctgggggaaaattccagccagctgcagaaatttgcataagtaatgagatgccaaatgttaatcaccaagacaatgaggaaaatgtctctagagcctgttagacgacttcacagcagcccctcctattacaggcctggaggcctaggaggaaagactttattttgtggggtgggcctagggtccccctgctctgtgcaaccctgcatcccagctgcttcagtcccaaccatggctaaaaggggccaacatacagctcaggccattgcttcagaaggtccaagcctcaaggcttagcagcttacacgtggtgttgggcctgcaggtgcacagaagtcaagaactgaggtttgggaacctccacctagatttcagaggatgtatggaaatgcctggatgtccaggcaagagcctgctgcagggacggggccctcgtggagaacctctgctggggcagtgcagtaggaaaatgtggggtgcaagctcccacacagaattcccactggggcactgcatagtggagctgtgagaagagggcaaccatcctccagaccccagaatggtagctccaccaacagcttgcactgcgcacctggaaaagctgcagacactcaatgccagcccatgaaagcagccaggaggggactgtaccctgaaaaaccacaggggtggagctgccaaagtggtggggacccaactcttgcaacagcatgaactggatgtaagacatggagtcaaaggagatcattttggaactttaatgtttaatgactgccctattggattttggacttgcatggggcctgttgcccctttgttctggacaatttctcccatttggaatgagtgtatttacccaatacctgtgcctccactgtatctaggaagtaattaacttgcttttgcttttacaggctcatagacagaagggacttgccttgtctcagtcgagactttggacttggactattgagttaacgctgaaatgagtcaagactttgggagactcttgggaaggcataattgtgttttgaaatgtgagaaagatgagattttggagggcaaaaggtggaatgatatggtctggctctgtgtcctcacccaaatctcgaattgtaatccaaattgtaatccccatgttttgggggagggaacctcatgggaggtgattagatcatgggagcagatccccctgctgttctcatgatagtgagtgacttctcaggagatctgatagttctataaggggctttttccccctttcctctgcacttccctcccctgccgccatgtgaataagaacgtgtttgtttcccattccaccatgattttaagtttcctgaagcctttccagtcatgcagaactgtgagtcaatgaaacctgtttcctttataaattaccatatctcaagtagttctttatagcagcatgaaaatggactaatacacccctgcagtgataaacattttcatcttttgagaataatcaaaaatagatgtgcagcaaaaatgtcataccattgcttcctgtgccctgtgatgcacaatggagcaatgcagcactcctcactagataaacattctgaaataacagtacagggcaagcagtcctaggaaggcagaccacagagcttagaaaaagtacacgctgcagtttgaagtgcaaaccacaatgaggcaatgaggagcttatgtccactctcaatataaaacatatctctgttaagtcctcaaatgcctatggttctctgcagtcacccattaatgacaactaagggaccatgaagggggagacatggactggcattgtctgctgcaccattcctggtggtttgattaaaaaacactgaaactggagaggatatgtttagaaaataattgtatgcttgcttcaattcagcttttctctccacttttaaaatcaggtaaagccaaactcatatatattcttattatctacaacaattactgtttcaggaggttgacatgtcttgttacctaaaaccactgaaaatttgaatgttgatcaacatttaaaatagcaagaggaatcttttcccattgcttaattttatttttttgagacagggtcttgttctatctccctggctagaatgcagtggcgtgatctcggctcacagcaacctctgcctctcaggctcaagcaatcctcccacctcagccaccctagtagctaggactacatgtgcatgccaccatgcttggctattttttttgtattttttgtacatatggtgttttgccatattgcccaggctggtctcaaactcctgggctcaagcaatccaccagccttggcctcccaaagtgctgggattacaggcatgagccaccaggcctggccaattttatttcttacttgactttttttgttggtgtagccattctcctattgatagacactgttcattttaatttttgactattacaaagaatgtttttgggaaattttaaaatttttttcttctcatgccaaaataaaagcttataacagaaaatataggcaaaacgtgaatatgtaaaagtttctgcaatcctacttaccctgaaataaccactgaatggcatggtggttgttatggtgtgtgtgtgcatgcaagtgtgtttacaacatttatctttttctgagtataagcttatatgtaaattttaaatttacatatatgaataagcaaatgcataaatttgtaaaaattgaatggtactaaacatactttttataagatccttttttaaccctgtaaggctattaaaatattcaaaacactatcctttttctagtactatgttcacaaagtattcattttaaaatatcactatagaacagtatattacagcaggcaaagaagttcagttgaaagttatactcctaatatttgagagagataagaatggatgaagtttgatgtacttaatcctattgcaataaagtgaactttcaaatatttcaagccttcactgcaaagtaaaataagacctattcttatttcttcaaaaattttatatattataagtaggtaaggtatctccagctgaaagaaataattttatggccagctttccaaaccttccaaattgtatatcactttcttctcttttaattctgctgtctcagatatttaattaataagagctgctgtagcaaggggcttgtccataattttattgtcaacatttctgagtcatctacttctgatttgttttaaaatcaaatgcaagatatttggctaacatacaatcaccatgagctaggaatataacaaataaaccaatgacagccttctctgatgcacccttactttcatctgaaccattgtgctaagaaaaattagttttttattccttaaaagtcttaagtatccttctgttatatctgaaacctcaactcctcaactccttttttgttagttgaccatcagccatcaaccaccatccagttaaagtcaatgatgtgaactgcacgcttaaaggtaagcaaaattcttttaagttctgctttgaaaagagggaacaaaacccttggtgacaggagtttgtaatctaataggggcactgtgattaagtgacatagtgcatacatgtgtgccaggaaacaaatctatactgagtacaatcagaaacagagatcctatcagacatatgataaagcttgcttaaggaagcttgagggaggagtgacaatctttattatggaaaagggtgtagtttgggaaaatactattacatcaagctgggaaggacagctaagagaatggatgacagaatcaggatataaaaagagcataaggtcaaaatataaccagatggagttaaatagggtcacatttgaagtcctgccctttggttaaaacaaaaacatctaactgagcagctgccaagagagaaggagatggtgcctaagtcaagcccttttagttaagtgcaggatgtcacaacgatacgatgtggcagccagtgtctatctaatctaaagtcactttcattgataaataaccccaggatgaggcaaagaaaaaaaaaagtctctatgatgttctgagctaattggattactttaggaatttctggaatttgctaatctttgggccattaaattacaaaaggaggttatgagataggagctagtctaatggggagtcactagaaaaggaaagagatgtgatggtataatggtagccaagttaaggaatagaaaacatagggaacagacctgatggttacagatacaaaagtgtcacatgaaaatggaatttcaggcagttgtgtgctgggtcaccaaaatgtcattcccaaagtttactccatcgcacctggccactctgcccttgaccctcgactcagccaaatatgacatatctctggaaggctggcagatgcaagctgaacggttggccataagagcccagctgaaacaagagtacctgcttcagtacaacaaccaactctaaccaccaagggctcatcgaagatcttgccttaattcgttggacctatgcaagatcagcaaatgtctattctaatttcagactcactcctaaaactcactcttgggagctctgtgtggaattgggcccctcttcttctggtattatgttttcaaaactgacagggataggaaagaaaaacttatccaggaaggaaaattggatggaacatttaacatctcatattaagtctggcaatgatgactataaggatcttgcttaaataaattgtctattaatcattaaaaaaagaaagaaaggaagaaaatggaatttcacttgccctgtgtgtttccaagattcacaggtaggagcaatgctacttagaagtttcacggaggccaaagttcagtgaaagcaagaccaagccaatgacacagagccagccaatgacacatcaacactgacaaggagaaggatgtgcagcaataggggcacaagcattgacctttgaagagtcacatcatagctgtgttagcactgaaccacagggcactggtgtcttttttcatcctgaaaattctgattcaacaaaaaagtttgtttccttcccaatttaccttcctttgaactaattaaacttctatcctcttcatccctcaactattaaatatttaaaaatatgttgaccaatttaaggttttgaaataaaaacattatatgaccaaaaggtttgataaattctcaaaagcataacactgtctacttctctgtaggtatctcgtgagcaccagatactaagctcccttgatgaaaatagcttttcaaaatatgatagatatgctagtgcactgtattcggaaaaatgtgagttcatatggacctgtcaggatgtaaaaaacatgcaatacttggtgtgtttcctaaggagggccccgggtaaggccccagtgctgtgcttctcacattgaaaacacatatgaatcacctgggatcttactgcaatgcagatggttacccactaggtcagggtggggtccaagaatttctaccaagtccaggtgatattcatactgctggttcatggatcacattttgagtagcaaggtaaggcgtatttcccatgaagcaccattgcagaatgtttattactaggccaatattcacctaggcatttctttgctttatatattaacacttctattgacacagatcataaaatttctgttttcctttctttgaaaattaaaatatatggtatactaaaacttaaaaaaaaatcagacagttttttcccccaggtacttaagaggatacaaacccatgaaacttggcctcaattagattacagtggtccctcaggatctttggggattggttccaggtcttcaggcagataccaaaatccatggatgctcaagttccttatataaaatgacatagtatttgtatataacctacacacatcaatatactttaaagcatctccagattacttatacctaatacaatgtaaatgttatgtcaatagttattatgctgtactgtttagggaatgacaagaaaagtctgtacatgttcagtatatacacaaccatattattaaaaaaaaaaattggattgaatacacagatgtggaacccatggatacgaaaggcctactgtacttggaagtatcaataggaaatttcatcaaaattgatggtgaatttcacatagaattaactctcattttgtttttatttatttagcatatgtaagccggtctctaataacaaaataattacaatgactatttttctccagctctaaatttattatagcaacaactcaggatcaaatataatttgagatccctttgaaggggtataagctgttggttgataatgatgttgagtagatggtccaaaaagactcagtctgaacatcctcaattgtttgccttagaccaaattctaagtgattgtaagaattcatcttctttgaatacggtgtattgaatttcttaatgaactctccagcaaacatgaaaaagtaaatgatgttatttgggcaagactgtttgcttatagaaaaataagaatgtcatctgtggagttttgaaacttcatcctaaatcatcacacatggttcccaggtgaagcttgtacatatattctgaagtagaaactgctcttttaatggtgatattcagaatctagtcaggctgatcattgtcctagtctcagcttttagcctcctgtttccttcatctgaaatgttcttgcccttcatctcctttgagtctatgcaaatgttaacctggagggctaccctattcaaaattgcatccctactgataacttcctatgtcattccctgacttttttccttagcacttatcactatccaacatatattttttacttatttttcttgaatattgtctatcttttctgtagttttctgctgctggtgtaacaaattatcagaaacttagtgatttaacaattaaaatgtatcattttatagttctgtaggtcagaagtccaacacaggcctcaatgggctaaaatcaaggtgtcttcagggttgcattcctttctgagtgggctaagggagaatctgcttccttgccctttctagctgtccacattccttggctccaggcccccttctttcatttccaaagccaacaaagttgcatctgtctgaccctttttctgttatcacatctctctctaacctaaccagggaaaagtctttgcttagaaggacttgtgtgattagattgggcccactgggctaatacggacactacatctcaaggtctgtgcccctaatcaaatctgcaaaatctttttttgcatgtgaggtaatgttcatttagtccagggattaggcagtggagctctttgcaggggctattattttgcctatattcattggaatgtaagctccaaaaggtcacagatttttatttgtttgattcactgttatattcctagcacttacagcagcacctggtatatagtataaactcaaaaaatatttatttcagaaaattaatgaaagaaaattggattgggctaatgatgtcatgacaaacacatatttgaagtgcaggcgctagacatagacccttactagatttttttgttttgatttttgagatggaatatcactctcacccaggctagagtgccgtggcgttatctcagcacactgtaacctctgcctcctgggttcaagccattctcctgcctcagcctcctgagtagctgggattacaggcacctgccaccaccatgcccagctaatttctgtatttttagtagagatgggttttcaccatgttggccaggctggtcttgaactcctgacctcaggggatctgcctgcctcagcctcccaaagtgttgagattacagatgtgagccaatgcatctggctagcctctactagatgtttgaagagttaatcacttgaattaaataaaccttagtcctcatttgaaaaatgagaccatcactttgcccacttcatagagtggtttagagaatcagtcaatgtgatctgcactgaagtggtctgaaaattcttagctaaagaaatgtaaattattgatactatactttttaagtcggtcttagtatccttacctaaaaatttaagtttctttgagctcaaaatatcagccattttggtcacagttcactcctcagactttcagaaaccccattcaagatgctgaaaaagatatatgggaaaatcttaaagcatggcagtagccttctttggtttcttttttgccaaacataccattcctcagggtcattgccctagactgagtgtagcatgattggaccatctgagaagatggtgggataacagaaagttatttggagtcttcagacctcagtctagtccaggctctttttgactgggcatttccattagtatctccaagccaccctgctgcctagagtttatcattctcagctacatgttattaaaacatgttagcaagtactgcagtggtgcagaagaaaggccctaagagccttattgtttttatttccttaaggtaggactagaacataatttaactaacacactgtcttcatataacttaagtttataaccagtatcatagaaaagataacatgcccacaaatacttgtagaattattttgctgatctttcaaaaaatggcacttagaacttttatcatctatttttagaatatttgtacaaggaaatgggcctctccaattttattgaaaacatttgtcaattttattaaattttttaaaactcagaatttgcttggaactcatatgcttatatttactagaagactaaaaatctaaaggtttaagatagaattttctattgccttagcaaatctgtaatgcccaaattagaaaacagttatttttctccaggattgatgtaattaaaacactaaagggtgggggggtcaaacaacaacaaaacagtcttaatatagatgtggtttgtttctctgggcctgtgactacatatggatatttggaaacattacagtgtttggcgacaacaaagctattcattgttagtcaacagatatgcacactgtggtgaaaactcaaccaataaaattgttaatttaatgcagtgattctcaaagtgtggtctccagactagcagcattagtgtcacttggggtcttattagaagcaaaaaattggaggctgtaccacagatctacagaattagaaattttggggaaggggcctggtaatgtgtggcttattggcccttccaggtgattctgatgatcattagtggatgcccttttactttcttaccttaaaatatcttataatcttgtttgatagtgtatatgaaaaagcacaattgctttttaaaaggtgaaaatctgagtcagcaattaaggctaagtcatatctaaaaatcatgtgggcagagtattttgaaaactagatatttgaatcagctgaaaaagcctctgctgcaacccaaacctaaaacctcccctaaaacccaaacctaaaagtattatttattcaataacttacataaattatccatgtaaaataaacattgtatatattaagaaatgcttttcacatgttaattgaaatctagcttattttcttggaattttctcttgcattttagacatattttccagagattgattttcttgctctaaaattttattggcaacccaaaaaaagcaaaatcaaacagacaagccaacaatattctcatataatcaaccagattttttaaatccagagtcttaaaaatatgggtattttcccctgcgagttaaataagcacaaaacaaacatattgtatggtctatagttttattttagtaactggaaacactattttgcctgcattccaattgttataataaaggtgaagcaaaagtcctgagacagcctcaaggatctggtggctaattctttcaacagaaccaagggcagggtccgagatgacaaggtctgtttcagctgggtctcaggtgagtgtccagggtatacagaatggggttgaagactctttccacaagagcagcagaatagtatgcacatgaaagtaccccattaccaagaggccttgtgggatgaacctgtgtgcaatggagttacaccatccaggacttcctgagtagaggattttgggttattggtaggcaatggagagccaatgagatttcaggttgtggatttacatatcacagtctctttttaggaagatgaactccagccaaagtgtaagctctaaactgaatcttacagagcctgttgtcaggaaattctggcaatttctagcttgacaaaaggccaggccaaagcagtagtggtggtgatggaggccagaatgtgagaaacctttgggccaggtttgaatgtgatggctgaaggaaaaaataggaaacaaggtaaaatcttgggcttcttgttaagtatttattaatattgggtatgatgcttattctgcattacttatccatgcaaactattgaggacaacaagataattttgtgcttagattggtgtgtgtgtgtgtgtggggggggggtcctctatcatgtatctagctgattcaaatcatttttttctaaatgataggaacaggtgaaaagtgatatccctgggagtccgagcaagtagggatgcatttcttaaccagcagttctttaagtggaagtctgtgaacctctaaagcagcggagtcatgaaagacatttagaaaaatacagtcacctgggtcctgtccccagaaagtctgatgtcatttttctgggtgtctggcccaggcatcagattttttaaagttccccaggtgattgaaagtggataagaactaatgcttgaaaatataagtgaaggcttttttcaattagataatataactttaatttcattctgttgatttgcctaataatctgttgtgatgctaatgaaaccaaagtgttacatatttacctcctagggatgatgcaaaaacaaaaagataatatgtgataaagtacatcaagctgatacctatttgggccctgttgtcaacaatagtgtttcaactttttcctacagggaataaatacttacataaatcactgggaaaatacagcaaagtagcataatttctttgcttttacctttaacacgtgggctataaaattgtctataaaacactatctgccacaacttataataaatacatcctttttattgacataagatgggtaaatatagtttttaaaaggcatcagaggagctataaaggcaaactggatgtcaacacccattttgagggggttaatttttcttccaggaagtttataaatggcaggtcctggaaatcctaaaatcgctagatggactttgccttgcacatacttgacattcaataaaaattctggaaatgcctgaaaaagatcagcacatgtgttgtcttaatatagcacagtaacattacattgtttgggatgggttgtgctgaaaaagttgatctcttccaagacttaaagaatagtgtctgaaatttagcaacaggaaatctgggcagatgtgtaatgaaagtgctgtgaaatgattagaatatctaaaacaaagaataaaaataccatggatttggtaatattggatacacgaaaatggaatatatcaaatacacatgaagttctatctggaaaatttaaaaaattagcttttgggccaggcatggtggctcacgcctgtaatcccagcactttgggaggccgagatgggtgaatcacaaggtcaggagattgagaccatcctggctaacacgatgaaaccctgtctctactaaaaatacaaaaaattagccaggcgtggtggcaggcacctgtagtcccagctactcgggaggctgaggcaagagaatggcgtgaacccgggaggcggagcttgcagtgagccgagatcatgccactgcactccagcctgggcaacagagcaagactcagcctcaaaaaaaaaaaaaaaaaaaaaaaaaaaaaaaattaccttttggctacttttaaagattttccacatgaatgttggaactacccaactttcaatgaagaagtcttagctctatgcatttgcaatatttaacttctcccactttttccaaatctcttagatttcagctgttatgacacatttctaagacctttattcagacccttacaggcttttgaaaagactcttttttctttaatatgagatgtattgtgtacctattacactgaatggcactatagaaaaatatggctaatctgtatttctgtactctttgtgaatgacctaaatacaatgtttaccaccacaaatttggtacaacctacatgaaataagacttcagttttaaatataatactgttccacatagtatgacaaatatatacttggtatatgaaccatttggtatgctacaatacgacccacccccaatttaaacaggcttatctgaagtttacagaagatttaatatagtttactagatgattaaatataggtatggttgtgcgtgtatgtgcatgcacacatattttgctgagtggttaatataaaagctatgatagaatgtgaggataaacactgtattagctaagtactgtagagtaaaagaattcagaggacctggactaggataaagagcacaggaaaagaagatgagatttccataaaacaagctttgacagctttgaccaactcttaactgtctgcctgtagtctacattatgtatgagcagaaagtttgtatttcacatagaagctttccagttattaattaggaaaatgtttacatatggtatgtcacatgagtaggtttatctccttagccgaccaaagtaatgcagatattaaaaagaatatgttgtcagaaataaattattcatgcttcctaacttttctaatttggtaatttgaaaacattaataggatttggtcattcttaattgtgttgatgactatccttgctctctttattctcaaggctagttgaaatttatctcatttatattaatttttctgtctgtggcttctcaaaagtaaaataacttcagaagcttcataagtatggagaaaatgttaggtgaaactttgcagaatcatttataatttatatgagatttttctttagtttttgagaactatcacttgaatatgtaatcatcaaacaggtggccttccacttatttgatatgatagaagaaaacttctaacattccaatttaaatattttatttgaaaattcactgctataataacactataacattaaggagagctgtgttgtaaacatagtccttctttttaaaaatgggaactcttattttatcctgtagctgttatattcatctactcatttttagtgttgctttcaccaaacaacatgtctacagtaaatatatttccattttatgattacagggaagtgattcctaatgaaaatgagaacagagtgctcaaattggggttagaccatccctgttgtgtcatagtttccactgttgaagtaaaatcccaactgaaaaataataggtcttgttagttggcaggcaggtttcactgagtaaactaagttgctttctaggattttgtgcagaaaaattctgcaatgctaaaattctgcaacgctaaaattcacataacacttaaaactgacatcgagagtagtggcccaatcactatgggagtaatcaacaactgtaaaagttttttggctttagcctctgctgtgaaaaagcatgagaagtatttatgagaataaagaggcctaagggattgcattttccacagtttattggacatctctacttggacaaccacagacttctcagaccctactagcccaaatggaacacataatttcaccctcaaactcactcctcttgctggaccccaaactcagtgaatggcctactgttcttctagttgtcccaagtgtcttcctgttcctcgctgtcacacatattgaatgccagttcccgttcaatctatttcctaagtagctatttcctaaatctctttacttttcattctccccttgctgctggtccaagccatgagtaccggtctgaattattgcagcaatgtcccagctggtctcctttccttcagcactgtccttccccaatacactctctacagcacagccaaatactacaacctcaaagactttcccttttgttggaatgaagtccggaattcttaacatggatagcaaggcctgttattttctcttccttgtattattctcagcttcatctcccatcattctccagagcatgtgcaactgtcctctctgcaccctaaactccaccatatgcacattcagtaatgtggtaatgtcaagaactctccactttccaactttgcatatgctcttgtctctgcctgccctgtccatcatcttgctaatttctattcacactgtaggctttagtgcctcttccatgaaccattcatgaactccacatcacccagtcctaaaatcaaggatgactgcttgcataacatcctatattctgcctcatcctggaagtgattatacttcattgtaattgatgtttactcatctagctttaccactggacctctggcttcacaagaatcacatatgtgagtatcttgctcactgtacaaccttagcccattatagtgataagcccatggtaggtgctccacaaatatttgttaagtgaattaatctgaatgcagatatgtacaaagaccacagagttcagatttttgtctatgcccttagctatcatgtcaaagaactggagggtagtgcataataactagctgtcttattacaacgtacctccctgcaatacagtttcacccaccctaccccccaaaaaattctaatcactagccagatttaaatctatttgactctacttctttcagtgttggtaagagctatagcagccattacttaagaagagagttaaattactaatatctgtctacccatttctctgagaaaatgaaattacttctctacataattaaaacaccatttctttgaacttgatgaagaagccaattttcttttgtgttcctgcctcaaaaaagaatatatgtctagagagaatattagagaagttattccataagatataactttctgctagaataaacttcattattcctacaaaattatggaagtagctggctatacttctctgcttacctcttaatttttcaaaaataacaaaaataacaaaactaaataaaagtctaccccatattttctaaaatagaattctgctaaaacacacacacacagacacatacatacacaaacacacacacacgaactatgaatttctataccattcttcaaaattctaaatattgtcaaagtcattttaagagaaacagaactagtttagttagtgtacatctgtcctatggtattctttgcaccagtggatctcagactctagcatacatcagagtgtcctggaggtctttgtaaaatgcaggttgctggactgctcccttccacctagagtttctgattcattaggcctgagatggaaccagataatttgcatctccagcaagttcctaggtgatattgatgctaacctggggaacacgctttgagatgtgacttatacgtgtaactaacagtagggaagcacatttagttctgtccatgcagttctatcaggcattttgacatgtgctgtcctcttgctctctttctttcattttttttggtaccaatatctaactcagcattactgcctaaatacataaagcctgtattccatgctgaaacttaacagcacaagtgtacatcatttaaaaaaacgaaaacaaaaaaaaccaaaaaacagaaaaaaagagggctatttctgcaagttaaaaaattaaatggaaaaacaaccccaaaattgctctaaggaggttttgccttcaatagcaaaacatgttttgcctcaattgtgatttctttgttcgggagccaaggtggcaattaagctggcacaaggagcaggagccatttatttaatatgatgacagcgtagccctttgtaaatcctggaacaatgagggcccacacacaggctcattccaagttctagttccttctcttccctgttgctcagtgtgaattctcatagccacaaaggaaggggaagattttcaatcctgtcacatcctcccccatttaaaccatttatagtcttaacttataagatatgagtaagaaatcttctttaaacattttgcagagctgatcatcaaatctaacaaactggtggttttgaaatctcctttgctccaaagacattccattaacctctgtgtcctctgttgtgtcattgtgctgagaagagcaagttaaaaatccagtcttaattggggcttggtggtaggattatttttatcttatagatttatttcaatattcattttaggaagaaagaagaccttaggaaggtctaattctcatcagttctggcataagctgagttagggatctcagaatttaaagaaacgacgcccttaataatggcatctgaagaagcaagtgtaccatgctgtgacaattacaagatactacatcagttcccatcctctactaggctcttttaggatggagactctgtctggttcactgctttatctctataatttacaatagtactcagaaaatagaaggcgctcagtatgtagcaattattgcctgactggctgtctctgtaagcattacagggaatgtacaaccaaaatgtataaagtgtaacatgacaccaaagttcataaattaaatgttatcaaaatagattgtttttataaatgaagaaaattaatcagaagatatctttttagaatataacaacctctaacacccagtctacaaatatacccatcatcaaacttctggcaaatgttcaaagtaaataaacacctatcatgacttaaatacctggctttatacttcaacagtgttcatatgagtaaaaacatttttgcttaagttgtctaccagtttataatatgggaaggaattccccatgggatactatctcctccccctttatatagggaatacaagtttggctaaatactttatcataattgtgcagaaagcacatggccttataaaagggcaatcacatatattatcaatgggattgatactattatcaatggtttcctaaaagcagcctctccattttgcaagtctatcaacttatagttctttaccttcccttcagctgaatctactcacttcaggctcagcctgagttcctgaaagaatcctgccagggtgggacccattataaggattttaattgcatctaggtcatgacactcagatctggatctaggggtgactgctggcttctgcatgatctactcttcttctcaggctgcccattccctgagatctacttcatggacactagatcctgtgcctgatgttcaaattaggatggcctcataccacaatgttttgttgccccttctagctttggatctcctgtaaccccaaatagcctaatctatgccgggccctcttatgcccttttgatactatttctcaaatgactcacaagaccagcctctaaggtcaagctagttctcccaggtctcttctagtatcctagtgctatttttttctctgccaagttctgatttcttttccagtccctgttgctaaaatcctactgaatccctcacagccacccaaatcctggcaaggtatgattttaccatcttaagttcattttcagggctgagcgtataataatgactggtcatgcagcacccagtgatcacactgtacagagagtacagacattgggatggaggaagggcaaaaagaggcccttgatactgaaacatattttcagagagtaatataattggtgaattctcatatgctgtgaggatcaaattgatgaaccattttagcactcccacaagaattctgctccctcatttctgcacagaatttcatcttatgaaaaagttccacaattgttaacatactatagcatctcttcatgccaagtagttttgtattttaagaattacaaaatgcactcatcaaataattttggcacataatatatatttctaaattccagaacaaatctctctcttgaaattctatttaaaatacaacctgggcttgtacaccatccagtatgatagaaaaacatataatcaattcatagaagaccaacacctgccctacaggtgctagaatttgacatcttgttgaaattagattgaaatttagtatacagtatgtaagaaaaaaggcagactacaatatttcctgctagtggacatcattcaggcctcagagatgaaatgtgcaaaactcttctagaaatactaatcaactgaaacaagccgcctccaaaacagtaatgtggtcagtctgcatgctgccaggtaatttacaatccatgacaagcagagccaagtgaaagttatttacatttattctactggtagaatagaagagatgagagtgaaaaggatctgctgaatcagatcatgtttgactgaggagtgacagggaagttttcttcaattaatagccagctgcataatttgagctaatgccagctggactttcatcatgaaacgacacagaaataaattattctgtactcaggtgctggcatagtgaagtgaattaatccacttaaatctggaggagggagagagaaagtagattacactatctgaattttttgagcctgttttagccacactttaaggatactgaggttcatgataattattaaaatgtccaagtggatccatttagactcaaatacttgcttgaatgaacaaattcttagaagggaggaaccagagtagaaatggctttatcaaggtcatggtggtttctttcaccaattagtgaaattcatattcaactcagaaggtcagggggaagtgggcaaaaagagtcttattaagaacaactttataggggaattcttgagggggtaaaaaggtgactacaaagatataaaggaatccaggacaggtttagagaggtcaactgcctgctggttcattcagaaaagattaacagacccagctgctgggacttttctggctaggcatccttcccagtggtcacaagtcaatgtgtctcctggctgcttggctatgttcccatccgtctggatggaagagcgcccacccctacacgccagaacttttccttaggggaaagttactgaggttccacgtcaggcaaactttgctcacccatcacttcaagtaaacaactcttctatggagatttcttagagaaaaaatgcacttgaaagcatctaaccaaagcaatgaaggtggaaaaaacaagttatgtgggaatctgagtatagaatatacagacataaaataagctctccaaatgaggaagcagtcacagcttgacctctgaattgtttgctgtttgttccttcaatattcaaactgtagccctggaaatacaaacacaaacttctaaacactcacaggcctgtggcaacaaaatgctacatgccagcttcacaactggggcatgcagaccataaatcctgtagtggcaggaggggaggtgtggaaatagactgtcatcattctgcagcaaggaaaactaggtacaaggaaaaggcaactggcaacacattcctggattctctcattcattgaagaaggaactcagggattgaattacccaattgacgctagttctacccatgccagagggcaaaagttccaagactgccacaggccatggttgcttggaatttaggcagaggtgcttggtccttagagtgtagcagagagaagttctggaaaaggagctcctcatcgagtctggtaatgagcacttctattctgacatggatttcagaggactcaggggacaacgtgcccagaatttaacccttttaatcagtcagcatgagagataaatctaatttagctatatgagactgatgagaaacagtctttgccgtctataacacaaaaggaaaaggacaaaataagaagcccattacttttagttaacattcagagcaacaaataaattcctacaatcacatagcacctggttccatcaatggttggttagtctgggagattctaagctattagctggaagctctctccacagtgagtagtggggagaaggggagaagcgagctgttagctgaattagcaagtgtttttacaaatgtcatatgtagtgtcaatgtgtgtcctaaatgtaacaccctgccaattcatcaatttatagacagaacataggcacaatttctagatatgagattgcatgacagtgtttctcaaggattagtttatttctttcaacacaccctttttgatacgaactgctttattttctagcactcactacatctcactcaaatgtgtggatggcaacagaaaattttgatcattactcagagtactgattttatacattatcatctttaaccttacagtcttctgaggttaaaatccaattacataaaaagcaaaagaacctcagaggtaaagagaccagccaaaatataactatgccctagttttacccctgtatttttattattttgtggggtaacttttatttgccagtcttccttaaaattgtaacttctttgaagatgggaactccatattattcatcttttcatcttcagtgcctagaacagtgcctggaacctggtaggcagtcagaaatgtgagaagtagatgcaggccatgcagccagtcagcaacagtgctgggttttcaatgcagaaatgtctgattccaagaccactcacgtaaaaaaaaaaatgttgcagtttatcagtgatgtttggcaaaagaatggatgttgatattagtttacccagtttcattctaggtagttcacaaccaggagcttctcaagaaatacttgtttacagaattcatgaatccaaattagctctgtttcccaaaaccatagataactggaaactaaaaattggataaaagtcagcttcaacagaagaaaaaagagtttgtattaaatatgaatgagcatttactttgttaaatgatatgtgggcttttcacctagattacaggaaaattactctagcatcaatttttactttgaactttgaagaactttgaagagctatattgagtaaaacccaaagtgctctccgcatgaaaaattctagtttgcccctactgtaaaaattcacaatataaatataatcatgagggtattttctttcatagcatcagtcatttaaaaatacaaatctttgaagaaaaaaaaattgttgacgaagtaaaatagcattaaatcctgtaaaaagattacaggcacaaaacctgaggattttacttgtaaagttttgttgatggagtcaaatactcacttgcattaactctctttccaaaccctgagtccaccccttcgtattccacttgtaataactaatgttaatagcaaaaatatatttatactggaatgaacaataagcatacaacagttgtttggtttaccaaattccctttcattcacagcttaaaatgtaaccaatttagctatgacaatgccagcttagtttatccaatagcacagtaagcactattcctagagctcataattttaggagctcatagaaatgttaaatctcttttaaaatctgaaaaaatgagtacaaaacagtttagattatatttatctttacataaatgcagctacaaaatataattttgtattttttatgaggaggggacccacaaagccaaaagtgcgttgcgctcatcaaaatcatagtgagctagggtatttttaatctttataaaattgctatggcattattcgttgctggaatgccaggagcatgttaatattatgtgccttttatttcttctcacccactaaaaaaatctaatctcacgaaaaatatggaaaagtcttatgaattggattggatatgaacaggatggatatatgacagatgtatacagatatatgatgggtatgaataggatgaatggatataaatcacaaatccaatttaactgggcaatgaaagaaaaaaaattcctaagaaagccttcctttcccctatctcacatcttttacctagaaagcaacaatttagaaatgattacaacttcagagaactgaaggaaaagacgaactaccagaatattgtggcttcataaaaacaccaatttagaaatgcttacccacaaagcttctttttccccttaacactggatttgctaattgaattgagcaaatcctgaatccagctggatatctcagtatgtagtaacaccaaattactgagttagtactgaattaataatctgaactgggtgagtatactcactaactttactcagttactaaaaggctagtatcaaagctaacgtcagaaatgcccttctcatacagtacagcataaccaacaacagtagttcttgtgggcattatgctttcatgccaaccaagccacaccttgattttctgactgtgttgcctatgagttggttctatgttcatccattaataggatgttgacttattaataaatatattatctaattcttcctctacctctaactattctgtggaatagataaaataaggagtaaaaatactttcaattttgaagtatttgttaagtatcttggcatagaaaaaggcaagaagtaacatttgaaataaatttgtaacattatctgtgaattttatttatctatgaacttctatcagttttttataggaaaaaaaggggcagtatatacataattcaaataccaatagttggaacagaaatttttaggatttctagcacattctaagtctcttttgaaaaattataaaatcaaattagaatttaacaccttgcctatatgaatgtcataataatatagaattatatgaattatataagaaggaaataagtaatgacaacctcaagtaaacgttcacttttttcacagccaaattttgacttttttgacagttttatctcagataagaattcctttttcctttcaaaatatcattttcacaattatgctgtgaaatatgtggtcatctgatattataggaaagcagaactttaaaagacttagaactacattcctccctgttgtaatgagatactcttcacatatgaccattttttctggttacagtgtatctctgaatacttgtcatgcatcttctcctcttattctgataaagaattctgattttcctttgattaatccccctcctactgatggaactgacctccacaaccgggacacacagaggcctggtcagtcagtcacaattgactcaaggttgacctgtaatccaagtgcacacgtttcaagtcagccctgggttttccttggaactactgggagatgtatgctctcatgtcacaagaattactacaggcagccttgtgctgtctgagctttctttgctaccacatagagaaagtcttagaaacacagtgagacagaaggagagaaagagaaagacagagacaaacgctcaatcaaatcatgagagggcctgcagcaatcctcacaaccattaaaactagctgtatcctttgaatttttgagtttcaagatcctgcaaactgctattttgtttaagtcggcttaaattcagtttctattatttgcaactaaaggagaaaactctaatactgtatttcaccacatgaatattttcaatgttaaggaatataaaagaaatcttgatatgatgcaagttcactcttgcttacttactctttgctatctttatatttgattgacaacaagggactccaactgttgcttgttgctccactggggaaaatttatttattcattcattccttcgctcattcattcaacaaatgcttatttcacacccattaggtaccaggcacccacctaggttctaaagattcataactcaacagaatagacaaatgttctaccttcataaagcttacgatctggtgggatggagtcaacccttaattaataaataaataaaaatctaagtgtgctgaatagctacatgtgctacagagaaaaataatgcaggaatgaggatacagaaagtctgcacttgaggataggttttgattagttgtttttaaaaacagatggtcatgaaaggtcttattaagaaagtgatatttgagcaaaggcctgaaaaaaaatggagttccttactggggaaagtatgggtcctacaacagagaatagtaagtctcagctctgcagggtgcatggcaaattttccttacaggagttcacctagttacacaagagagaaactcccatgacaccccactagaacttttttctgctagctctctgagggaactgggcatatttgttctgtttcactgggcaaacagaaataggagttaggggtggctgtaggttccacgaatcattattattttcaatgttcactctctggcgtaaaggctgtgaggtgaattgctgactaattttataaagcacctggagctcctcagggcaaaggcactatgtcaacaccaacattaaataaatagcaataattggccaagtcctctggtggtataaggcaaataaaatatgttccctcttggaagttcatgacgtctgccaggttaagcaagaatgaggcaaagcacttttagaaagctactttttctaccattgtatatggcctccaaacagccagccactgtgaaatgttaagtgttcaacagcaaattaaaactgagtgtgtttttcattcactatcacaacaaggtactaaataaccacttgagatatttgttgtacgttatcattttccaggcagttttactgttagctagaaataagagtagagtgacattcgtttgattagagcagaaccattttccaccaatttttagagcacatgcaaatctctttagcaaaaggactttttcaagggttgaatctcttatagtttctcaatgtgaatgttaattaaagaaacctaccaaaaccaagaatgatttcaaatggttatagggtttcaaatggtagatgaaacatgaaaatatatataacctattaacaagatatatttgtgtctctaagaattctataggggaatatacatttcagtgaaactctgtacccacccaacccactccacagcaaaacaggcatttgtgagaaagcgctatatatatacacacaaacacacacatgtacacatgcacaatttataaataaacatcaggatgttaaatttaactaattttaactaaaacaagggatagctcaggataaacttggttttactctactaactccaaagttcaataaataataacaattttctcaaggttattaaccatcaatactcatagaattatgaaatatttttgctaaaagcatttagaactaatctagtatgattcctttatttcacagatgaagaaacgaagtgtcacagaggtctctttgctaggggtaatctatgtgctgaaaaccacctataacactttgaaccatacctgttgttggtattttgtgatgtccgtctacatgttttccttgaatgactatatattttttattataaaaatgggctctcattttatgtattttttattttttcatttaacataatgaaaatctaccatgttaaaaattatccttatgcatcagtatcctatcatacacatttaccttgataacatatcaaggtatattgtgctaattcccgctgctgaatatttggctcattttttttcttggcacattttcagttttccactataataaacattgatgtaactaaatcttttcacatattcttaatttttttcttaggataaattcttcaaagtaaaattgttggttcatagtgtgacttgaattctcttctagaaagctactcaaactttcactttcattgctaatgaataagaatgtcctgactttagtcaatacgctgaatttgttatcatctagttttgactttgttttttaatcttgaatactctttagagaaaatgttagttcactattgtttaatttgtatttctttaaagttggggttttattcatgtaactcaccaattgtgtttcttatggattgtgttcattttcctggaagaaaggtcatttttttccttattaatttctaagaatttttttttttttgagacagagtctcactctgtcgcccaggctgaagtgcagtggcatgactcagcttactgcaacctccgcctaccaggttcaagagattctcctatctcagcctcctaagtagctgggattacaggcacgtgccaccacacctggctaatttttgtattttttagtagagacggggtttcaccatgttggtcaggctggtctcaaactcctgacctcgtgatccacctgccccagcctcccaaagtgctgggattataggcgtgagccaccccacctggacgatttctaaggatttttaagacattaaagtcaatgtctctttagtaacactggaaatagaatcccacccttttcatttgcctttacgttttctttatggtgtttttgatgtgtagaaaaatttgattccttaatgtatacacatctatcagacattttcttcatgctttctcgctctagtgatatgcttagaaatatcctccctatgttgaaatttaaatactcatttttattttattttagtaattttaactaaactactttttagttgttacattaataaaattatatattatatattaatgaaatctttatttaaataaatatttaataaaatatatatccaatgtatatttttatataaggtttaaagaaagaatctaactttatattattttcccaaacgatagctgttgctttcaacaccatttattgaataatcatcccttttctcattgaataaaatgctacttcagtcacacacacacacacacacacacaaatacataaatgagtcttatttgaaatctatagtctatccaaatcaactttatctaattcttcatttgagccaccgtcctaattcttacaatattatatattacatgatatatgttactgtaatttttatgatataatctctggaatggtgtgttctacatccttccaacctttacccactgtgctttatttcaactttttcttgattttcccatgttagcttgatttttgaaatactttattaaaatcaaaaataaaatgtgattggaattgcctatagtggaatgaatattgtggattgtttagcattagttaagacatttttgttttcttcacaacaataccaaaaaaacccttctaatttcttattattttcactcataaatataggtgtagtatgtttttgtgactagaatcttgtgctatttaaaaagaattggccgggcacagtggttcacacctataatcccagcaccttgagaggtcaacacaggcggattgcttgagcccaggagtttgagaccagcctagggaacacagcaagaccccatctctacaaaaaatttttgaaaaactgtccaggggtggtggtggatgtctgtagacctagctactcaagaggctgaagcagaagaattgcttgagcctaggaggtgaaggttgcagtgagctgagattgtgccattgtactccagcctggacaacagtaagaaagtaagtaaataaagaggtattttatttttttcattataatatctaactgattattactttctataaaaaagctaatagctttcttatatgtaattttgtatttggctacctatctgaattactgaatcatttctaataacatttcaactaattcctttggctcttccaggtaaatacccacatagctataaagtcagttttcattttatattttatgtttcaagttgttgtactagaacaataacttgacaataactatacaacttcccaaacaaatattacatacaaatattatgttacgtcttattgcttataactaagctgactttaatagaaacgactcacacttaaaaattggtttcaccattgaaataaacactatattcttctgttgctatttcactgcatccttttaaaaaaaactaacaacaaatggatattaagttttagtcaaatgccactgtggcacctgtcaatacaagtctattgctttttctttcaccatattaatatgatggattctgtgaccagatttgatcaaaattaactatatgtacatttacagactcggccttatttgacatgagcatgaatcttttaacaaaatgcaagattcaatttaccaagttgtatttaagattttatctaccgaaaagtaagattggttgagggacttccttcttattgcaaataggtctacttgatagaatgaattgaaaagttgattttcttttcacaaactctagaaaatttatataacatactatttgttccttaaaagtttggaaacattttctcagaaagtctctgtgcctgacatcttttgaaggactgtttatttaaagcaatttttctaattttttttctgacagatatcgctttgtcaaggttatatacttcactttgtatcaaatgtggaaatatatatatttttgcaagaaggcacaatttaatcaggattgtctctctccctttccgtatgtacatgtttctgactcatcctaggcccctcactttccctcactcccatagaactgtttcaccaactgttaggtatgactgctgtctcattctctctcaccacagaaagctgggaaaggcattttaggaggtgagaaataaagcatcctctctcaagtttttgccatcccccaagagttatatgtggggtctccatgccaacagtccactcctctgagatggttttccctaatcacccgcaagtaacttttcacttttaactttaaaagagtgagcagggctccccttcctcataacctagctgcgaagcaatttaataggtgttccatgaaatttaaaagcagtagtaagattcctaacagagacactcctcaactttctccattctcacagcctgtctctagatatagggagttctttggaactaatttctgaaagaacacgtactttttcatattatataacattctaagccacattaaaatgaatgcttggtgagatttttcaagcagatatttaaattattgtatgccactgagaaagattaacagggcataataagctatacttaatattttaggaacgagtatagtaaactattgtttaataaatacaaggcaaggcaaacattacaaagtgaaatgtggaagaactaaagcttctaaaataattgaaccttccctctagcagcccctcacagagctctccgtcattaaccaggagtataaaaaatagagcaaagtatataatacaataatagctatagttttttgagctctggccacatacctggcataatgctagatgttatacacattagctttcttcctcagggcagccctaaggaaaaagagcaaaggagggctgatgtggtttatagctcccatatgccaggccccaggatggatgagtttgtaggaactagagtctcagatcctaagtccatagagttaggaagacacaattaataaggcaaagttcctgctcttgacattgtaccactgtttcaggtttgactcaactttttttctgaaaataatgattaactttttatagttgtttacagcctgccaggcactgttctaagaactttatatgtatcaacttctccttgaatcttcacaaccactttataaagtaagtatcatgatggcccccatccccctccattttttaggggagaaaattgaggcttaaagaagtggcctgcccacagatggcaagtgaccaggccagagtccacacccagactatttaactctagactccatttaactctagactctaagcttttaatcactaaactttcagaaatgtctaccaagaaagatggctaaatttggcgagcaatatctaaaatcaagtccaaaggaatatgaataaaagcatttgaaagagaaggctatgatttctcacactatgactagcatttttccttaggtgtcatctatgctgaatctccactgggcaggaaacacaatgaaatacaactgaaactgaatggaaagttaaccatgaaacgactggaggaatctcagtcagaactaggtctcgctttaccaagagaggtcagtcatacttgacaatagaggctttagggcccttttcgatgttccacaccataatttaaatgatgcagtaaaaacagaaaaagcaaagagttaataatcatctgaagaaatgtgcttccattctaaacttccaagggggttgggggtgtaagaagactaaatattgtggaaagcagcttggtgacatctgaaaaggctaaaaacagaactaccattcaactcagcagtcccattcctgggtatatacccaaaggaatataaataattctaccataaaggcacatgcacacatatgttcgttgtagcactattcaccatagcaaagacatggaatcaacctaaatgcccatcaatggcagattggataaagaaaatgtggtacaggtacataatggaatgctatacagtcatacaaaaatgcaatcatgtcctctgcaaaacgtggatggagctagaggcattatccttagcaaactaacgcaggaacacaaaaccaaatactgtatgctctcacttgtaagtgggagctaaataatgaaaatacatggacacaaagaggatcagcatactggggcctaccagagggtggagggtggtatgagggagacaaccagagaaaataactattgggtagtaggcttagttcctgggtgatgaaataatctgtacaacaaacccccatgacaggagcttacctatattaaaaaaaatctccatatgtacccctgaacctaaaataaaagttttgttttttaaaataagatgaaatgcatagggcaaaggtaaatctgtttgtggaaaaacagcaaaaggaagcactgtttcctggcaataagtataactcttttcttaaggtctgcccttctccttaccccgatctccaacttgttggaaagctaagattattgaccttctgtgaactctgtatctagttaacttctttcattcaaccctttagggactcaagcaaacagcatcactgacaccattgacagtttgggattccaaggtggctatgcaaattaatccctgtctcttgctccactcctaccctcatcactaatcctcacttctcctacaaaaggacattgttatgaagcatcctcgccttgttttcagcttgtgtgtttttgagccagagcttcattagaatatgaccatctgtgctccctgggaccttggtcacctcaatttatttgctggaagatgtggaatgatcctatttcacgtgaatatctagctcagtttcctctatttctctaaatgtatctcaatgtcttttgtgctttctggaaggtattagagtttatggaccttgctcttggttaacattaaaaaataagctttctacataatatagtgtaaaaaagctatgtcatttcttcacttttctgactactaagttctcttgagaggcagtgagtgtcacactgcactactagtggcctgcacatctgagacagagtatctcttacacacttgtgaattaattcctaacttctgtataatattctatttacattttttattcaaattctctctcattctctgtacatttctttagcacacactagatgtctgctgtgccaggtgactctcacttattcagcacagcaaccctaagagacacacacatttagtactgaaatattagagtggagagaacaatggtgaggcaatgaggttacatggtcacattcttaccttgggaattctgctttgctgtgaagcagtgggtaaagacattgactattacagcactcactgtttatccaaacagtatcccaggggagaatacatttcagggttctgtacgaggaaaacttagtctttcctgagaaatggatgttgtgttcttctcgtctagcatttcttttgttttcctgctaagtttggccaccacgtaactatgagatgggtttctgggctccttcagaggaagcactatgactcttattattgaaatattcactttctcttcacccaattttctctttttaacattctgaattaaaaaaaaattattgactttgtactttttgtaacttactgcaaatccttttctaaataggcagggcatgaataaagaaaggatggaaggatggaagggaggaagggaaggacaaaggaagaaagggagggtggcagggagaaaacaaaaacaagtaggcaaatacataaaatgacttaccttttgtaattttaaattattcaagtttgttttctaataaatataaccttaatgaaatgccatctctaaaaatcctttatacaaagcttttcaaataataaaaggaatacgagtaaaatgatgaaataaataaactttttgcagccaagaagtctatgatctaacgtttcttgttcactatctctcaaggttccccaagagtaaacatatgccataaggatttttgctaaatctagtcttaaaataggaactattctaaaattaaacttctacttttatccataaggccatttatatcattttaagcaatgttgtaacaactattggaaataccacatggtctggttttacataaatttgcaatgtatattatcctccatcaccccctacattggtatagaagcttgttccaatggtatcacatagtgagttttattttctggccaggttggcattttgagatctagaatctttatatgccacccctgccgccattgccgactggctgtgtgcctaaaagccagagacactgggcagggttaaagattgtggccaggtttttttttttccactttgtcaaatgtaaaaatacaatgatggtttgtagagtatacttcagaaataatttagtcagtaggtttatgtctaccaatatatatcctatgagttaatataagcagttcacactaacaactgtaggtgatgtatccttcttttagttgctgatactgtgagagaataaggcattttatttaattaaagaatgagctaaaatagcaatgtggaaatacagaaaataaatactgaaaccacacaatgctaaacatgaatcagcattcctatatttgtaagtgaagtcacctaaagggaagaaagtataaacagaaaaggcaataactgcatcagggaaaatgagaacctatggaaggaaaaagaccagcagtacctggattcagcttttctggttggaaaggtctagagacattaaaatcacacctgtttataaaattatgtatatttaatattggaatattattggtggctctagagggcatacacctggttgtacaggaaccgtaaggtttaacaatactactaaaaaaggaatgtttatagatttagatttattgcaaaccatgctttcattttttcttcctataaatctttcctgagcatctactatatattaagtgctactgtagctatggagatacaacaagacaataaatatgaacttttgttggagttcacattccagtcgaagggatatgaatattaaacaaaataaataggtaaattagaaggtatatcagaaaatgacaaggacaatagagaaaactttagcaggggagtctgggagtggggttagggattaaaactgcagttctcaatctaatggatagaaaatgttacattgaagtagctttggggtgaagccttgaaggaagtgagccacgcagataactgggtaaaagcatatcattctcttgtttagatataaatgtgctgagaaaaaaaaagtattttctatatataagactattcctctgaagcagtagcatgcagatgactgggaattgtagaagaggtgtcaatgccaacaatttgaagaaaaataacatattttaatgttgaaacaaatagagaaaagtaagggattgaagagatattttaaagagaaaactgaaggtgttaaaaatgtgcatctgataccataaatccaggctactcttccagacaccaggctcacatgttcaatttcttctggcatgaaaaattccagtggaaaaagtcaaagaagctcttatctcttcgctgaagcagtcatgctagggtaacagctgaattcaggaaaacttaaggaaactaactttcactgcactcatactatatgtaaaacatcatacacataatatgaatgtccaattttagaagtatttaaaaaacatggattttatatagctctaagccacatgaggtgtgtatgaggttgggggtagtgaagctcaaaattgtaagctagacacttcttgaaaaaaaaactaaatgcagccttcactaatggcaataggtagaaagagaaagagcatgagccagaaatactcatatttaaatcaaattatggctctgtgctctgtggtcatgaggaaactgcttaatatcatttacttcatttattaaatgagtctattagcaacaacacatgtcaaattcctaacatggtacctgtccatccttcaccttatgagattattaaattattaaattttgccttttgagcaaaaatattgatttattgaaaatacggcctaaaatatatgccaattatgctacttactataatagtttaacatacaacagcttgaaaatagtataattctttcttcacatgagccatgttatgatttccagtaatttgggacccactggtatgtgggattcattacaatgttcttcaaaattatttcatttattacatggactttgtttaaggaaacgaacagaaaaaaattaaatgtttgttttggagaagtttcatgctgttaacttcaaagcccctaagcctccagtggccctcttggatataagccacagatatgagcgtgaatgacgctggttgttctacatgaaacttcctgatgtgaaaacttttcacctataacctcaaaagtcagctatagctaatagctcatgagtatgtttccacaatactgaacattttgataaaatacactttaaagacttcctgattagaaaagattaaaaaaaaatgttttcctaggattatactggaaattttgagaagcttcttacagcactcaaaaagagttcttgtgtatttgttgttgtctggaacgacatcatcaaggatcaatcacattctttaagggctaagtacgttcacaaaatttccatttttctctccaaagcacatggaaataatttacatataaatgaagaaacatgccaccctttaaaaataccagtttcttgacatatagtccaatggattgctacaatttcaagtctttaatagattcaagttgaaaggaatggcatgtcatttgaaagcgtttccaaagcacaagggcagccttgttttgcaatgtttctgaaatatttggtttaggacatggcaccagagggcttggcagtgaatactccgaagaaatgtaaagtttaatcaatccatgaaaatcagtcccagatgtggcttacgagtgacaccatgtttttaaacataatctggcataaaaagttcaaaggtaatagatatcagaaatatattcctagtgataaaactgtaggtaaagtttatttaaacctttattatgaacccactacacgcattatctgttttatgtcttatagcatgtaaaaaggtgagaaaaacatactgtcctgaatatgctaccaatcaggtagatgaaagcacaaaaaaaacccattcattcattcactcactcattcattcaacaagtatgtattgaactccaattcagggttagatactcttttggcaccatgactgtgagatctggttcttgttctccgctatctctgcgacttttcatctttagtggggagaaaagacaggtaaacagttgattaaaacctagtaagaattaggttcaagttttcacaggatgtggtgaagctcagaggagagagcagagcactggtccagttctcaggtctggggcctggaggagaattgccaagggagatagagattgagcatagtcagggaagggtaatcccagcagataaagcaaactgtgtaaatacggggaaaagctagcaggaaacaggcaacaataaattcattgtttctggagacagtcttaatgggacatggcaaacagagagaggatactagtgagagagccaggtgctgcgttcctgatggccaaaaggtcttgttggagagtttgtattttatcttcagggatctggaaagccttgaaagatttcaatcaaaaagatatttaaaaacatgacagagtaagagaacactaagttcctcacttaaaagttatggcagacatttcaaaactgttcaccaatttccagttttcttcttccaaccccacaggaaaattgtacttccctgcctctttgaggttaacaaagttgcattgctttggaaaatgaaatatgatccacttttcggggtggaagcatttaattgtgacttctggaatctctaaccctttcttctgtcatggtgaaggtagacacctgtggtttatatggcggcattgcttttggcaatcacatggagactgctggcctgcggggttctcagatccacagtggggtcgtccgttattggagtattattttgcctaccatgactagtacacgtattcaagtaatggagatattcttataattaacaagctactagctctgatttgtaatttgctcaattagacaaagttaagtgtgttccttgttaaaagtattcacctgtctaaagtttcttgtcttagtaaagcaagtcaccgcttccagattttggaagtggtaattaacagcgttttgcttatggatttacttataattagtttttgtttttggaaatttgaaaaatgcaaagtttaaagaagagggtgtacatttattctaattacttttagaaagaagtagtacatcagtaatatggtctcagtgttaaaatattttaaaagggaccaggcatggtggctcacgcctgtaattccagcactttgggcagccgaggcaggcagatcacctgtggtcaggagtttgagaccagcctgaccaacatggcaaaaacccgtctctactaaaaattcaaaaaaattagccaggcatggtggcatatgcctgtaatcccagctatttgggaggctgaggccggagaattgcttgaacccgggaggcagatgttgcagtgagctgagatcgcaccactgcactccagcctgggcaacaagagtgaaacgctgtcaaaaaaaaaaaaaaaaattaaataaaatgtagattaactcctgaaagtgaatactgtacatgtttgcatgcattttattctttgtaccttgtgactgctggctacttactgccttcctcctgataccagtttttctctactgcatatgtcaataaatgtttagaaatgcttgaagaatacagagaaagcccaaagtgttttttgttttgttttgttttgttttgtttttttcagaaatgcatctaagtgtctccttacaaaatgagagaattcattgattagccattctttggacatgctcttaaacgtcctctaccagaaggaatttcatattcctatcacaaaagggaaattgcttattcttatgtttataacaccagatcttttatttgatatatactatgtgtatatattatacaaataagctctttataaaagataaccatgaaggaattatttcctgaaacggcaaaatataaatttgcctgtaaaatcagaatgccctagccaatcttttgagatttgaccaggatgatcctgtgggtaaggaaactaaccctttcaaattgcatgaaaattagaagacaaatgaagatgttgtgaatggaaattcatttccaaataaaccactgggataaaaatcattagaataatgctagtttcaaaatctatgtttttccgtctctttgtcactcacaattatttcaaatatgttcactttaaagtacagtatatatacctagttaggttgagtcatgttttagaaaaattccttagagtttgtttttaagcaaaacaggactgttttaaacaaagcagaaccttaacaggaaactgataacagtggccaagaaaagcatcttattttctattttctgtgtattagaaagaaaccctatttctcacttcctcatatggtaattatatctcggtggaattgaatcctcaggacaacagggcatgttattgtgagatattttacacctggcttaaccattctgtaaaatcagagatagtgactagcccagaggctctgtctcacttccttccggtgttgcttagctattgataaatattaaggtgcatgtgatttggctgctaaaatgaagaaaggatgtcagaaggctatcagtttgctgaatcaaacagcattgccacagggctccaagctggcagggcccctctgggcattgccaggtcaccaaggaagtggctgggtgaggtggcaacaggtgtcagacatgctgctgagcagatgatctcagcaggcctgaggacagaagagaaggttaccacacaaagtgcttagctgtgaccgcagaggaatttcagcatcaaaggaatttgagtagaaaaaggtttcaaatttcagttaacccagggttgaagcagcaggactcattgatagaaagagagaagcaaataaaagcccacactagttaacataactctcaaataagaatgcaattatctgcagccacagtagcccatggaaagatatccctaaccagtcattcagttgagacatagggacatcacctgggtggaaaggacccttacaggttgtgaaggaattataagtgaccattagtgagtggtcactatgtaccagacacagctgtaagtgctttatggccattaattcattccatcttcacaacaacactctgaggtaagtattcatatttgccttattgtacagaggtagaaatggaatcataaaaaagtgaagacatcagccctagctgatacagcaagtacagaggagagccagaatataaacctaagaagtctgtctgtataaaccatgctcttagccaccaagtttcaccatccctcacagggagaaaactgcagagcagaaaagttctggtcttactcctaagaagagatgcacattacatacatgaaaagataccaaacatgacaacatagaaaatgatggatgccaagtgagtgccaggaactatagagctgttgaaagagattcattgcaaaacaggttggaataagcaagacaaacttgagaagtggattctcacattgagtgtgaacaagcaggggcagtgtgatgtggaggaagggagcatgtactctacaggctttagcttcagaggggcttgggttcaaatcccagctctgccacttacaagtcatgtgagcttggggaagttacttattctttgttttctagttttcctatctgcagggatagaaaaatgctatttcaaaacactattcatgaagatcaagcaaaattagttataagcaggtctcagcatacttggtacaaggtacacatttaatatgtgtactattatccaactagggagagatagaaagggagcttcaggtgagaggaacagcataaaaaatgatccgcaaaagccagaaataaaacttctatgagctcagttcaagctgactgggtaggtaaatgtctgccatgaacttggaagtgagagagaatctcccttggacactcattaaggggcctcaaagccatgaagagttgccatgtggtccttccagtcaataaataattttgtccaaacacgagtggaagaaaaaattaagagacacccggatggggaaaacccattctctttttggtgagacaatctagccagaaggacactctcgccagctagagctctgcatatccaaacaagcacaggtaaagtggaagaactgaccagaagaggagaaaacatgaattaattaattaatcaaagaaacacctgtaaggttccaagtaggtggcaggtaggctgagtgttagtgtatccagtcaggcaggtggtgatgacaaagggcccccaggaaactcccatttgtgtgagtgagaaaggcaagaaaacagcatgcacaatgctacttgaggagcgatgtttgaaaaagtgatgcacaggttgcaggggatgcacagaaactagggatgcagcactggagtggggtgagaagcttccaagaagagacaagccttctgatgggtctcaaaggaagaggagggtctcaccaggcaaaggggttgggggacacattctagtcagaaggaacaccatggacaaaggttgatgaatgaagcagaatgatatctttaagaagctgcaaaacactttccaccaggagggtgcagctggggtgtggcacatgaggttgtgaaatcaggtcctaaagaggctggaagaatgtgtaggaaggagatgggctccgcttggctcttaggtctctgcagaaggaaagagaaggagaatgggacaggtggtgagactggaggcctgtacactatttagaaagttactgggccaggcacagtggataatgcctataatcccaacattttgggaggctgaaccaggaggatcgcttgagcccgggagatcaaaaccaacttgggcaacatggaaaaaccctatatttacaaaaaaataaaaaatgagccaggcatgttggtttgcacctgtagtcccacctacttgagaggctgaagtgggaggatgccttgagctcaggaggttaaggctacagtgagccataactgcaccactgtactccagtctggatgactgagtaaaaccctgtctacaaaaatgctctaaaacaacaaccaaaaaaacccagaaagttactgcatggagcccagaggagaaatagttgcagcatcactgggaggtgtgggtagtggggtgaaaaggctatggcgtaagcctggtgaggaaaggcaaagcacctgatgctccttggcttcaagtacagatggcaaagcaactgggcaaggaagtccctggacagatgctcaggatgattacagcttcagaatgctgaagtgcagctgtgcctatgttttcttcctcctgtcctctgccacactgtccttcgtcaccctctggggcacctcccctcatatgagaattgagaaatggagggagagtacatgagtagtggggagacaccaagacagcagagcatagtgaagagaggaggagaggggaagcaaaacttaaaagagactcaatgaaactgggagtgcttttgctaatgccactaggaaaaagaaatgtgaaaataaaattttatatataaatacaaacacatgcatatgagtgggtgggttaaactactataccacctcttagccagaatgatcttttctaattagattaggaaatgaaagtgttagaagactgaatgggtaacatttgaattttccttttgaaagatgggccatattttgactttagaggaaacacagatgggaagtgcattcttgatcttggaaatgttgtgatgatccatcactgtcagggtgaagtaaggatctttagcatggccaccagagccttatctcccacctctgtgcctgcctccaccctggctcttctgctgcctttatattaaacatttgttcattcaccacataaggttctctctcttgccttcttttcctggttaattcttactgatcctgcaaatcacagcctgaactactcatcctcagagaagacattcctgattttccctgaacagataaaaaaacccttcacagatttttgaaccctgtgtgtctttctcccgtagcatctgatccagtcacagtttcatgtgtgtgtgtgtgtgtgtgtgtgtgtgtgtgtgtgtgtgtgtgtgtgtgagagaatgagagagagagagaaagagaatttgattaatgcatgtcttccccagttaatcataaactccataggggcaagaaccatgtctgatttggcatctacgaatgagtgatgaatgcaaataatgtttggctatggggggatgaggtgtggccatgtaggaagatgatgtcagggtgtggtacaaggttaaggaagctgcagctaaaaaggatgccaacttaatctattttggccattttgtctaccctaagtattatgttcacactgtatttcttctttctggactaagaaaaaaaaaacatgtttgcttgtggggtctttttttccttctaaaatattagactgcaaacaaaggcactgttgggtagtatatttttgttagcacccaaggggaaatgactgtgttcttgggctctccaatttttacattacatgttttctacatgagctttcaacctaatgtaagaattaaatgcaaatttgaggcatatgaactattttatgcaagatcttaaaattgttttccttgggacgttcattgaaagtatggctcattactgaaaatctattcttcagtgtgttcctaaccatctagccacgtcaaaaaaagttgctttaatatctgaagccaaatcgctgctttcctttgtgattacaaggactctcttggtaaatcagagtatggccaatgtccagttgctaaaggtggaaactacaagttactattctccttaagttaccagcaagatacagtcaacatgtagttctttggtgtctgtcaagaaagtacagagatttataggtaaagaagtcaattttcttatcatagatatagttgtcatatggagagtatgctgattagaaataatgaaagcaagagataaacttaaattgtggaattatctgagaatttccattatccatgtcccaagttaactgcaaacaatataaagttgactatatcaatttttatgtacagaaaaacatttgggacacaaatacattttaaaatcttaagagtttgcagggtaaaaaacattttgggggaaaaataatttttctaagggtttgagaaaaattcagcttatatttatgtatttcaacttcagtaaggataaatggaacagcaccactggaattgaacaattaagtaagcaaatgatggatggtagtttttcactgttggagtggaagattatagataagcaagaggaagaagctagaatgacccatgtggtaatgagttagatttgaaaatatcagtatgaactaatgcttatctatctatcatctatctatttatgcttcctgattgttagatatgtgtacatacacaggttggtatacacaaatatatgtccttgctctgtcagccaagaaggccaaaaggaaatgacaacccaaaaacaatgaacacacctattgctcaaatcttggtttttaataccattttccaatgaaaggaacgtgtgctccttggagaaatggctgaatctatgatgaggaaggagttatattgttgataagcctcaagtattgtgtaatgctagaaaggatgaaagtgcatcaaaacaaaacaaacaaaaaacagaaaacaaaaccaccacaattgtggggatgtatcaaagggacacaagaaatagtacccaatggccaaagctggaacaatttcacagcacgattagtatgacagtagtggattataacctaagcataaaataaatatccatgagtccatactgatatacataaatgctgaataattaaatgagggagaataagcaaatcttctgtggagaagaattgcaaatattttatgtagattctctgccttcaaggagatggagtataacaccctcttaagtgtgggttgtttatcatgacttccttccaaagggtaggtatgaaaataataaaaataaggaaaaataatacatttatagtggaaaaacctgaccaaatccacctcgatcaggtgatcaaggttaacatctttagtcatgttgacagtgtgatggaaaaatggcacattaccctctgtggtctctctccccaaaacactaactacagtctaatcatgaaaaatcaatcagaaaattccaactgagagacattctacaaaatacctaatcagtactcctcaaaactgccaaggtaatgaaaaacaaggaaaatctgagaaaattctatagcaaagataaatgaaacacgagaactaaatgcaatgtggtatcctgagtggggccctggaatagaaaaaaagaaccttaggtaaaactaaggatatatgaatgaatagggactttaaataataataatgtaccaatactggttcattcattgtaacaaaagtatcatactcatataagactttaataaaaggcagtgggtgaggggtatatggaaactccctgcactatctttgccatttttctgcaaatctaaagctgttttaaaataaaatttatctttacaaagccctgaaagcctagaaatttaaagtaaactcgtacaatcaaatagtaaggcctaatcttactgacataagccaatatttaattttctaacccaaaatacaaactcttcttcacatgttaacctctatctccattttctatgtctacatttctttagaagaccataaatcacgctatattatcattaattagagccaagttaaaatgttaaaattgctaaacatatgactcatttaaacaaaggtttactaaaagacaggaaacaatttacaggaggtatgcattttctgcatggttgcatctttcaagaagacaaagaaagggattaagaatacctttgtcctaagatacaaaaaaaccacaaggcaaaaagtacgacatataaagttttacaccaaacaaaaaagagaaaaatttcagcaaatcaatgttatcatctacttatgattttttatcattgcaaacaacgcatgtttgtccatccttacttcgccacctggaccaatgcaggccatgtcatatgaaatgcctgttctgaccattagaacatccagactcattctggggcttaatctcttttactgcaggtgcatccacttgttatatttcagattagcagcctcaaagaactagcctcttcccagtacccatccttcaattactgcatcattttctctaacaattgcagtctttcaaccactttatatgtgacaaggcatgagcttgcttcctctcttgtcactctcctgagtcctcttctgtttgtctgcagcccaaaaggaagcacaatattccagctgaggtctgaatgatgcagggtcaagtgcattcattacctctttattttgggttattctggttctattaatacagcttaagatgttatgtgaaatttccaaaataggttccatattttaccttcaaaactgtatggcagacacaaatactacattatctgtgattaccgtgaatgaggttagcacattattatgtggttgtgaatatcatacttggcttcctggagaccgaatattcatgtatcagggccctcctgtgatgacacagtcagtggcgccctcacaagggcataccttctagccttgtcttattctttaaaaaaaacccacattctttctttgttctagctacacagctggaaaatcagaactgaacataatagtgggaagagagtactctttaatctcagtatttaatctcctgatactttctggacctctgaaagtattaatacatgcattcccatgagaaatattattgcttctctaataaataaggatgtcatacaaaattaacaaattaataattcaaggacacattcgggtgccaaagaatacagttttctaatttttacaggaaaatatgtaaagtaatataaaattttcacttgtaaatagtgcaaactgtgttagaaaaaaagacaatgcagatgagagatttccttgaaatgctcttaaaatcatgttattgatccgtgtaagtcagctatatcaattctactgatcaagaaataggtattttaaacacaatgctttcaggagtatacaatgttgacaaatatgcaaaaaaaaaaaaattgcaaaactccaagaaaatcaaataatgaatgctagccaaatttctatccgaactaagctaactcaatgatattatcgttgtctttaatggagaaacatgaataaggataatctttagtggacttagattaagtaatacaatgaatagctataaaatttgtggatcagaattagaagaggggaaaaacacattaatcaagtagacatgttaacaaaataatggattagtcaggattacatttgaataaattagcaaagcaaaagaaatacattaaatatctaatatttagtaacttagaagagaaaaaaatgctgtgtattttacatactaattcatacacatgcccaacaaataactaccgtttccagtcttcatgtgcaccataacatgtgtaacatatgaaacaaaaatttgctcctccctgatgtatattggtatgaaaatcttttaaggtaacatgagaatgaaagagattcttcttcatgctagacatagaggtttttaaacacatcatttggctgacgtaaagcacatttgcaataggcattagtaacctcaagttaagaacaatatatgccaggctgatgtactggacacttcctaaatactgtactcagcagttttggagcacttagcaatgatgaattggtgtgaagactcaggtactgaaaggtcatttccctttttttcttgaatcttttgcttgtcttgattgacgctctgaagaagccaaggatacagaaggggtggagaaagcacgcaacccaaattacccaaaggagctgcttataatgaacttgaatgaagatagattttggggagaggtgggggaaagtggccacaatcttcaatattcttttgaagtgttactgctttcaaagttgtgatttttctcaaggtaaagctgtttgacacagatagactcatctgtcaatcaaacatcttttactcatggccaggtcaaatacttgactattctagtagtggtatcaaactcttagtgccaatataaaacagccaactcacctagccagggaaaagaaataataagaaaatgaaaaagtgcactgagcctttatatcctgtattcaagaactgcatttcttttttatttagttgttttgtcattgctgtttatcagtttttgtttttgttgttttgttttatgatcaaatagttttagggggataatatataatagccatgtcacacatttctgaaagaacaacttatttcacctggccccataaatggaaatatttcataaattccagaagctttggcattcgtctacatcctctttccagactgcttgctatttcataatcattttcatgattctcattttccttatgaattgaatttgtgcttgaaacatttcaagcctagggaagcaatcttgtgagctgacagatcttattgggagcaaccttgttcagaattttgacttccacttccactcttacacaacaaatgtccacgtatagactcaacatttgcctcaaaaattcaagtctccttaagaattacaaaaggttgtatcaccctgtaagactgttgccattacagatggcataggactcaggattctaaaatctagtgctataatgggctataagttgggttaaagaagtgagaatgctgtgcttttaacttcaaaatttggcaagacataccattttttaataagaaacatattttttatttggattatccttttcttatactatctattttattatactttctttaatagtatttaatcagattttaatgaaatctggtacacaggttttttgttttgttttgttttgtttttgtttttgtttttgtttttgagacggagtcttgctctttcgcccaggccggactgcagtggcgctatctgggctcactgcaagctccgcctcccgggttcacgccattctcctgcctcagcatcccgagtagctgggactacaggcgcccgccaccacgcccagctaattttttgtatttttagtagagacggggcttcaccatattagccaagatggtctcgatctcctgacctcgtgatccacccgcctcggcctcccaaagtgctgggattacaggcgtgagccaccacgcccggccgctttcttttaattataaactaacaatagtatttacaattttcaaagaactttcaaatatactacaatcttccacagaaatccataggggaaaaaagggacaggagaggaactaaaatatatcaaacacactaagttgagcagataccatgatttatatatgtatatcattaatctttatgcacaacttaggacaaatttctttctgatcttagtatcataagtggtgtgcttccctgatccatcaaattgtttatccaatggacacggggatttgtgtttaagcttcctgatttaccctggatcctaggaagcttagtgagaactttacattccatcttgcatacccttggacttcatggtctgcttaactcttgaaagatggaaggccctctgcctcccttgagatctaaacaaaattgatttgaacttcctaatttcatgaccagtaagaatcccaaaactcacctctaaatttctgataatttcctaaaggctgggctcattgacctgctttgccaacacaacacagctcattttgattcacatgccaccaacaccatcaaaatcacttacttcaggtactcctgaggcttcaagtaagacatacatatattagtggtcttcccacccctagcaactccctgtaccctccccaatacccctcacccaccgaaccactgtcagtactggggagggatctgtttatggagtatacccgcagttctcagccttcccagggcgaattttcctcatcctgtcctctctcctaatttctctgcctcatctccatcattctcattggctctttagcactaaattcttcttctgttatgcagagaagttttcacccttagagcacttgagcacctacctatagtcagatcctcagggactttcttcctatcccaagggcacgttcaaaatagctcttctaggccagctgcagtgactcactcctgtaatcctagcactttgggaggctgagatgggtggatcacctggggtcaggagttcgagaccagccaggccaacatggtgaaaccccatctttactaaaaatacaaaaattagctgggtgtggcagcttgcatgcgtagtcccagcaactcgggaggctgagctaggagaaccgcttgaaactgggaggcagaggttgcagtgggatgacatcacaccactgcactccagcctggacaacaaagggagactctgtctcaaaaaaaaatatatatatatatatatatataaaaatatatatttatatatatttatatataaaaatatatatatttatatatatatttatatatataaatatatatttatatatatatataaatatatatttatatatatatatataaatatatatttatatatatatatatataaatatcttctagcaaagacatttttcttccttccccaagaggattctggtgccgtttgtaaaggtaatatatatatatatattttttaactattacatacatatgtgagtaggaacatcataccttatttctctttgcccttcatcaacattctccctataagttatgcacatataactttgttggttgtcttaaatgctgcctgggaaaagctgcggtttaaaaatgacaaattaaataatgtattatctcattgaatccttacagtaaatctgggtgattggaactgttctatttttctcttataaatgagttaagtgatgctcataaaaggtgatttgctcaaagttaaccagtcagcatcagagttgaatttgaacttggttcaatacagctttaaagcatgggatctttcccttgcattgtactactggttaagagagagaggtatgaaaccctcgaatgctttatcaaaatatacctgtcacttcctcttcctacccactcttcaacctccagattttcatactccttattactttccccccaacaaagtcttgcagttatttctgataaatgatacaactgccttccctaatgacattctccaatcctcaccatctccatcacactgagaactatggctttttaaaacattgaagttaatttttcaggatgttctctgacaaaactacatataatgatataaaatagttattgatactctttcataataaagtgagaataaaacctcattctatacatatatagtgtgattataaccactatactaaagaattgatatatttaaaaactcaaatataggatatgtatgctagaataatgagagaaattaattaacactgataatattaataaaaattatcatttctacaatgagactagaaaggaggaggccagatgaggcagagctttatgctgtattacatataatacaaagctagtacattttcttggcaagtgaagagatattagggagatgatttttagagcttagtttgacagtgaaagatgtataaaaagaacgaagagccacacgtagaggctggtctatgtctgaagaccacatcatgtactgtgatgaaaagtaattaaaatgaaacatcaatgttatagatgcagaaaggggcataatcaagcatcagagccagctgtggagataatttacagacttttatctcaccagcaagataaaacatacatatcttcaaggaaagaaagattcctatatgaaagtgaatgagctagttattagttttgaagaaatggtgtcttagataaggtgatttgtagcaatagcatttagattttacagatacacccagttcggcaggatggttgcttctacaaatccagttaaactctcccaagtgacagaaatcaagatatgtgggaattatttatgctcaagatgacaatttttatagaaacagtatctatccccccaaaaacatgggctatatcctaaaaacctgaaattaatattaaaagccgtaaattcccaggacacaattctggaaaagtaatgtttactctaaaatcattttattgagcacctactatgtgtcaggcactgtgctaagaacagagaatctaatgaagcagggcctgagtaagacagtcataaacagaaaatccatcctgtataaggtaggcactgactcaacatgggagggcacatcagtcgattcttgctgaggcttgagagatgaggaggtataaattatccctcataattcaaacttaacccaaggtattgtccctgtatttactgaacaagaatgtgatatagaagaggcagtttagacctccaagcaacctatagttaatgggtaagatctaggttggaagtggcctgccactgattaccctaggcaacctggttaaccattcacagctagttgcctaatctgtactataacaatatttattggatacttactgagtgacaggtgttctaagcactagactggttttctcatttaatcttcacagcaaccctatgcaatgagaactatttactgtccctatgttacagatcatggagaggttagataagtgacccaaggttgcacccttagtaagtagataacaagcccttgccacagacttgggggatgattaagtaaaatgatgtctataaaaaaattagtctatacttggaatggataacctgttaaatgtgatagttattatctgtattattttttatagcatacgaccctaccttatctcaaaacatagcacaataacattatttgaaaaatataaagttatttaattaaaatttcccctgacaatataatttttatttatcattcttttctgtacacataattatttattaagaaaaaatttaaaaagtacctattaagtacaacaccatgctgggtattgtggtataaagtagaaaaaagtagtcgaggtggctactgcaatgaatagaacagattataatgttaatacctggtctcaaaggctagcttggtctcagaaagttctttgaagcaaaaggttgtgtgcagtgaagatctcacagaatgtggtcaccctttcaaatgatgacatcctgaggcaacttagcattcaacctctctcaaaaatcaaatctggcacagattattttctaaaaaataggacttttcccacaaatattttcttcttttaaaattaacacacccaaaggtttaagactcaaatgccttactttaggacttgtaagaggtctctttcactgatctcaataccactacggttttctcaatttgcccactgtcacattgctagctttcctttcttctctagaacatcaagggactctccatcattacgccaattatttgttttaaacatagtgagcaacccaatgacaaggttcttaagattgaggacttcatatcatgttatttccttaaattaaatggaggatatatgaaaaaggaagggcctgagacctttatcaagagaagagttgggaagatatgagaaatgtataggttgcatatggaatatgttttctcaaatactgtggatatcagcattaacgggcataacgctgctgtcttccccatgaaaaaggctgccatttaaagttaggttttgtggagaaggaattaagcaaaatacccaaggtagacaggctaaggatattccataggagaggccaaatacttgagaaaagcatcagagctcagtcctggaggtgtttgttgatttatgtgtggtttctctgcattacctttaatggaagaacaattatgcctgaataagacagaaatgagtaaattaactaggtaagatataagatcatagatttttatagcaccttagtgatcagttaagtcaaccttctcattttcatatttagaaaagaaaaatatggagactcaagggagaggaagaatgaagttccctgacaagtgactaagacttttagaatcttatttagagttttagagccacagcaaaaattctacaaagcaagctctgtataaagtagtggtgagcactgaatgctgacaataatagcggaagctctgctgagatgattagaagagatgaaaggaattcataatattggctaaagtcacagtatcctccagggtttattctcatgacctagaaaattataaggctatttaataatatcccttaacttacatattttatttgtcattttctcctatttatcttggagacataaaagagaatttaaatgtataaatatttaaactgggttacatcagttctggttaaagtcatattatgtttccttatttccagtacatttctcagagactggtgacactttcaagtaagcttcatagcggttttgaagaaatttttgtaaaagcaggttacatatatatggatttgtgacattctaacataaaccacagaaaggttcctattaaaaagggagcaaagctgaatcattttggcttttcttcccactgtgatttttattcatttgaagataaaattcaaagcaaacatcttaaagcttctgtttgtcacccaagagttatttcaaggcagcacaggaaatctcacattttcaaaaaatcaggtcatgaaaatggaactgcaatctaattaatatgttcataaaacagtttccaccactaccaaataaaacaacaacaacaattaagatcaactctgtattctttggaatcccaagaaacacaatccataggagacattctcatcacaaaacagtttcaaatttaataattaagaattgtaacatttctgtcacatctctactcatttccctgacataatactttgtgtaaataatttctcaagtagagtaaaacgtcttttattgactggatatattcattcaacatcactgacctttttccaacttgtttgactgtcttgtactctctcttcaataacctttccaattccccctagtagctgttccatcatcttactaagctcctccacctgctcctccctggtcctctttctgagatgtgatcttgaattccatttaatacttcccagagaaaacacagggcataaaacaaaaactccctcaggctctccttccacctacctaatctccacattatctgcattctccctccttttcctccccctatcccagagggtgtcatgtccacaagtttcccagctctgtatcagaatatttccttagggacatgcttcctactcttaaaagtgcttggtgttcttcactagctactgtgtttttctcctctccttctcctctttcctcctcttcttctcctcctccttcgttcttaagcaaaattttgaaagaagtagtttgcacaacttttctctgcttttattacccctgaaatataacttacccccagacactcccttaaaccactctctgaagtattatcagtaactactaattcccaaatccatcaaatatattttcactttgaaacttaaggtatttggatcaagtcagttaagttgtttctccttctgactcctgtaacaacttgtatatatctatattaatatgctccatactatactgtaattatttgtttctgtggctgttctccagactagtttatgagtatctccaaggcaggactcttattacattcatctgggcatcccctatgaataaataactcagtgtgttccacctgttccaatataattcactaaccatgacatttttcagtaactcagaaattgggctattttatgattaaaatgcttctttggcaattggatctgatttcagataatactaatattctttacttgagcacaaaatgaagtttaaagacatacaattagttgaatattttgaagaaagtaataattatggcagcaaaacctaaaatgtggatgatcttttatttttggcaaagcattctcaaaaccatttcatctgtcacaaagtaaagctggagcccgtatcaaagcagggccagagataggcagtttgaacagggctcaacaatgccccgcagagatggtgaatagagctgaattcatctatgctccacacaccaagtgtgtacccagtgggaagagtgacttttgctttgaacagaggctctgtccattcaccaagtactgtagtttgcatttctacttcatctgttcaaagtgtgacacctttcctaatatatcgtccagagaggcactttttagtgaaaggatcctataggccacagtgaccttggaaacagagttcaccacaaattccttttaaatttctcattctgagaaaatacagaaagagctgctgacacagtctaagtataggtcattgttctaacattaaaaggaagagtttctcaaggaaaggctattcacattcagtaagcatcctacatacttagccaggctgctaaataacagggtaaatctgcttattttctctggtctactgctaatctaattttcaaaaagatccataaacaagagtgctaagtcatctgccacaagaacaatatggtggattaaaaatatattgggctctaaaatcaggccaggcctggttttgagtgggtcagcttccctagcaatagatatatgaactttcagcaagttatctaatctctgtgaacattaccttcctcatctgcaaacagggatttggataagaaattctcagaaagttatattgccattaaaggatgtaacttatgtgaaaacatatggcatgcagaggagtgctcaacagtgttgatctcttccatgaagtatatgatagttatacaagagattttggcatgtcattgtcaacattctaataaattcttcttttatttttttgagacagggtctttctgtcttgcccaggctggagtgcagtggcatgatcatggcttatcgtagcctcaaccttctgaattcaagagacactcccaccttagcctccctgagtaactgggaccacaggcatgaaccaccatgcccagctacctttaaaaaaatagagagagagacagggtctcactatgttgttcaggctggtctctaataaattgttattaccaatgtgctatgagattttctttaatagcctacttcttaacatgaagtgggtaaatatctgctgtaatagttttcaaaagtggtaaaaactcaaagagctttcagaaggtcacacaaaacattaacactccagaagctgaattagaaacctggagtgctttttttaaattatttttttttagtttatttatgtttccagccaatagcctgattatgtagactctagattatctatccttgaaatcatatatggagagatatatatgtataaattttacacaacataatccctagttgtaatatattgtcttgggtatgtttataggctggtacttctcaaacaactggaaacgtcacctaatagtccatcaagttataagcagttgcagcagttatggcttggagacatttttgagctattgcaaaaatgtggataatgctatagctagacagagtattaatgagcattaacgtttgtgggatatgattgaaagaggagagaaaaggatgagggatttttttaaaaaggaacattcgacctatggcaataaaaaactggttgtttagtttttttgggttcttctttgcatctcagaatttgaaactattttcaattttcctttacttgcctatttttctctgaacccaaatacctcaacattagtgtaagtaactcagtaatagtcaactaaaaggaagaagcaaaaaggagtggaaagtgaagaatttaaaagaagctaaaacatcatacattgttagtaaataattttcatatgatgaggaataatttcttatttttttccttttgtaagatttctaagacctccctggcttatgccactcagtcctttgaagatgtaacctcacagcgatttaaagtgcacaaactattttactacagcagaaaggctgctaggactaaagactatttttcatttccataagttgtaagcacattgatattactaataacaactttgctcctctatcatagcatacttaatcgaattatttttaaaaacactaaaacataaacatttgtaatttcatttttaaattccaaggtattactagaaaaaattaaggggcatacagctgatggcaacaaaagacagtaaaatagaaagccaagagaaaagttttatgtttaataggatcgatatctcatataatggaaaatctttgctacactatatctaaacctgaatttctgccttaaacaatggctgactttaacattgagccctagggatttgtgaacgagatgagtttgtataattatgagctccatctaaactttattggtcctaagtgtttacaagtaaattgtatttggccccaacaggaattcagaattaagctggcagtctggtatttatattttagaatttctgggttgttctgtaacccagaggaagagatgttaaagaagcaaggtcagctattacctgcaatttcactggaagacaagcagacactgcaataattttaagttaactaaaaggagcaaagctccattatcttacatgagacttgatacgtcatttccttcaacgtatacatagtcatcaaactcaatattgctcccaccccctaaaattctaataaaatataatgtattggtcagaacacatactctggaaaatgcacttctggattgagtttctgtaatttcaatgtatgaagaggagaaaaccttaaaagatgaaactctatgaggctagataggaaggattatcttttcattagaaggcaggccattctgactttctctgaatacgtattcattatattagtagatttaaacacatatacatgcaaattatgaacacatatatgaatatattatcaatatactgatttatatcttgcttcattccataaaggatttagatcaaaacagaataaaacagtatgagttagtttatgaattgaatgcttggtctatagaggaacaatcaaacaaataactttctagactaaaccttttagaaattgatacctggaaaaggacagtctaatgaaagaatttagggtcctagaagaaggaaaaagatgcctccatgttgagtgaaagtgccacagtcacctcattttgcctcttcactggagttacctctcagcatcacaaagacagtttaaaacatttagatgtcctacctttaaaaattaaaccctaagcaccaaataagcaaatcattaatcaccttccacaatcattaatcccaaatcttcctctggtgtcctcagaggggccctccatggcagcattccacagcctctcctagccagggcctttagcttctatcttccactgtccttttagccatgtgaatccatcattaaaaggatgcaaaggtatttaaataaaatgccctcctaaattgtttagctatgaaattcaattgcattcaacatagccttgatgtttctggcatgaaattatagtatttttacaaataagattataaaaagttgttatatatcttttaagtcaggcaaaaagctgaacatgttagtcacactgtgttaggtcattcatgttagaccctggcatgtgattccaggtcataatgcttctaaaggtcctcttaactgctgctacatgaaatttaaattcctagaaagctgacttgcatttcccttctttcaaccatgccatacttgttcctgaatgccaggctatctctccattctaacaactagccagaaggaaaaataagaagagctatatagtacttatctatccagtgaggcaaacccttatctttgtttggcttggcagtaaaaagactgaaaagtgtaatggaaagaagccttcgcaataaaatcctccagctaatatttctaatgtagcttcaaagaagaaacacacattcttcataccactcttttagcacggaaggggtagtgttctattaaaccaagtaataggaccacttattaactttaactcataactgataaagagtgaatttgtaatactattgctcaataatcaacacaccagccctagggcaggtggatgagagtacaagtaggaactctgtgcacaggcttctatttcaattactacttctggtaaaatttgaagactaccctagacctcctgtgtctcagctttttctcattcttgcttctcaaaaagcaggacagaaagaggaccagcacatgccaagtcccgcctctccaaagggtacagagcctttctagagatgagctagggctcgtgaaaccaaagcacatatgtcttttacaatgtttattattccttagcactggcctgttgccaacttctgatcggtcccttcacgaagaaaaggctctaaatgtgagaatgaggatagggggagtctttggagatgaaaagagcaatttggcgagacctttattctaagcacgataattcacgagcctgaaatctcaccctataggggctcttacagtaggacaaagggaaagagggttttctgtcaacaaacccctacaatctcttactgcagtactggaaggggaggctataaataagaggaaaacaacaaccattgagaaagtcaagaaccaagcacaaaattaattaggtcacctggaaaaaaaccaccaccttcttcctttgagtccaacatcatattaatgaatccctgcaaggggcccaggaagagtaggagttatacagagcattaacattctacattggcttagtttggccacaacaacaacaacagattggtacgacatgcagtgaagcagatgaagggttacctaactccaggcacaaaagaaaaccaacaggactctcaacttctccatacagctttcaaacatatgtattacagatctagaggagcatgaataagcaaatttgcattctttccaaaacttcagagttgaatagcttatttctttccagtcaaaagtataggtgaggctaatgcaataaaaataaaaagtgcttataattgcaggcattcaaagagtacatggatcctatgtattacaacataaacaaatgggcttaaacagcagaacttaggtagaacaaaaactgttgctttgtagcaaggtacacttgatagaaaggagactggtaatttcccctcccaagcaaatcttaagaggtataaaatgaactctgaagaaaagcctaaggcatagaagaaaaataattgacaaatgcctactacgtgccaggaactgtttccaggatcttttaatctcaagattaaagactattgatgtaaatttgtctgtaagaataatgaggaccttattgctgatgcctgaccctcaccaacagaacaagcaaggcaatggcaccaaggctccccctgactaggaaactctggtgatgcagttggaagtgggccaccgaggtttgcaggcatgtcacccaagcattctagagactggggatagtagctctggtcagcaaaaaaggtagatacgccacagcatcgactctggatggatctggtgttgttagaaaataagcacctgcctagagtgggagaggatgcctcccatccttctctgcaatggattttttagctgaaagccgaaaactctgtaacaaaccagcaggtgattttggtggtaccttaagctctcagggagctttcatttgagacattgtcataaaagcagctggaaagccctccgaaacctatatttaggtatctattattcatccagagtccagccagaacatttacctgaaagatatactttcaaaatcagacaaactgcatttccaaaacaacccatgttagcagacactaagccttaacatgtgcctttattatgcattcacaaagtttctgctatgaaagtcagaatccagctgaccctaaaggtatggcaaaaacaagcaattttaaaataatgaccttttgctcttataaataccctcagcaatgagttcctacacacatttagtcataaactccagcaagaaatggcacatgatatcacatgtccagggacctgaatgcattgcattgaaccttaatagatgaccaaatatcaaggcactaagcaagttctatgagagcctgagcacttcctgattcatatgttagaattctactagaattctactggttcattctggtagaaatatttcttgaatagctaaaatatccttaactgtgaggcaccaacacattttagcattattttaaaattgagtcaacattctaagtttcccttaaccttcttttagaaattcagacaaattgatatatcagaaattcatgtgtgcccttccccagggaattttcaaataaaaatagcaaaacaacaaaaaacaaaccctaagcctcatctttaaaaaaatttattaaattgttgccattctcaaagtttttttcttcctccatgaaatattagcaatttaaatgttctcaagtcctcatgcttgacttatttggggatgcttcatattaacaaagtatttttattgcataaccattactttctcagacaatattcggttttgcacagtttacttttcattctcacttgataccaatactctagttcaagacaaatcctcatctggtacctgtcacggaatttgataattctgagttttacaaactgaagggaatattgattactcaccatatccaggaatgccttctaaagggaaaattattcacgtgcatcatgttcgcagatcttctgtcattaatatttttcttgtctcctacgttacatgtagtgatttttacagatgaattccaactctcttgtttgagcagctatcgtgggcaattattgcaacaagtattgaatcccaaaaaaaaaaaaaaaatctccccccaccaataaaaacaaatagcaattacaaaaggccttccaggatttgaaaaaagaaacatcacagagcactgcaggtatgggtccatccatttaggttccactagttagtcaacatactaaaataaccagttcaactaataatcctaaatggtggcaaatattgtcctggtaaaatctaaccgccttgagtgtaaattaatgcatccttaaggaaggactctggaatgtgggaagaaaggagtcaaaagacagtttcttgatatccttgttaaagaagtgttagaagggaaatggaaaacttcaggttgctttgccatgctgtcctttagaaatgaatattgctttttcttctttcttaggcacatattcatgtatggtcactttaacgcagtgctaccgtctgagacgtgtcggacaaaggcctgggcagaggggctagaaaccatgtatcaccaaagccaacttctttcccagatttcagaattgctggttcaactgcaaaagtaggaaggcaatgagtaatttctgctctgcaggacaagattaccattaactaccatcatgacttcagaagatgctgtcacgatgaaattcatttctgctgcctaaccccataataaggctggctgttctctttaagtaaaatgactaagctattgatcttttcactgcagaatcccctttattttgttattatcaaaaccatgtgggagcttttcatattttgccttggaaagaaaatgaatttcacagctgcaagtcagacgttgtctaagaattcttcccccgatgtctttcttttcttttttttcctctctcaatctcttttgtttttcaccccaaattcagttttccaataggtgtcatttattctgatgctctgacatcttctgaaagattctcatgcccaagctatacagaccttgcatgcttttaaaacacaatggcaacaggctcctgctggagtcccccagcgccgaatttccagcagaacctttggaatcctcgcagccgccttgtctgccctgggctgtgccgccccagctctgatcagctcaggacacttgcaggctccgtggtactgtacattaactctgcagcagcctggctcagctgcagagactgctgcctgacaggggatgtgctggcgtcaagggggccctctaggtgggttcccagacattgcagagccgcgcactccttgctaacctccaagtaagagcaagcaaaaggggttaaaggaatagctcgccctggaagagcagacttctttcagtaattaccaggcaagaaaagctaaacaaggagaagcctgtaaaacacctcacagggaaattacgccttaaacaaatacggagggaggattttttgtttgctcgttttccttcttacccagtgaaaaaaaaagaaataaaagaagtccagagataatttgcaaatgatagagtttggtggatttcactccttaaaaaaaaagcaccggggtggggaagccttgtttacttgatgatttgtaaccatttagctgcagatgaccacatggtgatttttggacaggaaatcctatggaagccggttctgcagaagtcagttgtacttcaattgcaattgcgcatgccataaaactgcttgtttgattagggggtgtgtagatatgaggaatgctgagataaaacgttgcaatccctatcactgatgttttgcatttcttcatgcttgctcctttgttgcaaaaattctgttcaataatcccccaaaagcaccccatcactgttgatgccattttggagcaagaataaaatagtaaactcttgtaatagtaggttggcacttaaatggtatttgtttgaaatcagtgggagaatggactttgcagtagaagtacactcaacattaatataccacttttaacttaggtatttaaaaaggcttttacgcaattgcttgatattaaatggaataccggcaacatttaatataacatgctattatcttcatttaggatttccccagtgaggtcctgtcattgcagaaaatattacccaagattgggtggagggcatgtcccataaattcaaaacctagtataaagaaaactaatcttaaaaaccaccataatttggagaattttcattttgatcaaaagatgatcctaaaaggaggattcctaggaggaagaagaactgggtgattccttaaaagcaatgtgaacttgtaggttcagaaagatgccactacagcataaaagaatcttgagaatatttgttgagatttcctgtagcctaggcagtgtcctcatgacccctttttgctaaagggactaaatctcttccataaggtcatttgtaatctggcccagaaaacttcagcctacattgtttttaacaagctttgaatgttttgaatcaagtaattaaaattttgatattatattagacatttaaatattattatttaagagctaggaacatctacaatgccccaggtcccattctaagatagttacagtattaccccatttaatccacacaacagcactatgagttaaggactgttactagccctgttctccagatgaggctattgaggcactcagatgttaagtagcatgtctgaggttaaatatctagtgagtcactatctgaatcaaggaagtctggctccagagcctgtacacattaccacaatattctagcacctctgtaatcataataataccaccttgttatacttttatactttctaaaatattattgttatatgtattattttggcatcacagaattatgctgaggagattaagacatttattatgcccattttggagatgccaaaaagattgtatttgttcattatcaggcatcttgtgagcagtagatctggaagagaattcaaattatttgactctggttagtgatctttgatcatgatgatgataatgatgggttttaattattttaaaactaacattcagtccttatacaagagagtaggtctccatagaaagtagcaaatgcaaagattttttaaaaagatgtaaaaatatattttcctttgtaatgaacatcatttatctgacattattttcttagtccattttattctactctgttcatatgtcaaaccatcacctatgggtgataggatagtaagaatacctctgaatctttctccactaccacacagttcaacattcaatacttgttagctacatttccatttgcgggcaatgatataagcaaagcactttataaataaaatacaaatgatttggccattaaactactaaatatacttaaactaagaggacattttagctgaatatttttaaagtgaattttcgttggatttttatttttatacatgcaactgtctagaataaagtctaacaaattagaacaaaaggaaacacaactgagaaactatgataaataacagaaaagccaaatttctgcttgaaagatagcaaagaaaaaactgtaatttatttcacagttcagagaatcaagactacacattattaaacaatccaaaattgaatatttttgcagacataaggcaacaaatataaaagaataggcttgcttagaaaatagaaataactcatttccagcattttattccatttatattagaaagagggtcttaagagttatgtctactaatttataggctgatactttacaaatttaatacttcctacatgtatggccttcaagaaacaacagttaggcagaactaataggtttgtaatctaaaaacaagttgtcaaaaatgaaaaaatgttgttgggttagggtaatgctaatctattttgttacactaaaagataatcatcctttcatgaaacttttaagaaatatcaggaagccagttctggttgctcatgcctgtagtcctagctacttggaaggctgatgcaggaggataacttgagcccatttcaagaccaggctgggaaacatagactctgtctctaaaaaaattaaaaagaaatatcaggagtaaccataaaagattatctttatggctaatctcagccccattatttttatcaatacaggagtgcgaattattagcagggcaccacaaattggcataacctcagtgaagtccctgcagctatggcataacctcagctctactagagcaaagactggtttgttgttttgttttgtgtttttttttaaattttaatcccacagcaagcacaagagtaagtgaacttatattaactacccttaaatgaggctgattcaataaaaagctcaattaattgataaactacaaactcagagcaaaccaaaatactttcaacattttcattgaaagatcgcttaatgcatccagaatcagagccagaagtattaactagccggtgtcccacgtccttttccaataaaacccttttctctcatggttatagggttatgctcataagagtgaaggttttcaaactaagtttctgggaaccctatggtttttcaaagttgcatcaggtcagctgaggggcaaggtactttgtgctgggtctaggaagccaggtactttgtgctgtttcaacaagagctcttctgctttaactagttttatctcaaagtttgataatacatacaaaaaaagtctggctctttaaaaaaaattacaaaaatgtaacagtagaaatacagaattaatactttctacacaaattcttatctctgtaatatcagtttcagtatttcatcctcttaaaatgccttcaacttacacacttccttcacaatgagcataaaagaatgattaagttcaacctttatgctagtataagcatagtataataaagtcacaccctagttcctgaggttgggtatttcctagactctttagtcacttgtacttatcagagggtgtgatgagttacttcattgattttccctgagtttcactttcagaaagtaactttaatgtcaaatgttaaggtatatttttttgtcatcattgcattttggtataatcaatagctaatgtcaatgtttgcctcttaaataacttgatgaaataaaactcctgtatatttagacatcaaagaataaagacctaaaagatgacttatttatcttatatgaataccaataatcagttcagatatttttggaaagtctccattctttcaagaggctggattacttttgtcccttagatgtcaaaaacaaaacacttggtccctgtattctacatattgggttcatataaatatatttacacatacaaaaacttctatgtacttttcttagcacattctatatactattaataacagtataaatacattatacacaaggatatagaagctactgtcacctggatatcttgcaggatgtgactttttgcctcaagctccccccataaatatatattttttaccaataaaaaataaaatttacatgagttttcacatgtgtgtatgtatgtgtaattatacatttttttctttttattgcatatatcatcaactaataaagaggtgagtgtgccatcagaatgagacctgaggtggctgtgcttccaaccccacctcccagcaagaaaagaacattcaagaccaaattctctatctcacctttacagaaagccaatcccccaggaacagaacagtgtcttcttctctatatttataacaccaaaaacattgttggtactcagtcaatgttaactaataacgatgttgatagtcatgactttccactcctggcaagttctagcaaagtctgaaggcatgctgttctgaacatttataactgaaatacgagaagcctttcatgaagccgcagtttcagttgctgagagtcagggaaatgcatcatgtttcagcaagttgctagtagctactacattcaatttctacatattctcataacccagggtacaatcaccaattagaaaagaaaaaataaattcattaaacacctagtttcatcacctaaaaccagcaaatgctttgttgggacttttcatgattcaactaatataaaaagccattttggatcatactcctcaaggttaaatcttctaatcttaaatgataaattcttttacagaagaaaaatctcataatatgaaatatatttcataattggaatatttagaatgcttgttaaattttacttttaattttttttttggaagtagaagacttaaaagcctaatactgaaatacaaagaaggcacttaatatttatacttaagaatcaaaagtggaaaaatgttcacagcaagtttaaagacaaaaaagtcaaatgtgtataccatcttggagtcctaagatgtgaacccttattttcaggttctgccttttactttttgtgtaattttgaccaacgcatgaaacctctgtgagacacaatttccttatccgtagcatggaagtaatacaaacacttagattattataattttaacttattataatttaaaattttttaataagaagagctctttaaatgttgtttgcatatacctttaaaatttgcttagtaaaatataataaaatacagatcatttgttttgcaatttactggaatcaaaatggaaaaaaaagaaaaaatacaaataatgtaatgtcaaaactaccttctgaaatggaattacatttcatttatatcttaagcttttctaaaggctttgtataatatttgtttagaaaattcaaaggagcaaaaatatttctcatgtaataaaataaagcccaacttcaaaacttactcatattatcagctgggcatggtggttcgcacctgtaatggctctcaaaaaaaaaaaaaaaagagaaatgttgtaagaatgcacacttattctttcatttatcctgattagatgtatccaaaatagatttgctttcactggaaatttaattgattgttactgattgataatttaattaaacttctgatgacagttcttctatcactcaacctcccagtaaaaaagtaacataatccagctttcagttcctcacataaggagcttggaagttgccaatctgtcctaacaacaaaaaagctgaacaaactgaaaaatcaactcttcttagatccataagagaagtgaggtcacagggcaaactgctgcccaaaccactggtgagatagacagtaggctatggagaatcacaacataccggagcagaaacctccaagagaaccagtgctggggtagaaaaacctcaactataattgacaaatcgttagaggctgagtgcaggcaagtctgaaagttgaaaaactccagaggaacccagtaatagggaggtccccacaattctgtgtgttttacctccaggagtgctaccaagttctcacagtaaatattggagaaaaattctctcatgcttccagcaagagaagggaaaaagtacacatctttaaatctgctgaagcttggttcttcctgaggagaaactagttaatcagagcctaacctgctggggttttttgttccattttgttttgttatattagagcctcactgacctggggaaagaaaaatgcccaactccagcccactctagcctaccatcaaggagaaaggaaatactcaattccagcccacgttagccattctctctcacctatggtataagaaaaaaaaaacctgaaaaacacttaggagattcacaatccagaggcccaggctcaccaaaagtctgaaacctaattatggaatgatagaaagcttcccctccactgccccttaccacaccaccacccacataacttttttattttatttatttatttatttatttatttatttatttatttatttatttggcagagtttcgttcttgtagctcaggctggaatgcagtggcacaatcttggctcactgcaacttccgcctcccgggttcaagcaattctcctgcctcagcctccccagtagctaggattagaggtatgtgtcaccatgactggctaattttcgtgttttcagtagagatgaggttttaccacattggccatgctggtctcaacctcctgacctcaggtgatccacctgcttccacctcccaaagtgctgggattaccaggcatgagccaccatgcctggcccacccatataacttaaggcctatttacaggagttccttttatccagtacatgcccagctatgaagaaaaaattacaatgcatagttaaaggcaaagaacacagtttaaagagacagaagaggcatcagaactagacatgccagagatgttggaattatccgtatgatacaaaaatggaagatatacatcaatataaatttgtgcaaacccatagaatatacaatactaagagtaaattctaatgtaagctatatgttttagagataatgatgtatcaatgtaggttcaattgtaaaaaaaaatgtaccacttttgtgggggggatattgataatggggtggctatgcatgtgtgggggttggagtaaatggaatatctctggacctttctgtgaattttgctgtgaacctaaaaatgctttaaaaaataaagtttttacaaagttacatgacaagcattaacattttatacccagaatatgtacaatttttatacaatttcaaatttatggatgctaaaattgctatttgtaatgtcaatagattccattttctttacaattgcttgaagcaaagatgtaattttatcaagaatgtttaacacatattttgacaatctatttataaaatctgaaacttatcacatagtttcattttaactagattcaatatcatttaaagtttctttttaaagaggaaacattatttcatttaggaaaccatgcaagttcaacatgggaaatacaaaaataaaataaaataaacacacaagaaagaagcaagtcatccataattccattcccaaaagacaagtcagtatacttctttccagtcttcctcccctccaggaatagtgggtttaccaccgatttttatgttgttgtaagaatatttcaccgacctctgaatttggtaaaaagtactgcctggaaaagaactcttttatttgccagatggcacatggtaaagaaattaccatgaaaatactcaaacctctccactctcacaggtttactggggaaggcagttcaatcagatggggcttacaaaagttattattctctttaaaactcttgtgatgaatttttaccagtagatgatctcaagagggtattcctctggatgtttctattcttaactctttagttttgatccacctttaggtctgcttgtatatttctttttaaaaatcttaagtagtatatcgctgcatatactactacagtagtaggacatagtagatgtattgtatggtccaggtaaaactaagaaattattcttcctacttttagaatggaatacaatgtgtggtccaccatatatattgtcaatctaatttaacgcttctttaatattctgccagtactggtttttagtgctttttaaaaattatatatatatatatttttgcagtgttttcagtcactttaataggaagctggaagaggctgcatcagaggctgcaggtaaaatgccatttaaaatccaaaggccccatccaccacttctaacccatgcacatatataattacacatcattggcagttaacagagttaggtataaaagcaaatatgactatgttatttacaaatacatatatttgtatatatttataacatatgtatattacatatatatatacagacacatatatgaaacattaaaaatgaaaatatttcatttagaaaaccatgcaagttcaacacgagaaatacaaaaaaaaaaagaaacacacaaggaagacacatatacatgtatttttatttcggcatcttgaattgactacgcagagacattgccactccatttttaagttatttttgaaatagatgactaaagattatcatcagcatgtagtggggtacatgctctaggggtagtggggttttctggtctgttttgtccttggtatatcctctaatgcctagaatagtatctggtgcataataaggactcagagtccttattatcttgacattgactttgttaagtattttattatcataaatatttaataaatgagtctctataccaaacatgattacttatgtctgcctatgtttccttctaaagaccttgcctttcctacacttcaccattataaaatctgatgggaataagcatgataacttgactcactgacatctgattcatttactaggcagcaaatattaatatttgctctttggaatgtgaaatgtcctaagtgaaattgagactctaatcagttcaaggtggggttgaaccaaaatgtcctgtagactcaggggctgaagttaccattttgggttcagtgcaaactgataactaaagagacagtggcaattacagggagaaggcaggaaagaacagaaacacagagacaaaaagaaatcggtgattgtatggccccaaagagagtagctgccttaatttcagttttcctaatccaataggccctgctatacttgtttctgttaatttctgtatcttcatagtaactatgttcccccttttctacaggagctagtctgagtcagcttctttttttgcaatcaacattgtgatgagtcatcatataagaaaccttatgttgctattcataaattatttccttccctcctgaaataaagtcatttaaaattaatgctatattgtaatattgaatagctacaatgaatgaacttgacattgaattaatggttacatgatcaagtggcttaaattaaaatgcacagagtggcgttaacaatgtatctacatctacatccacatctagatgttctggagactgttctttttctctgactgacatctattacacttccaatcaaaatactagcttctcattttctcgaaccccttttcacagttttcttcattaaatgtcagtttgtttcagataaggagaggtgagagagagagaaagagagagagagagagattttggaaaaaaaagaaatactgtgatatttttagatttatagagagaataatttagtactcaaaaggcagaattcctttttaggaaaaaaaggatattcagataaattttttcaaataatcatttgaaagcttaaaaatataaaaatgtatttaaactagaacccaataatttagaataattaatagtttcaaagtcactgtagtataattaagtagaataatctttgcattcaagtgtagaataaattcaaggctagttattaaatactagttgcccattgtggacagatgccctctcattcacctagcattttacacactcttccttgctgtttttaacattctgactcgagggtgaatctataatgctgagcacttgaaacttttaactcgcctacctctctctataattggcatattccattcctaaaaaaatcgcaatagactatataaatcacttaataggcacaacaaagcaaaacatgaacaatacacgtcccaaactgatgagacacaaaactattaatgtgaaactgaattgcctagctctgtatcttatacttttctctctgggaagcacatttgaaatgtgggaaataattcaatggggaatataatgtgattttatctgttgtttttagttccaagatttgtaaaatacataaagacacaaaagagctttaaaattttccacaaaataaagtagcaaacctgatcaaatagtaaattcatttttaagatttctcctcttttctcactgaccctccctttccctttagattagcaatcaaacagggactggagcaaaaataaaaagcaggaagtgggcaacatagcacatgacaaaaaaggattttgttgtcagaatcctcagcacgttttattgatgtttgaaattcccaactcattttcaaaatgaaaatgctacaggaagcaggaacaaagttaatgaaaatataaatgcacttttctcctcgtcttccataaccactcactgattagaggcacagtccatttgagatgaggctgctgcctgtgtgtgtgggagggttgaatattttttgctctgggaggagcaactgtgatagccccaaatccctgacagcctctcttcatagactgcaggtctagtgtgcaggtgatagtgctaaactcccagtccaagggagtctaaaggaggaagccgtgaagaaaaaggaaagtgaaacagtggactaggacagaaggacattactattaatactaattttcagccagtgcagtggctcacacatgtaatcccggtgctttgcaaggctgaggcaagaggatcctttgagcccaggagttcaaggctgcagtgggtgacaaaatgaaaccctgtctctagcaatataaaaaataaaaatcctaactttcccattccccccagtgacctgctgttttccacaccttgaatgcacatctcttttgggatccatttgctggagcagaggtgttttaaagatcagaagcatatttgctaggaggcataaataattttcccctcaaatattagagtaagaaaggggaagcacgcaagaaagatacaaatatgatatggtattgtcaaggtagttaaaaatatttgtaaatggatatcaatattgtaacatatttgctgaaaatgaggacatgtagtagatagcaaaatgctgttttttgctttttctttttttttttttgagctcttgttgcccaggctggagtgcaatggcgcaatcttggctcactgcaacctctgcctcccaggtttgagtgattctgctaccttagcctcccaaagagctgggattacaggcaccaccaccacacccagctatttttatttatttatttattttttttttatttttagtagagatggagtttcaccatgttggctaggctggtcttgaactcctgacctcaggtgatccgcccaccttggtctcccaaagtgtaaaacacattttatttgctttcaaactgtccctttaaactttatttataaagaacatcttatgacttttctgggtactgttaggcaatagagacctttgcattcatgctaaaccatcatctcagactctatccagaaattagaatgtccatttcaaattgtaacccaaaactctaaacttgattgaacttacattttctcccctctcccagctgggcccaccacagagtctctgtgtgcagtggagtaagtgggtggcattgagactgggttgctcttccccttccttggctatccaggctggctagccgttggtattgactcctctgggattggaaggcacagaaagtggtgaggaaaggaagaaaagagttttgttttgttttcctgaattagtgccatcgtaagatggcatcacatgttggagacctggcagatgttgaaagctgcctctttgtctcatggtacttttgtgggttcataattggtatccctgctgggtcctctggctgcaactcctttgactcaagcaagagccttgttttccaattgctgctgattaaccagcacccccatcaaggccttggttttctagtggttccatccctaccaactcttgctcttggagccaaactggctttcccagatggtcctcttgggaaggacatcaaatggctgaaggccaggtctctctttgagcttaatgtgagttagataactgcagcccgctttaagagagggtagggttggactcacggcactactcagttctctctctcttaaaaatatatcttcacaagttcttgctcaggcatgaaagggtgcattttctgcctttggtcctggtgtctggctatgactgtccatcctgtgtaaatgaggagagtaagtctgagcaaaaggacaaagtgctaagatggcaaagcagaacctgggtgatgtgtttgaacctcttaataacctaccctggaatagcctaccttgaaaattcatgttataagacagtacattttcctcatttgtttttgttaagccattaagttgggggctccagacttgcaaccaaaggcatcttaacttaagaagtttaccataaatatttattataacccacacaaggggatgtctcagtaggtaatccagttagacagcagaggaagtttatgtttcctcacttttcttcttctttccaagtagctggtgggtgagctcatctgctacaaaacacacttcaaaataagatctttaagttaattttcaaattgaaattgctattattgaaacaacagttgtgatagcacctgcgataacaaatgtaaataaaaacaaataaaagctatgctcaatttgtggacccatcatttctcagtaggcttggatctctagagttcatggggagacccaagaggtttctaatattacaatgtattaccaatatccagggcaacaatcacatttcatcttagaaaatcagaagatgatgtatgtgccaaaaacctttggaaattgaattgtgctttatgctgaattctgtttggaggatctagcaaggacccattttactgttccatcctatgatgtgggtgtgcttatattaaatcactttcagagaaacactaggtgactaatttgtgacaatgatatgtttgcagactaacacattcgtaagaacagcagaataatgagctaatttgtaacgtaccagatggaatgtactgaaagctagtggcctaagctatcataattgtcctttataatccaagaagtcatttctagtaatcttgctacccacaacattgtttttatataaacaggtcacagtagaactaatcctcttcccgtgaaggcaggcctctgttatttcagtgtgcttgcaactggggagctgctgcagtgtgtggttctggtttgctttttttttttttaactcctatgtctgaatggcaccctataatgagggatcattaatcttaactgttctgtagcccatgtcattgttgttattttcttttgaagttgtttcttccgtaatttacacacatttaggtatattcaaatttatacttgaactgtctttctttttcctctatgtttgtgtgttccagctcactgaaataggaactgaatcctcagcacttttgagactgcccatcccaaatcaatccagtgattactttaaccttcttatcattagtctcactccctctcctttcgtgctcaaccaaaacttgagatttataaatctgaaccccaatttcagctctttctccattacatctcctcagagccccaagtgtaaactagctaacttgtactgctaggttaatagaaatttttctaaaagaataactaatatcaattttcctcaaactctttcaaaaacttgatggggtggaatacttccaaactcattttacgaatctagcattgccctgataccaaagccagagaaggacactacaaaaaaagaaaactacaggccaaagtttctgatgaatatagatgcaaaaatcctcaacaaactagccaactgaatttaaaaacacaataaaaagactgttcaccatgatcaagtgggattcatcctagggatgcaaggatggctcaacacacacaaatcaatacatgtaatatatcacattaacagaacaaaggacgaaaactatatcatcatttcaatagacgcagaaaaagcacttgacaaaattgaacatcctttcataataaaaacccctcaacaaattaagtatagaaggaatgtacttcaacaagcaaaggccatatatgacaaacacatagttaacaccatacttaacaaggaaaagttgaaagcttttcctttaagatccagagcaagaaaagatggccactcttgccacttctattcattataatagaaattgcagtatacaaaatcaacatacaaaaatcagtagtgttgatatacactagcagcgaactatctgaaaaagaaatttttaaaatcccatttataatagttacaaagctgtataacattaaagatgacacaaatgaatgcaaagatagttcgtgttcatagattggaggaattaatattaaaatgtccatatctgaaacaatctacaaaacaatctacagattcattataagccctatcaaaattccaataccattcttcacagaaacagaaaaaaacaatactaaatttcatatggaaccacaaaagacattaaatatccaactcaaccttgagcaaaaagaacaatgccaaaggcatcacattacctgacttcaaaatacacaacaaagttgtagtaaccaaaacagcatcgtacttacataaaaacagacatatagaccaatgaaacataatagagagccagaaataaacccctacatctacagtgaacttattttcaacaaaggtgccaagaacatacattggggaaacacaatctcttcaataaatggtgctgggaaaactgtatatccacatgcagaagaataaatataaacctttatctcataccatatataaaaatcaacctatagtggatgaaagacataaatgtaagaataggggaaaagctatatgacactgatttaggcaatgattttttgaacatgactccaaaaccaaaggcaacaaaagccaaaatagacaagattgcatcaagctaaaaagcttctgcacaacaaaggaaataatcaactgagtgaagagacagcctacagattaggagaaaatatttacaagctatacctctaataaggaatttgtatccaaaaatataagaaactcaaacaactcaatggcaagaaaataaccttattgaaaaatgggcaaaggaactaaaaagacatttttcaaaagacttacaaatggccaacagacatatgaaaaactattccacatcactaatcatcagaaaaatgcatactaatactacaatgagctatcacttcatacttgttagaatggctattatcagaaagtcaaaagatattaagtgttggcaagaatgtggagaaaagagaacccttgtacactgttgatgggaatgtaaattagtacagccattataaaaaatagtatggaggttctttgaataattaaaaatagaactaccatatgatccagcaatcccactactaggtatatatccagataaatcctgcatgatctcattcatatgggaaatttaaaacagttgagctcatagaactagagattagaatggtaattaccaggggctggggcaactggaaatggaggtgcaagtgtgatattgatcaaaggaaacaaaatttcagttagataagaaaaataagttcaagaaatctattgtacaatatggtgattctagtcaataacaatatgttgtattcttgaaaaatgttaacagagtggatattaagtgttttcatcacaaaaataaccatgtgagttaatgcatgttaattttctagatttagtcagtctacaatgtatatatacttcaaaacatcatgttgtaaatgataaatacacaattttattggacagttaagaatatagatataattttaaaatttacttagatgtatatcaagacatgccatatgtttgaatacagtcttgtaaaaacagtttttctgaagaaagcgtggttttctggaaggagcacaggcttttagtatcatcggacagacctgagtctcttattaccactttatttacttagtctcatttcccaaccttaaccaaatcttaattttttcgtctggaaaacaatgatacatatctcctagatttcttcaggattacattagaaggtatagattaaatcatgtagcacatgcaagtactcaatgcatagttgtttcccttgattcctcagatgtttgccatttaacctgctgactgcaatggtgagaatgttaaattagggaagcaagaaaacagcagtgtagaaataggagaaggatgaataacataagcttctaagaagcaattattaatgcaacgtaagctgggagggtcgactgtaaacagccatggtatggttttggtatcatttgccttaaggagagtctataaattagagtaagaccaataacccagaagaaaaatgggacatggatgcaaataaccatcacagaaggggaactataaatagtcaaaagccatttgaaaagatcttcaatctcactgataaccaaaaataaatcaaactacaatgaggtattttgcctatcacattcgtttaagattttttttaaaagactaaaaatatgcagattgtgagggggtgggaaacagtacacccatacacagttgttagaaacatggattaggagagacattttggagtacaatttagcaaatttttaaaaatgtaaaccatacataccatttcagaacaattacatttgtaagagtttatcctacaaaaatgattgctcaagtgcacacaaacatacacacacatacacacattcattttggcactgtttataagaccaacaaaacaacaacaaaagtctgtttctttctctctgaccagatattaaattcctggggagaaggtcagacctttctacctcctccccagtaacttccaaacccgtaaacatgtaacagggttgaaggtgcttaaaactgcatattggctgacaaaacatcagaatatttttattatgtataaagacaattatatagatttataaaatttgtaactgacttgctatttccaaaggtgaaaataagtattcaataattggcaatgcaaaagtttatttttttctatccattggaaatttgtgaacattttacacaataattgagttttatcaactttccaaatataagtatttcttatttgtatttcagataataaatttgttatttctagagacttaaagtatttaaagaaaatcaaaacatcccatcaaacacaattttgttcttaagtctctctttcttcttttattctccaaccctgcctcccatggtatatacaaagctttgctttgctgccagactttctctaacatctaaaaagtgtagaaagcaccgttattataggctaaaattgatctcatttatcccaggagtaccaacattctcaaacaggggttcaaactcctgttactataattcttgggcctgttatttcaatgagaatctaattttcttgcaataacaaatggggagatgggagacagtgtcttccaattacaaagaccatgctcctgatattatcagcaaagcgtacctctgggtcactttcaccagaagcaggtttgggccttagttacaccctctggaccaaagtgatgtgaatttaagtgtatttgttagtgaactgtctgatctgggctatggaacagactaaatggaactaatccatctaaacgggaaactcattagacaggtagtcagcctaacttggctactttattacagatagatccaatattaaaaataagatccaatatttaaaaataaaatagtaccttctttttcagggagaactatactaaataagaacagttgatatacatatattcatatgtagatgcagacatatatagatatatacatatgtatatacatgaatatacatgaagtaagagtgttacagtattctcagagcaatgtgctaggaaaacaccctttcatctatgtgaaccccagatcaactcgtataaattctgtatttgtatgtttctagcactataaattgagctgagcttctcaaaagaatacattgtattaactaaaggaattcaattaataattagcaaagaaactaatcagctttcttccacataccatttagaaacatgcaacagcacattggaaatggcagcaggaggagagtgaaataaagttaatattttttcaagtctgtcttctggggaagactttgtgcattgagacttagacaagttatttcctttaatacaataaccttataaagcatgtactaatattccccagtttatagatgatgaatctgaggaacctggagaggttaagttacttgcccatggacctggagagtaaatggctgagctgtgcttggacaccaaaacctacctttgcccaccatactgggagaccagaattgtcctgtggattcggagaaggctggacaggactggttggaggggatgcaattatggaaagagtagatggagtaataaagaacataaccttcgtaagtagtaaatgccaggcactgtgctcaatacttgacttgcctttcctcatttaatcttccacaaaagtactactagtttgtccactttacagtgaggaaaacaaagcacagaatagttaagcaaatcacccaaagttacacagccagttagcaagtcttacaattaattcataatattatttcattgtttattttccccatattcatctctctttttgttttctatttctttcttacagaagggggggaaggggacatgttttataatttactgatttcatatacctttggaagttttagtgccttttggttaaaaagtaaccaatatttttccctacgtttcagatgccaagaggctatttagagatattgggaggcactttactgacgttctgcttatgtcaacagatacgcgtagaattaggctgtaatttgattcctaaccctattgatgacttcctaaaccctcatcaaaaacattttgttttagttccccatatgcaaaatcaaaataaagaggtgtctttgtttaaaaatgctaatatatgatttggcaaaggctgacattttatcttgtctccttggctgctgttttaggattattcatctagcactgactgagtgcccagcatccatgcccctcccctttcctatttattatcaggctgctgcagtgcagcgttgaaacatctgatcatttagatcattaaaaatcaatccaatgaccaaatagttctgtacgttttagagaaatgacagaaagtgcagtattagattgctattaacttgctctggggttttctttttacagctgccaggaaagtcatttggtaaaattgattaaaccagcatgccaaggaggagagcggaaaagagcagagaaatgcaaacacagtgagcttggaggggagggcaatgtttttcttgggaatgaagtgagatgtcagtagaggaggcagcagggggtaggtgggaggagaaaccttgcatatagtgagcatactataattagaggtacaagagattcaagatggtaggatacaaggaaccacaatgcggaaacaataaaggaaggaagaaggaatgaaaaggaagcaagctatccatgcgcttctaacatactgtctgcattggttacactgcacagtttgtctgaattaatccaagagacatcactggtacaataagaagaagctgatttgaggatttccatagataaggctctttcaatagcaggagtaggtagggaagagtgcctagtttcctacacagtgtggtttatttctgtaagaacaattaatgaagaaaagaaaataaacctctctacttgtgctcaataggacgatgagtgcataaaaattcacacatgccttcccctaatttgttattatagtggccatacatattccttccctccaaataggaactgtgttccccttacagaattgcatttctcctttaacacgtttcaacaattttttgattaatccgaaaagaaccctggtatgtgaaatcagagagtgctgacaaggatggattttaatgtggggtttctgccactttgcctctatttctaattcctccctatgtcctatttaaagtcacacttagctcacacagcgcatgcttctagagaagaggataagcaaaaccatcaagaatttatttgctgtgtattatgtctgctaacatttcaagtataacaaccacctaaacacaagggacttaaaaacagcattaaaactttaaaaataaagaaaatattctgtggatgagtgcatgtatttccttggatattggacattgaaaatgataagacacaagaaccatttaattgcataggagaacaccaacactagtctaaatgaagtaacccccttgagagaagttttaaattgcatttaccctgtcctgggtatgctacttggaagaagctatgatttagacagcaatttttggcagccaagatttacataagagtaagtagccttcttgaatgagagtggcagccagcttccatgaagtctcccacctcctggcatttaacatacatctttgtagagtccccctcccactctatcccaggattggttatcagacagcagtgatgacatgtcactttcaagaagagattatgaaagactgtgtttgacttctgtcttgggatgtctctgtcttttgtctccgtctctgtctgcctatctgtctctctcatctctcactctgggggatacaagctataatactgtggttagccctatagagaggcccacatggcaaggagttgaggctttccaacaactatatgagtcactgaggaagcagctgagccttgagatgactgtagcccaagccaacaactcgtgagagacccttagccagaaccactaattaatatagagaaatactgagcaatttacatgattgaagatcatatgtagagagatatgtcataaaaggcaggattggatgggaagtagaaggatatagatgcaaaacttcaaggaagaaggtgtactcatcattggtgctattcgtcaccattctcagttctccctctttaaggcacatggcaagattgcactttcttgcccctttgaagttaggcatggtaaccttactttggcaaataaaatgtgagcagcatgagaaacacgtatatctctctaatttgtatatgtacacacacacacacacacacacatatatatatgtagttaatctgaatatcactatgatttgatgaaacaagacaaaaaagaaaaaagatatgtgagcagaagcaatacgtgtcacttctgggggaaaccactgaggtctgtgtatgaagtgccctgtcttctgccacaatgactgggaactttcccgactgtggtgtctcccattaactgtgttcctaagtgaagagcagaaccctctccctccaccacaaacctgtcatgaacatgtagcttgagtgagaaataagcctctactcttctaagcaactgagcttttggtgttgttcctgtagcccattctcactaaaacagaaaatgggtctctgactaagaattcactctacagaaaaaaggaatctggtatgaataacccgaacctcagccacaaactctgagcttcctgaaaggtgtagtggttcttggcagattgtggtgactggcatatgaactctcctaatcatatcccggaaatacaaagagttgtgtggagaactgaaagaacttttttcactagattcctagaatttgagagctccagaagcagcacagctgttggcttcccctgagagagcaagaagggagatgtactctcctttctactctgcaggtgaatagtgttctggtactgccctagatacaacagagaacattcatagctggaacaaactggttggtgtctgccgttaggcaatcaagagactaatgaacatgggtcaaggtcactggtagagcagagaccagtacaaagtgacatcctgggcagatccatgcaggggcaattgcaaggcaccccccagagtctcagagatgctaagtgaaagaggttgtgtgagttactgaggtttatgctggagaatatgagcatagagctattgagactggagaactgattttaatgtgacctaatttatatctaccagcttgaagattaaacatctaaaaccctattacttcattactaattaattatgtgtttgttacaataatctatctgacatcacactgtatcatgtggcattatatggttccaccttgatcagctttcaactcaagaatttaaaatcctcttcaccaggatcttattttggtctagaacagattaatctattctcaactgccacatgtttttagacactatacaaataacattttaaaatgttcattgattcaaagcttagtggcttacaattcagtgcaaaaagacatgggcaatgaagcaaagatgtgagcagttcagctgaattaacattttgagtatatgcacattagtcctttggatgggatcatgcctcaaacccattgaaatacacctcaatgaaacaataagtaaacgagggggaaaaggagactacatgaggttttgagtggtgaagacatgaagtctgtaaggctatggagaataattaaatgtgatatttatatttcaaaataggtaaaacttgataatggcagaaggtaaggagtcagtggagaaaaacagaaaatgctggcagaaagaaacaggggctaggggtacaaggtctcttagaaagtgggaagaaatgggatctagaccacaaatctggatgtccttacagaggattcacatacaaatcttattcaaatacatcatggattcgtactgaaccttcagggtagattttaatgacaacctggttgtcttagtccattcaggctgctataacaaaatacctgagtagattagaaatagcagaaatttattgctgacagtcctagaagctaagaagtccaagatgaaggcatcagcagattggatatctggtgatggtttacttccttgttgatggacaactatctattcactgcaagctcacaaggctcaaggggaaaaggatctaggcttctttcataagggcactaatcccatttgtaagaaccctgccctcatgacttaatgacctcccaaagccccacttcctaataccatgatattgggggtgaggatttcaaaacaagaattttgggaggacacaagcagtcagatgatagccctggtttaacccatatggctcatgttctctcccctagcacccttgtatttccccttgtaacactcatcacaacctgcacttgtatattcatttatctgtctgaatgcccgtctccacactaggatacaaacttcttaagggcagggtttacatctgctgtggtcactgttacacaatctccctagcacagtgcctggtacacagtaaatgttccataaatattaatatttgtggattgatcaaatcaggatagacacaagaacaaatttaagattacttagcttattgtcccaatctcactttggcccaccttactttgtcacttaaatgaagtcctagaatgaactgtggcccagtagtccttatacctttgtaaaacttcattgatattgagggatttcaatccagttttgataatatagcagccaaatctatccacatcactaaagccaatcagccagactgtcattcttactctgatgctatttagaatgtgcaatgagccaccggattccacttcctaaaaactaatttccctagagcttctgctctcttattttatcaatgcccctgaggtcagaaactatgattttgtctctcctgaacagcacaatgtctcattaaaacttcttcctataagcttgagtttttctttagaactgcaaggaagtttcaaggatcatgaaggacctttggtttgatatcagctatttttagtgctttgagagcaacagcacagtcaagttcactaatgacctaaaaacaattaattcaatatatattctgattccttgattgacactgttttttttgtttgtttgtttgttttagatttggaaaaaaattactgcttgttcaatcttttaaaaatggatgttctaatttttttttttacagattccaacaaccaagttggattatcgtatttgaatataaatatgggcaagtctgacaatccaataatttatattttatatagcctgcttctacctaaggagaggaagatagacagtaattatttatctattcaacaaatttttattgactgccaccatatgctaagaacaactctaaaggccagggatatagcagtgaactatgaaataactagggctcttgagtcgtggtaggagagatgaaaaataaacaaaaagaaaaagtgaaatctatataaggattatatgataacagtttgcagggagaacaatttaaaaagaagaggggatggggaatgccaggaacaggcatggtgaagatataattattaaaaacaaaataaaaggatagcctcactctgaagatatccaaataaaggatggaaagaggtgaggaaagaaaacaatggcatatcaggctgatgcaagttctggctgaaggacttgagaacatgaagtacctgaagcaggactttgcttggatagttgtgggaatggaaggagaccagagtgactggaccagaggaggaggagtaggagctgaatctgagaggccacaggaaaaaatagtagattattataaagaccttcaatttcattttgaggaaaatcagaagttactgaagtattctgagcaaagaagtgacctaatgccacctagactggagcagcctcactctgctgaggggtgcaaaacaggctgaagcagggacactggtcaggaggtggtgcagcaacacaggtgggaaagttggtggccggaaccaagctggttgccatggtgatggtgagaaatgggcaaattctgggttatattttgaaagaatgctggctggatttgctgattggattggaattgggagtgtgaggaaaaaaagagtcaaagacaacaacaaagtttggtctgagatcaggaaggctccaggaggagcaagtttgctgggaaagagcaatactttggttttggacatgctcagtttcaggtatagaggagacatcatggtggaaatgacaggaaggcagttgaatatgaaagtctgtatcaggtgagagatccagatcggtagagacttgacaaacaatggcatatagactttgaagtcttgtgattagatgaggtgtaagagatacgcagaaggaggacagaagactgcaaggactaagcttgggacatgtccatgctaagactttggaaagctgaggaggatgcagcaaaggaggatgcagagtcctcaagggaaaagggggaaagccaggggaatgagatgccttgagaccctggggaagagagttgtcttctctaaatggtaggtattcagcatcagtgtagagacacctgctttgtaatatttatttggtcatgggattcacatgccttgacttacacataggttaacattaaatttaatttgcatattttggagaattgaccaatttataagagagaaacaagaggaaagaacaaatgccagaacttatgaaatcttcaagattaactgattacatatcagtaaaccaaaattacattacattaagactgccgttaaattaatttagtaatgcttcaccatgaagattatcttaatatttggctcaatttttaaaaaaaacttttttcttaatttttttacaaaaaaatttttctataactcaaaaaaatattttgagttacagtttacacattaagggggaagccattctccattcacatattcccatatattatataagttgaacttttttccaggcaactgcataatttaagtaagttctgacccatttcttagtcactgccctgactggacttgacctgactggggagcacacattgagttcaaagaacactctgctctgacattagccccataggaataggccactttaaaatgcaaatatgtaaaattaagaaggaagataattatattggagtaagcatcttattttggagaaaaattagaactgaattttatgccaatgataatattcaagctttgtattatcatagaaattatgattttgttttatcttttaactaaaaccaaagtcaaagatttcttacaagtatgagaaaagtgaatttaaaaataaaatagagctatatgagatatgtgcagcattgcttctattattgcatacaatcatagctcagaactgtaagagtctatgttactacacataaagcaacaatatacaaacttctatgtaattgtattttccccttttagaaatggagagaataccaatcctgtttacctaatcagacaagattatgtattttaaagcattttaaaaactatagaatatcgcacaacaccaacggagtaattcagtgtgactttcctttaatggatgaaaagttttaaagcactagttattcttcagttggtaggaaggcatttatctgtaaattgatacatcctcaggcaactgtgctgatattcaaatttagttattcaaaatgtggctttcatttttttttttttttggtggtagggtctctctctatcatctagacctgagtgcagtggcacagtctcggttctgcaacctccacctctcaggctcaagcaattctcaggcctcagcctcctgagtagctgagactacaggcacgcactaccacacccagctaatttttgtattttttgtagagacagggttttgccatgttgctcaggctggtctcaaactcttgagctcaagcgatctgcaggcctcgacctcccaaactgctgggattacaggcatgagccaccacgcctggctgggatatttttatgttgaacattcccattctagccatgcgcttcttacctggacttcattaatatatatatacatatgttagaccagcattttgaggttagaaatcatgaatcaaacagtaaggtttcctgggatatattagacaaaacaaaattgaaccctggtatgtttgaattgggagtagtcctggtacactatgactttctggttcagagataaaagccttaaatggcctcttaaactttaaggattcttagccattcaatatctccctatgccattttgatgagactagtgtaaatgaatcataggcacatagattaaattcccccacgaaatactcatgactatgaaacatttaagaaaaagtgggtaaagagtcaaatatgttttgctgactcctcaatattttcaagatggacacagacacagtcagcacattcaaaacaagctaacagtgaccaaaagtgtctgcatttgctcttatatcaccagtctttatgtcttcttcaattgtgaggaagaaaagctcttcaacaatacagttcacatttcagtctcagtagctggggtaatctgatctcctgattttactctaggcttactttgaatgtgaccctagtaagtttaaaattctttatactgcctaccttacactcctgactagctagttagctaaatagaaatgagggttagaccaaaagaggactatcttacagcgaagtataggtctaggcagttttctatctatttagtgaattattacagaagtcctcaaaatggccttctaggagtctagaaaaagtaaacgtattttccataagcatccacaatctgtctttttttttttcaattatactttaagttttagggtacatgtgcacaatgtgcaggttagttacatatgtatacatgtgccatgttggtgtgctgcacccattaactcgtcatttaacactaggtatatctcctaatgctatccctccccccttcccccaccccacaacaggccctggtgtgtgatgttccccttcctgtgtccatgtgtcttagtagtaaaaccaagaaataatctcatctgattttaatgcaaattacacccatttccaaacatgctggctttttaaaacaatattttttattaagatttacaatggaatttcaaaaatgcagccatttacactaggttgattcttatttcactttatgtacatgagtggtttttcagctttaaagttttaaagaattcagctcagtattttggtgtttcagcactttctattttgaaaatgagccaaatattgatgtggtcagatctatgatccctcaaaccattaaaagttataactctgtgataaatataatgtagcagtgttccaaattggcaactcatattaagtttaagaataggaattacctacaaaaaatttccaagtcaccatatatctgtctctgtgataatgtcatgctccctagcgatgctctcaaatggtagaatgagtcactggcccttgtcttttcaaattttatccatgaaaataaaagtaaactgctaaagataatctagaattttgtactctagcaggtttcaaatataattgcttctgtgttttttggtataaagttgctcccatggagattataattctgatttttttcctattctatgcatttcaagagctaaaataagtgtgggaaaggatatctatatatatctatacctctatacgtattccaactaagatagtgaagggtttaactttgtgtattacttagacctaataattacatatatatatatatatatatatatatatctccaagattttaaagtattaggtaataagtgcacataagatttcgtactttttgtcgttttcttcttttaaattatgcatcagattttcttgtctccaattgctgagggtgtatcttctcttcttatttgctatcaacattatgactaaaaatatatcctccaacatgtctaaaagtcttattttagataggtggatttcaaaccttgctttgcttatgggtaaattaggcaaagagagggtgctgtggtggaggagctccatcgtcctccatcttcaaccttgaagagctcaatttggaaaccagtgtggtagccctgtatagtgaaagtcatttactaacttctcttccatggcaaccacagtaaatattatgctacaatgtggactctaaaataagagattaaaagctaatattgatctatgaatgtatgacaataatagcaccacgaataaacccaagtccaacactttattgcgtctcccccagaaatcatgtgttgaagtcctaactcctcgtacgtgagaatgtgaccttactggaaataggattgttgcaggtatgattcattaagtgaagatgaggacatattgcaagagagtaggtccctaatccagtgtgcctcacgcctttataaaaagaacaccatgtgaagagacaaacacgtacacagaaggaacactatgtgaagactggatggatgctgctacaagcaaaggaactaccagaagctacaagagagaactggaacagttccttccctagctcctttacagggagcatggccctgccaacacctcgatcgtagaattctcacctccataactgtgagacaacacatttctgtttaaaccactctgtttctagtactttgtttcagcagaaaactcatacaccactcattcctcaattttctgcattctgacttcaactcctaccataccaatgaagtgcttttcactaagtagtggcctcttttcaagtcagtcagctcattctacttctagcttttcaactactgactttccctttataaagcctctcttgatcattattttctgatttttttttttactaacagttctgaatactcctcatttcattccttcaacaatcattgagagtttatgtgtcatgtaaaaaaaagaattcttcgatgcctaaaagtttctatgttaaaggaacataaagttgggtgggagagagaagtaaatcaatgagtagattttcattgtacacagtatgagaataaacaggaagccctcttaagcccattctacaggtttaggcagacatccttttaaaagatgatatatcagatatgagctggaacatgaggaggagttaccttgacaggaatggaagatgtaagacctgagccaagaggaagagggtgttctaggcaaaaacagcaaagaaacaaaggctcagagacaagagagaatcatgaacgccagagaattgtgatgaaaactgtgtgcagaatgaaagagaggacctgacaaaagaacagaacaggcgtcgggttctgatgggccatatatgccatgttacagcttggcctctattctgaaagcaacagatagtcactgaaaagtcttaagcaggaaatatatattatcatatttatcctctagaaaaaaatgttctgagcattgtgtgaaaaacagattagtgggagtaagcaaagccaaacacagaggatacagtcaggaggtggtggtaatatttcagaagacagatgatggtggctgctatggtttgaatgtttctccccttccaaaactcatattgaaatttaatagtcattgtaacagtattaagaggtgggacctttaagaggtaattaggtcatgagggctccaccctcatgggaggcattggtgcccttataagggcaagttcagtcccttcttgctctctcctgccctctcactttccgccatatgatgtcacaacaagaaagccctcgcaagatgctggcacgttgatattggactttccagcttccagactgtaagaaatgagtttctgttcattataaattacccagttttaggtattttgttatagcaacacagactgacttagcttaacctaaagtaatacccatgtatataaaaaactttggagaatactagaggtgaaactgatatgacttgacaattgattggacatgagggataaataaaacaattcaaaatgattatcaagtttctggcttgtacaatttaataaaatctgatgtcactcattcagactgaaatatgggggaggagaaaagggggaggtggtagagcagattggatgagatgggaagggaatggaggcaaggaggctctcttggacacatcagtgagtttggacatcttgtgcagacatatctaaaatataagcctagggtctaggatatccagatgaaagactgataaagggaatgcctgagaaggcatggatgtgaagaagaccaccagcatatcacaatcatctgtggaatttctgaataacttaggtgcctgggccccaatccctagtaattctgattcagatgatcgagcatagcaagcggatggctgcattttaaaaggctttgcaggtgattctgatgcatagccatggctaaatacctctggaatatggggtaacagcagaaagtgctgacgaaagaacactgccatttcagtggtaggcagaggatcaagaaaccccaaagaaaactgacaaactgcaggctgttagctaggagcccatggaggaatagactgttttatgcacagagagtggcctacactcttcaaatactgaagagaatctgagtaaaacaaagactaagaaaaaatttcctggatttagcactaaaaatgtcagtatatttggtgtaggaaagtgcaaaattgagagtagatgcaaaattatttggctgttagagggaggaaggcagtaggcagaggaggacccatgaaaatttgctttagcactgttatgctttgctttttgaaggaagtgttttaagtatgtttaaatacccatgttaaagacttagtccatggctaaagctggtgatccaagacaagtggcaggtgaaggagcaagtcaactgaaaaggcagaagcaggtgggactcaaggtacaggagcagatttctacctcaaacagaaataggatggaaatgtccatgtgaccaagagacagagtttttattgggaaaaaaggacacaaggctgactagagaaatgaatgggattttggcagtattgaggctccatccaattgggtctggagagtatgaacttgctgtggcaccagtgtaagtggttgtgtttttctctggaaacacaagggttaaaaatggggagatcacacaggtggattaatcctggcttgttatctcctgtttgggtttatgaggagaacaatgaagggttagcaagaaagcagttgagaaataagactattaggtctttaacgtaataagaggagctagaaagaaagaaaactatgcttagagtgtgggatatttgagtttaagattttgaggttggttggagcagttctggctgatgacaaagttcagagtgtggccatggaggtgaattgccaaggtaaaactgaagtcaagatcagtggatataaggaagggggatatgagaaaataaggttctcacccttgattgcacattagggtgatttggtggctataaaatctttcaacacttcagccccagtgaaatcaggatctttgtgggtagaaccaaagcatgaatacttttaaaagtacaaagattgagaaccacagaactcagctgtctgttttgtctaactgaattttgaagtcactcaaggtcatgaattgtagggatatttttggtttcaagacttttactcagcaaagtattgagatgaagagaatggcaaaatagccagcatggggaagaaacaaagaattccaacagctcttaaatattttgtggtttattataaaaagataaatggaacaaggattgtattgtcagacttctttcttatgataacctagagaaatctcctatactctcatttcctcttttttttttgtggccccctagagtaggagtataaataaatccccactttctttgtaaaagttcaattgtaaaagttcaattaggcaagttagagctataagcctataaaacactccagactcaactctgcaatttccatcttcacacttcaggtggctgtcttagatttagtttcttagactagggcctgcccttattagtttttcaattaccaccctcttccagagactgggtaactgatcaggtctattccagaggttgtatattagcaataccctttgcttcacacaaaaaaagctaaaaattaatggatatcctttatgtttcctggagtgagcaccttcatctgagatgcattgaataggaagccagctgagttcttcttgtcaccatggtgactttagcatccctgaattataggttctcacaggagttcacccaggtgaaggctttgaatatgatcagaaagcaaacctgctaggcccctaaatgatgcttcagcttacaaaagtatcaaaataatgattgggtattccctagcatagtggctaattcctagtagtttctcactgattaaatctgaaagatattttcctccctgttctccttcctgcagcaacaaagcccaggcttttcctgggaagtctaaggttgcaaaagatcttggttataaacaacagtagtcagaatgtccctaggaagccaggcttttaatttatcaagcattccctggcagtgaggcatccaaatcattttacttgactttttccttacctgataaatcagcaaagaacaagaatatgatgctaaattagtctgtgcaagaatgaaagccaaagtttccaaattttctgtgcccaacaactatgtgaaatctgagaaatgaactccaatcagtaacattaatgacttaaatttgtatgactttacagttcagtatatttatacgttatagtttatattttcatatcttttatgtcatctgatctttaaaagagttacaagtattgcctctttttaaaagaaaatgacttctggcttcagaagataaaacttgccagaagttaaacctgaaattaagtggctcactggaccccaagttcaaaatcagatattttgacttagaaaacagagttctttccgctacactattttctttatatatatatatgcacacacatatgcacacaaacacatacccacacactatatatacgaatgtatgcatacacacatatattttaagaggaaaatataattccagggggaaaagtattattgcaggtatcaataaccatttgggacaaatttaaaaggtcttaattctaatttgctgtgaaaagtcatgccagagttattacagcatcaaaaagtaaaacaaaacaaacaacttcagttccatctgatgtagctgactttttgatgagactaaaactgtgtagttcatcatctccatccaagttcagatctcaagtctatgatcttgactaccttaatgtatggctattattatcttgatgatcacattggctttgctttcggcacaccccgatctctctccctttcttctgattttctccactcaaaacaagaggggtatttttctccgacatttgtctcttccatgcccaatcttaaggaagacctactgtagttgccaaagcgcatcagcacctgggagactattttagaatgactgacatcattctcctgacactcaccatcagcccaattctcaaacaacataaggtctgagaacacagagtcgggtgctgtaaactcaaagaagtactttaaaccatggcaaattcatcacccctccaaagtgctgactaatatcttggggctagttcttttccaactcagctcatatcccattatcaccacatctcttcagtctttttgtcctgattctttatcgttgtgatcaccacccagtaagaaaacccttcctttggccttgctcttaccatatttcattgatattatgatgacactgattgtgagatgcattattaattgcttaatggtttttcaggacaaaaataaacactaaccttattaaatgagcacatcaattgcatgactcatccaaatttcagaaacgttaaaataataaataatgcttcaaaattgtcaaaaatacagaatatccttgctcacatcctcatttggcatagtttcttctgctccaacattttctgtaagaccctaccctctcactttcctgtacctctagtacagtgctgttcaatcgaattttctgtggtgatgctaatgttctaaaatctgtgctgttcaatattagacaactacatcttacacctaggccaaactttttcttcctaagctagcttgccctgttgccctcaataacaaccttaatcacagtgataatttcttcagactcacctccacttcactttagaaagacaaagtcgtggacttggtcacctccagccctgcatcccagtgcttggagctctgttgttctgttccatctccgaggcttgaaactgtctcaatttcccctctctaaataaatctattatcttcctatcacttaaacttcctagctcaccctgatcttggtatgtgccctcatgagaacaaccaggtccccagagttccaattcctgaccttttataaaccttgatacccaccgccttctgtaccttctagactgttgagcgttactagaaaaaaagattagtcatcttgactagatgttcaatgaatcgtgctatttacatttaaggagggttcaatgtttctctgcaatgctatttttaacaagtgattgaaaagctttatgttacttttaaattcacaacattacctcactttcctttactgtcaatagaaaataataatggcaatgatagtaaaaaatagctaacatttctgtgcatttataatgtggtatatgctactctaagcagtttatatgcatcatatcagttaactatcataaatattatttggccttactattttttatcactttacagaagagaaaatatatataaagcagccccgttgtgttgagaggatagaagccttcttacatgtaattgctttttctccctcatttgaaaccactactcattttctgttcttttcctgtatttcagaaaaataagattttcactttccagactaaatggatccatgcacgctcttaattctatccccattctatccttcaggacgtttctcctaattccatcccctgttccatcctttggggccttctctgtctctgacatcttcagtctatccctcctttccttcacatactcctgccccgatcacaatggttctttccactctatctacaaattctcacttaatgaacagaaagttaaaagatcttctcccgaatttgtcatttttttttcagtctcctccctttgctttacccctttaagcttcctgagagactgggaagggcagtgtgatgcagtgaggaacatgttcccaggcagccatcagggaggaggccacagagacgctgtggcacaaacgtggtagtactcggctttaatctgcaatggatgagaatgtctgagcagactgatgcacagaggaattatgtggcctctgccttgttatccaactattgagacatttggtctacatctaattaagaattatttctggcagtttttcaattacatggttatttcttcattttgcctggtagttctttatttctcaaatggtagaactcttagcattcctttaagcctttgcagtatgatttctgcctctatcaattctgattgctataattgagttcctaaaaagtcaacatgtgaccaagctttttggctgtgattattgtctttcttagcatttaaatacaagatgatcagccaccctaatcttctctccttttcaaatataatggaaacactgcttaaatttattgataggaattccacatcttggctaatacacaattctaagatgactcctattaccctcagccctggtgttactccacggttatattactttacatggaaaaaggaatttttgtagatgcaattaaggttactaatcagctgaccttaagataagattatcagggtgggtctaatctaatcacatgagtcctataaaacctataaaagcagagtgctttctttagctagaagcaaaaaaggaagtcagagagatgaagtgtgagaggggaggtcttccacggctgagatgaagatgaccaatgggataagaatccaagagtggcctctagaaggtcacagggggctacagccaacagctagcaaaagaagagggatttctatcctataattgcaagaaactgaattcttccaacagtggcagtaatgatcttgagagatgaccttgattccagataagatcacagctggttagcaccttaatttcagccttgagtttgagactctgagcacataaaccagccctgttatcctgaatttctgacctaaagagctgcgacattaaaaaaaaaaaaggatattgttttaagttgctaagtgtatggaaatttgttactcaacaataaaaaaagactatagccaaaacatctggataatttattgctgcatccttcatatcttagataagaagacggtgtctcataactctgaaacataaatttctcaatttttctttaaaataaaggtttgctcaagtgtaaattagaaaacatatgctttattaaaagaacattctctttcaaaaataaatacacgactatattattcatggattctttatggcattacaaaccaatgactgggcgcggtggctcatgcctgtaatcccagcactttgggaggctgaggcgggcggatcacaagatcaggagattgagaccatcctagctaacacggtgaaaccccgtctctactaaaaaaacaaaaatacaaaaaattggccaggcgtggtggcgggcgcctgtagtcccagctacttgggtggctgaggcaggagaatggcatgaacccaggaggcggagcttgcagtgagcccagattgtgccactgtactccagcctgggtgaaagagtgagactccgtctcaaaaaaacaaaacaaaacaaaataaaaaaaaccaatgcctggtttccattttagggtccgttaacattaaagtaatgtttgttggattctataaaataacagttggcctctgaagtatttaatgaaatgaggtttctatacatcaaacatttaaatgaaagtcaacaagagaattagatggtttaaacacaatggttatatggaaccatggtaatggtcatttcataaagtttatgtgtatatcaaaacatcaagttgttcactgaaaatatatacaatttcaatttgtcagttatatcccaataaagctgaaagtactattgaattcttaaaaaatatgttgaaccatgcatttctttattcaagggtgactgctttacagaacaaatgagtgacttaatttcttaatttggaaattctattatgtaattttagttaagctaactgcaagtttgcagtttacaaaaatggaaagcttttttataacagtgagatcccatctctacaaatttgttttttaaatgctaaactaaaatagaagacattaatattttaatagtgaaaggatgagcattagtttaactttcagtggtaaaaaaatcatattaacatccaaatcatgtaacaagttatttgcagtatgagaatagagtcaatattttgattaaataaattaaggtaataactttaatgaacgctgagctaaaatactaaaatgcattgatgaatagaggcatgtctagaccttgcaaatatatatgcttctattgcttcctatgcctcaaacataaataagatctttaatttctgtctttattatgtctgataaatatgctcctactttgcctttgttggctctataatcctccaattataatgcttctgttgtttgtcttattcttcaaaatagcccaaaagacctatcaggaagctttggattttgtacacatttaatttttcatacttcccctattcacttcctaatgaagggtctactctacaaccacattcaggcaataagaattagttaggtaccaacttagagtctagtccttccagtagcatttttagttcttcaggtaattgtgacttgactcacttaaggtcatcaattaccattcctcaaatttaactggatggtgataagtttgaaggtgtgaatggtattccaatagagaataccctgtgaccatgtattcttttcagaaaagtcacaaagcaggtgggatattttgtcactgttcaaagattaaaatgatagtaatagaggttatttaaaaatgttccaaattctagggttttatcttactattctttttccaaaactggagcatattctaagttcattgccacatgtatttcatattttattcttacctagcactgaattttatataagcaatatgctttctatcactttctaactgcattatgtattatcccttcaccccaccccaaagccttttgttaagccagtgatatcaatgaatgcctcctttaggggtgtggttcaggattcagtaacacattggagtatgtgctatacttcaaggcacattggagtatgttccttgaagcatcagatttttatgtgaagccaaaatagttttataaaatatagattgttattcatagcaatggtttttactgccaacaatgagagatgtttgctagcctttggttacttcctgagcataaaatcaccccagcactgcttatccctaaggcagaggctgaacaaggatggtgagaatctatatactttccagggttgagggaagaaatgagcccacacgtgacacctgctgactccttgtacctgcacccatattttatcctcaagtaagggatatctcagttcattgtccttaaagacatgtttctcaaagagtcattcttaaagttgtgtaaaacagaatctgtacattaattatctatgcctactgcttacttatctgaatagcaaagacaacaacaattaaaataaaaaattgctgccacagaattcactataaatgttaatgggactctcaagacaacccctttacagcttttcaaaacttcaaggggtatttttaacttaataatggaagaagaaaatgcttgcaatacacccaatacacctggtaccataaagaagaacaaatcaactgggagctgtgtggtgtcatgagagggcagcaatgcagggcagtgttgtggaatttggcaggcagcaccgggtctgaactgaattatcactattatatcctcatctatgcttctatgtctagaaatgtcccatagaacttcctgcagtagcagaaatgttctatatctgtgctgtccaatataatagccactaatggatatttaaatttagatttattaaaataaaattgaaaatttagtttctttcacatatggctagtgaataccaatttggatagagaatgagattcttttttagatacttataccacctattacttattgagccctaacctcaagccagaggttaaggatctattttgtaccaggcactgttctccaagcccagaatagaacaacctccaagacaagtagggccctggcaccatggacttcagactagtgtgggggatagaaaaagaataagaaaataaatgattctatgatttactttggcatattatatagggcaagggactgtgtgtgctaggaaagggtaagactgttcttagaaaaggtagttgtattagtccgttctcatcccactaataaagacatacctgacactgggtgatttataatggaaagaggtttaattgactcacagttcagcatggctggggaagcctcaggaaacttacaaccatggtggaaggggaagctaacatgtccttcttcacatagcagcagcaaggagaagtgccaaacaaaaaagggaaagccccttaaaaaaccatcagatctcatgagaactcactcactatcatgagaacagcatgagtgtaactgccaccatgattcaattacctcccacttggtccctcccactacacgtgcggattatgggaactacaattcaggatattttggtggggacacagccaaactacatcagtggtcaagcatggtctgtctgagaaagtgacttctgagtgttgttatgggttgtactgtgtccccctatcaaaattaatgttgaagcctaacctctcagtaccctagaatgggaccctattggaaatagggtttttgcagatgttattagttaagatgaggtcatataggagtaagatgcaccctacttcaatgtgactggtgtccttgtaataaaagggaaatttggacacagagacatgtacagagagaagacaaagagaaatttggacacagagacatgaagggaaatgtggacacagagacatgtacagagagaagacgaagagaaaatacagagagaaggccatctacaagctaagaaaaggacctgaaacagatccttcctcacagccctcggaaagaaccaaccctgccaacaccttgatctcagactcctagcctccagaacggtgagataataaatttctgttgcttaaggcaccaagcttgtggtattttctatagcagccctagccgactaatacaagtggcaacttgatgaggaagccatgcaaattgcgcatgtcatttaatcctcacagctaccctatgtgttaggcattggtgtgtccatttatcagatgagaatttcaagttcaaaactatgaaaataatttgcctgaggaaatattgctcttatgtggcagactcaagacagaagtctgagttagcatgatccctgggtctcagtgtttcttattatactcttttactaccttgacttatctaaatacactcacatctgattcaatgacaatgaaacaattaattttacaagtaaatagattagtttatatggttatgtctataccgtagtttcagttaaaataaaattttaaagtctagcaaaggtgtcttatttggcttttccttcaaaactaactccgtatttgattgttgaatctatctgtgaatattagcctttgaagtatggagatacatacacttttatgcatatgcacacatacgcacatacgtctatatataattttagtctattttatagcttacattttagattaatttaagcattgtgatgtaaagtctacagtactcttttctcagccttttccccactaccttcccttgtattttacgtgtccagcctgacactcatattatcttgcttcaggatacatctatttcttaaagtcatttttctatgaggacaatcacaatccccttataatgaatacaagcatgtttatagaccctcaccttcatcaaagaggcttcaatgttctcttaagagtgtatgaagctggaaatatattctgaaaatataagctcaacacctgccttcctgaaaatatgggtggtggaaagcccttgtgagtggatagcccatgatttgtttgctcaattagtgaaaagaaacacttcaattggcaaaaatgtttgcccaaatgagaatggctttatagaaatgttctaaatatggcctgactctaatcaagcaatgccatctgcttgatgagtgacaaggtcacaacttctataatagaagcagtctccagtgccagaaatgaatatacagaagtccaactgctgcctacactaaacatggctacctatgttgtaggaggcctgcacgtgtctgttagcttcaggtatgatcttaccaagaggcactttcattggtcttgatcctgctaattatgaggtgtagacccttggctgagtcacttaatattcctgacgctcggttttttttccctagaaaatgtagctaacaatttctatgtctcatatttgtggaagggataaaatgaggtcatactcttgaagacatcttgtgaaatgcaaagtaaaatgtaagcaaaaggcacaatttttccacctgtaaggaatggctcctagaataaaaaattactttgaagtactttttgagtacttattttgtaccaagcacatggccaataactttatttgcattatgtcattttatctcataatgacactatcaattatgtattattacaactgccatcttccagaagaggcaactagtagtgcttaaatggtttaggtgagttgcccaaagttccccagctagtaagtgccagagagtagatttgaacccacctgtgttcttaactatttcttctcttatcccttatgcccctgccaacagttaaaaaagagcaactattcttaaaactatattactgagataatttacttgcttttgtttgtggagacaaaaattttaagatcattatttttcaattgtaagagaataaagatggccaaatagaaacagctccggcctgcagctcccagtgagatcaacacagaaggcaggtgatttcagcatttccaactgaggtacccagctcatctcactggacctggttagacagtgggtgcagcccacagagggcaagcagaagcagggtggggcgtctccccacctgggaagcacaaggggctcgggaactccctcctctacccaagggaagtcatgagggactgtgccgtgaggaacgaagctacccagcccagatactatgcttttcccacggtcttcactagccacagatcaggagattctcttgggtgcctataccacaagggctctgggtttcaagcacaaaactgggtggctgtttgggcaggcattgagctagctgcagtttttttttcataacccaatggcacctggaacaccagtgagacagccattcaatcccctggaagggggctgaagccagggagccaaggggtcttgctcagtgaatcccacactgacagagcccagcaagctaagatacactggcttgaaattcttgctgccagtatagcagcctgaagtcgacctgggatgctctagcttggtgtggggaggggtgtccgccattactgaggcttaagtaggtggtttttccctcacagtgtaaacaaagctgccaggaagttcaaactgggcagagcccaccgcagctccacaaagttgctgtagccagactgcctctctagattcttcctgtctgagcagggtatctctgaaagaaaggtagcagccccagtcaggggcttacagataaaactcccatctccctgggacagagcacctggggggaggggtggctttgggcacagcttcagcagacttaaatgttcctgcctgccagctctgaagagaacagcagatttcccagcacagcccttaagctctgctaaggaacagactccctcctcaagttggcccctgacccctgtgcctcccgatagggagatactcccagcaggggttgacagacacttcatacaggagagttctggctggcatctgttgggtgcccctcttggacgaagcttccagaggaaggagcagggagcaatttttgctgttctgcaggctctgctagtgatacccaggcaaacagggtgtggagtggacctccagcaaacctgcagaagaggggtctgactgctagaaggaaaactaacaaacaaaaagcaatagcatcaacatcaacaaaaaagatgaccacacaaaaactccatctaaaggtcaccaacagcaaagaacaaaggtagataaatccatgaagatgaggaaaaaccagtgcaaaaaggatggaaattccaaaaaacagaatgcctcttcttctccgaaggatcacaactcctcgccagcaagggaacaaaactggacagaaaatgagttagatcaattcacagaaataggcttcagaaggtgggtaataacaaactcctccaagctaaaaaagtatgttctaacctaatgcaaggaagctaagaacattgataaaaggttagtggaatagctaactagaataaccagtttagagaagaacataaataacctgatggagttgaaaaaacacagcacgagaacatcgtgaagcttaccacagtatcaatagccaaactgatcaagtggaagaaaggatatcagagattgaagatcaacttaatgaaataaagcatgaagacaagattagataaaaaaagaatgaaaaggaatgaaaaaagcttccaagaaatatgggactatgtaaaaagccaaacctacatgtgattagtgtacctgaaagagatgggaagaatgaaaccaagttggaaaacacttttcaggatattttccaggagaacttccccaacctagcaagacaggccaacattcaaattcagaaaatacagagaacctcacaaagatactccttgagaagagcaaccccaagacacataatcgtgagattcatcaaggttgaaatgaaggaaaacatgtgaagggcagccagagagaaaggttgggttacccacaaagggaagcccatcagactaacagctgatctctctgcagaaaccctacaagccagaagagagtgggggccaatattcaacattcttaaagagaagaatttgcaacccagaatttcatatccagccaaactaagcttcataattgaagaagaaacaaaatcctttacaaacaagcaaatcctgagggatttcgtccccaccaggcctgccttacaagagctcctggaggaagcactaaatatggaaaggaaaaactgataccagccactgcaaaaacatattaaattgtaaagaccgctgacactatgaagaaactacatcaactaatgggcaaaataaacagctagcatcataatgacaggatcaaattcatacataacaatattaaccttaaatgtaaatgagctaaatgccccaattaaatggcacaggctggcaaactagacagagtcaagacccatcaatgtgctgtatttagtagactcatctcatgtgcaaacacacacacaggctcaaaaataaagggatggaggaagatttaccaaacaaacagaaagaaaaaaaaaaggtgttgtaatcctagtctctgataaaacagactttaaaccaaaaaagacagaaaaagacaaagaagggcattacatattggtaaagggttcaatgcaacaagaagagctaactacctgaaatatatatgcacccaatacaagagcacccagattcataatgcaagttcctagagacctacaaagagacttagacttccacacaatactagtgggagactttaacaccccactgtcaatatcagacagatgaacgagacagaaaattaacaagaatattcaagacttgaactaagctctggaccaagtggacctaatagacatctacagaactctccaccacaaatcaacagaatatacattcttctcagcaccacattgcacttattctaaaattgaccacataattggaaataaaacactcctcagcaaatgcaaaaaaccagaaatcataacaaacagtctctcagaccacagtgcaatcaagttagaactcaggattaagaactaactcaaaacagcacaactacatggaaaatcaaaaaacctgctcctgaatgactactgggtgaataacgaaacaaaggcagaaataaataagttctttgaaactaataagaacaaacatacaatgtaccagaatctctgggacacagctaaagcagtgtttagagggaaatttatagcactaaatgcacacaagagaaagcaggaaagatctaaaattgacaccctaacatcacaattaaaagaactagagaagcaagggcaaacacattcaaaagccagcagaaggcaagaaataactaagatcagagcagaattgaaggagacagagacagaaaaaaccctttgaaaaaatcaatgaatccaggagctggttttttgaaacgattaacaaaacagaccactagccagatcaatgaagaagaaaagagagaagaatcaaatagacacaataaataaaaaatgataaaggggatatcatcattgatcccacagaaatacaaactaccaccagagaatactataaacacctctacacaaataaactagaaaatctagaagaaatggataaattcctggacacatacaccttcctaagactaaaccagaaagaagtggaatccctgaatagaccaataacaaattctgaaattgaggcagtaattaataacttaccaaccaaaaaaagcccaggaccagatgaattcacagccaaattctaccagaggtacaaagaggagctggtaccgttccttctgaaactattccaatcaatagaaaaagagggactcctccctaactcgttttatgaggccagcatcatcctgataccaaaagctggcagagacacaacaaaaaaagaaaatctcaggccaaatatccttgatgaacatcgatgtgaaaatcctcaataaaatactggtaaaccaaatccagcaacgcattaaaaagcttatccaccacgatcaagtcggcttcatccctgggatgcaaggctagttcaacatatgcaaatcaataaacataacccatcacataaatgaaaccaatgacaaaaaccacatgatcaactcaatagatgcagaaaaggccttcgataaaattcaacactccttcatgctaaaaacactcaataggtattgatgtaacatgtcttgaaataataagagctatttatgacaaacccacagccaacaacatactgaatgggcaaaagctggaagtattccctttgaaaactggcacaagacaaggatgccctctttcaccactcctgttcaacacagtattggaagttctggccagggcaatcaggcaagagaaagaaataaaatatattcaaataggaagagaggatgttaaattatctctctttgcggatgacatgactgtatatttagaaaaccccatcgtctcagcccaaaaactccttaagctgataagcaacttcagcaaagtctcaggataaaaactcaatgtacaaaaatcacaatcattcctatacacaaataatagacaaacagccaaatcatgagcaaactcccattcacaattgcaacaaaaagaagaaaatacctacgaatacaacttacaagggatgtgaaggacctcttcaagttgaactacaaaccactgcccaaggaaataagagaagacacaaacaaatggaaaaacattccatgctcatggataggaagaatcaatatagtgaaaatggccacactgtccaaagtaatttatagattcaatgctattcccatcaagctaccattgactttcttcacagaattagaaaaaactactttaaatttcatatggaaccaaaagagagcccgtattgccaagacaatcctaagcaaaagaaaaaacaaacaaacaaacaaaaaacaaagctggaagcatcaagctacctgacttcaaactatactataaggctacagtaaccacaacagcatgctactggtaccaaaacaggtatatagaccaatggaacagaacagaggcctcagaaacaacaccacacatctacaaccatctgatctttgacaaacctgacaaaaacaagcaatggggaatggattccctatttaataaatgctgttgggaaaactggctagccatatgcagaaaactgaaactggaccccttccttacaccttatacaaaaattaactcaagatggattaaagacttaaacttaagacctaaaaccataaaaaccctagaagaaaacctaggcaataccattcaggacataagcatgggcaaagagttcatgactaaaacaccaaaagcaatggcaacgaaagccaaaattgacaaatgggatctaactaaactaaagagcttctgcacagcaaaagaaactatcatcagagtgaacaggctagagaatgagagaaaagttttgcagtctccatctgacaaaggtctaatatccagaatctacaaggaacttaaacaaatttacaagaaacaaacaaccccatcaaaaagcagacgaaggatatggacagacaattctcaaaagaagacatttatgcatatgaacaagcatatgaaaaaagctcatcatcactggtcattagagaaatgcaaatcaaaactacaatgagataccatctcacaccagttagaatgacgatcattaaaaagtcaggaaaaaatagatgctggaaaggatgtggagaaataggaatgcttttacactgttggtgggagtgtaaattggttcaaccatcgtggaagacagtgtggcgatttctcaaggatctagaagtagaaataccatttgacccagcaatcccattactgggtatataatcccaaaggattataaatcattctactatagagacacatgcacgtgtatgtttattgcaggactattcacaatagcaaagacttggaaccaacaaaaatacccatcaatgatagactggatgaagaaaatgtggcacatatacaccatggaatactttgcagacataaaaaaaaaaaaatgagttcatgtcctttgcagggacttggatgaagcttgaaaccatcattcttagcaaactaacacaggaaccgaaaaccaaacaccgcatgttctcactcataagtgggagttgaacaatgagaacatatgggcaaagggaggggaacatcacacactggggcctgtcggggggttgggggcaagggaagggataacattcggagaaatacctaatgtagatgatgagttgatgggtgcagcaactgaatctggttttcaatacttctgttgaaagccataaatatgatttaatatggactataataaggtactattctgctcttcacttcaaagacacatcttttgaatatggcaagtagctagggaaatatcaaaagttccagtattatttcgttatattttccaaattctccactaatctttgagtgtagacatttaaccaaataaaatgattcatattacttaatgttgttactcatgccaaatatatttcataataaaacaaagacatctgagtgtagagagaggatggataggaaatgacaaagaaagtaaagtgatttgagaagggattaggtctaatcagttgggtttatttttttctgggaataattaagatatttactgaggcaatgggttatcataaagcaaaaaacaaagaaactcctaactcactccatgagatcgaatttcataaaagcatttctataaaaatgatgaatagaccaccagaatcgaaatgtatgcaaattgcaaagctagttggaggagtgtgtgtgtgctgccttggtctctcaagtctatcaaaaaaggggaaaaagaaaaggtgacttgctgcctgagcagttctatgcctaacatcagatactgtaataccaccattaaaaaaagggaattcatcataaatgctacttaaaagacagtaaagagccaacacacatgtttgagaacaagtaactcctatcagggaccttaaatgagagagatacggagcttaacctgagggcagcagggcttcctcagtgcccccaccctctacctcccaatccttatagtatcacttttctttagcctacaaagatacgtgtgaacacagttttttgttgttttttttttaaagaaatgtaaggacaaagcacatttgtaaatagagggaataggacatagtggattaaggacagtgtatagtgttttatataaaagattctacaacaaattttcttgaaaaaatgaggcaggtatgagatgtcctgaagcccccagttctcataacttttaggatatgagtaaatttgttatatggcatttcacaggtactgaattgcaggattttggtcagtcacagtttcttgccagaagcactatcttttgtaaagggctacatagcagaatttttgttctattttagttttattttgcttttgtttggtgggaagtaggaagagaaaaattcttactaaattccattacctagaaatatttttatagcataaaacattttccacaaatttttctatgcacattatttaataattttttataatatcatttccaaattattatacatctataataccaatgtaatgactattgtgtatagtctcgatattactgatccatttttgagatattaaggtttttttcctttttttactataataaacaatattgtgatgaacagcttcttcacatatattttggctaatttatctgactatgccctaaagttaaattcctacaaagaagagaaaatcttctgttttggaaagataattggtgctttagaaagatagttcttgctggtggcgatggctgggttgggggagagaaaagactaaaagactaagaagcccataaccaaaactcaggcagtggtaacagaagtgcagatgagggagagcagaaaggatactcagaaggtagaatcaacatggtacagagactgatccatgggaagctaaggagagactcaaggagagagaaaagtcacgggtggcctgaaggctcctagcgtgaacaactggggagtacataatgaatttcaaattgaacttgttgagtctgaggtgccttcaaggcatcctagtagaaatggtcaatgggcagtgcacagtggaaatatatagcattccaggacacagacccacacattcctgacaaacacaaatcaatttggttttacaggagttcataatatcacccctgccaattttaaatatagtgtctatagtgtgtgtgtgtgtgtgtgtgtgtgtgtgtgtgtgtgtgtgtgtgatgggatggggattacacaggaagtttctttggttgttgtccagtcactgcatttgatgtacatttgatgtaacagttctttttttttttttaacattaatgccccaaccttaaagaagagcttttgtcttattataaacaatactgaattaaaatttgcaaatttaaaactagagcaaatatggaaaaagttattgaaaagtaacaatcaatccatcaatgctcccagtgaagaataaacatcatcataagaatgcccaatatttgcagtgtctattgttttttgaaaaagatttacacaggcataagatatttgatttttaccataaccttggaaggcacattagtttttattgctaatttacagatctaaggaaactgaggttctgaaaaggtaaacagtgtttttctgttgttcaaagctgggaaatgcccaaattgaaacttgagccctggctttcagactctggagccggagttcttcctctcacccttcagctagctgcattaagtcaatcaatcaataaataactttttattgcctgttctttctcttcctcctccttattctaatcaagatattttaagttttgaattaaaaatttatctcattcttatggcaaagtaggtttcaagccatttcacggaaatttatacaagtgcctttgtgctacaatggctgaaccagagcacccagctctcaggcagtccccactgtggagacagagcctgctgtcccactggacagagcctcaaccctggctgactcacagccctgtgtatgtcacttggcagcttcttccagtagcatgtccttccactacattcttcagtcacctttctctactgcacaaatcctgcctgataatatgtgtgcaatgcaagcccacactactttttggaacctcattcaattgtcacctcttgcacagaaaacaaacaacaacaacaacaaacaaaaagctatttttgagtgtgcctgtttatcaagagtgttctctaaaaatttatcataatgccattatcattctgtaactccatggttcagatttaaggcaattctatatctctttgtctcttgtgtagtctccagtcaacttcattctcagagatttatagaaaatttttcccatatactgctactcagaagtcacatttatttttcaggttttttaggctgagtctgacctggaagcactttttttatgggttcagtttccctactcttgaaggttaaagtgactttctccggcttcctagtttattttagaaagccattataactgtgacagaagaaatctaaccaaaatagcacaaaaatattctgaccaaactcagtttttacttttggctgaaagctatttaatgtatgtttggtgccacttaaaaaaaaagtttcattgagatgtaactgagataaaataaactgcacatattttaaagtgtacaacttgacaattactgcaaatgtatacaccagtgagaccatcaccacaagcaagggaatgaacatatccatcactcccacactgccgacttcccgtgtgttccttcagaatcccttcttttccctcctttgccacatattctggaaagggagagcgaatatcgttaaaacttcaaattctttccagcttttctatagatctaactttgttttaataaaaatcacaataggagtcttaaaaaatgtaaaaacattgtccagaaataaaagcactttaaaatgatgttacaaatgaggaaataagaaaacaatgaacacatcaatacaaaaccaggcaaagtccataggcagagaatgctcatccctctgaaatggctaataaaaagactgaaatctaaatctaaatcttactaataatcaaataaataaatgacaattaaaatagcatattcatttacattaatttttgtcaaagatttagaagacaatatgatgctcagaatttaaagctttttgaaagtagacactaatatattactgaaaaaagtacagatttccttgtaactattgcaatattaaatgtacattatttttgatgtagcaacttatctaggaattaatactaaagaaataaataaatgaacaatggcaacaacttgggagcaatataaatgtctgtcattagtaaactggttaactatctaatggttcattcttataaaggaatcaccagaggccatttaaatggtaaagtttatctgtatgaattaagtggaaagaaaaagagtggaagtaaaggagatacatatagaatgatttcttttcttttgtacacaaaaataatccactgtgtttttcaggtgtaggaagaactctggaaaaaactatataaaatttaagtaaagttttctctgggaatggaagtaaaacagctttcactttttactatatatatatttaattttactaaaaaatatttactacttttataatttcaaatgttttcatttaataacaatatgtatatattcttattaaacttatatagttttctatgtccctctaaacatatacactgatacggtttgactctgtgtccccacccaaatctcatcttgaattatactcccataatttccatgtgttgtgggggacacccggtgggagataatttgaatcatgggggaagtttcccctatactattctcgtggtggtgaataagtctcacaagatctgatggttttatcaggggtttccacttttgcatcttcctcattttttcttgccgccaccatgtaagaagtgtctttcacctcccaccatgattctgaggcctccccggccatgtggaactgtaaatccaattaaacctctttttcttcccagtctcaggtatgtctttatcagcagcatgaaaacagactaacacatgcactaagaacaaaatcctaaaaaatacactacaaggtgttagagtcattctataaccacgagaagtcttataaaaaatttgttcatctgatttttctaatttttgtacaattatttgttataagctgtataacaaaatacttctaataaactcttgtttaggtaaaatcaatataacaaaaaattacttaaatagtataaaatagtcaatctctacatttttttttccaaatgctgacaataacaataaagtaaataaagtcactatagggacttctgcttcttgcccaaaggagtcaggtttatgcttgctcatgaaagaatggaaaaactggacaaaatgaatgaaacaacagttttcagaccttaggcaacagttagcttagcatggtgattagagaaaatgaatacaatgagatgacgcctatggttgccccagtgtacatgctggagagcttccaggtcccagcataaggaggagggatcactgcctgacctgaaagtctccctaagttgaggagatggagctgggaattcagggaggtcaaggtaactagaatttgctgaaaagagaggagacagtggcccagagagggaactcagggacatctgcacaggccccctcttgagtcttcagctgagtgttgatcagcctgaggaaggtgaaatttctgggaaaaagctggaggaaggaatgacaaagacacgaggaaacttttgggggtgatatatatttgtgtactatctcagttttggtaattttctcacagatgtgtatacctatatcaaaatttactaaattgtgtaatttacatgtagtttattatatatttttttccagtggagttttaaaaacaattttgtaaagaaaaaaatgtatggtgaaaatgaactgatgggataggatattactcaaattagctctttgtgtaagcacggtacaattagcatcgatttacatttacatctcttcaggttgacaagaaagcaagtatggataccaccaaaaacacctatataatttgcatccaaatgtagtaaattactttgaaaaatattggaagttttccctagtggattaaagttttcctaacatgtgactttaatcattggcctattactctaagaaattgtaattcactaataatacataaggccatagacctgggtctgccccctccctcaatatcaataataccaacatttgtagaaggtatataaatgttatgcacttcaagaagagaagtatgccaagagagatgtaataatgcatgagatagagtctagagaatttagaacaagccttggtttagatgaacattaagggattaagggctattcttccagtaggacatttgtaggagaacaggaaagccaggtgaccatattctacagggcaggcctgagctttatctatttcgtggctggatgttgcatgttctctgaatcagcaaattgtcagtgggaaaaatgtatctatattgactgctctcaaccagcttatttaagataaaatagtaccttggcagccagctgaagagattttttggtactgtgttggtctgagtaatggattattgatctacagttaaactgatctgaaggtcagacttctaggatttctctcagtctcacattctgaatccattgttgtcttttaggaatggttatatcagaggtacctgactcatctttggccagaacaacaggagcaaatctggtattacagtatgtgggctgcaaatataacaaaattagtgcctctatattttgctctgcagattgttcctgaattatggtcccacagtcatgctgcattgctcactggaagtttctataatgagaatttaacccacttgtttacactggaacttagttcataggttctcatcacatttatttcaggctttcaggtgaaataccctgcctatttgagcttacaacatttttatttctaatgtaaacgtgtgtatctgtacgtgtattttaatcaataaaatgacagattctcagcttctcgaggactatgccgaaaaacctaaaggataatccaggttacaaatagcacattctgttcagtgaattgggctttcatcccattatcagacaatgccattggttctttaaaattaatcgaggggaatatttcacatgaaagggattacttcttcctatgcaagtcaaaaaattggaaaacaaatgaacatttaaagcctactggagcccagctgtttgccccctgaaaagattatgctattcaatgactggagtgatttaaagaagtagcatgacatttgaattattggctatcaaaaagaacttgtggaggagacttcataaaatgaacttctaagaaataccccttgagaaatggtgctgaactctaggaaaaaaatagaactatttctgtttaactgtaaggacagcttctgtgtttccttaggcaaacagatttcctgtggtctagaaatgtttctgtctaccacagaggtggatttaccgtgaggctaggaagggtgaagcttcagggcccctcacttgcacaagctccttcctaaggcactggaaaaggctcgaggggtgggatggcatgctcctttgcttttagaattttgcatgagtgagacattttaactgcagaagtttaagatcaatgtctacgtactgattttgcctatatcacacttttcccttgggttagttagcactggggtgactgtgggccattttgggatctggctaattagaaactgagttaaagattcatttagtttcagtttggtgtgattatattcttgtggttctcagtctcttccctgtacccttaggttcttgctggctgtctgggtgtagcttccacgaacacacctgattaccatggtgctggtaacatgaaagtgcaagcccagagatcactccaaaatcaatgtgcccagagcttcaggcaccacaagtctgtgtggagtgaaggagacacaatgttcaaaacatataaagccaggaactgctctttgaaaattcttccaaatcttacagttcacaaatgaaagacatttgatagagatatttcccaagtttggtcacagtcctaagaatgtatatgaaatcacccccaaaaattgagaaacttgatgtaacttttctaaactatcggtaataaaatgacagattacaatcaattatactagagaaaagactgcattatcttgttattctcaacatagaaaacataatagaatcatgtaaaatgaagaggcaatcagagaataagcaaccaaaactacagagccaaaaaaatcatagaaatgtatcaagcaattaattttctgaaaatgaagttaattttataaattttgttatccttgtagaatttgtcagctttattaattttataatctggtgtgatttagttttacatcctaaataaatattcaatctccacattcaatacatattccaatgatgtatccatttctcttaaaagggactcctcgagttgtataagacatcagttggtataaagcctggacccactccttgtcaactaccatagtttccctgggatatgaagaggtaacttcctttatattacaactaagtaataaaatggatataaatgtattagccgaactgcaaattgtgatattcagcattttaagggactgattctgttggatactcagaaatataaataggccaaatcctatgaccaataaattaatcaattgataaaacaatgtatctttttcttgattacactaaaaatttaaaatattatattccttatacaacatttttaatttaatttgccttgtaagtgttggtagtatatgcatagttctccagaaatatgtttttaaatatctttatatataaaactgggttttaggtcctcgatttgtggcaaacgttttgaacgcttgtttggcttaaaattcacaaacatataaactagcaatgacatcatgataggctttgtgcatttcttaccaaaagtgataaaatttgtagacaataggccgggtgcggtagctcacacctgtaattccagcactttgggaggccaaggcaggcggatcatgaggtcaggagatcgagaccatcctggctaacatggtgaaaccctgtctctactaaaactacaaaaaattagctgatcatggtggcacgagcctgtagtcccagctactcgagaggctgaggcaggagaatcgcttgaacccgggaggtggaggttgcagtgagccgagatcacgccactgcactccagcctgggtgacagagagagactctatctcaaacaaaaacaaaaaaaaatttgtagacaacatatttaacaagtctgtcatacttgttcagctccataatccttactacaaaatgcacataatctggcatattcacagccttcaagttgaaatggaagctttcatcaagttcatcaaattacacaaatcacacatgacaaaggagagaccacaaagctggtgtacaattgtttaataatttatatgttaatattggtaaactaaagccaaatataaaaatgaaacatatcatcaatgacatcttcagataataaggataagattattattttaaaactgtaaatttagataaactgaggtctgtataattcatggtaatatttcctatctttctctatatattattcatatatgtacattttaaatatatttttgaaattagggatttttcaaagtttttttttttttaattaaaatagtgattttaaatatacctatacctgtttaaatatatctgtaaaatgttcaggttatgacacactttaaataactaaaattcatcttaaaccgtatcttctaccacatcatttacatgtgcaggagataactgcagataagactgaagaaggatggaagctgaaggtttacagagaacaaagtttttgatacttccaactgtgaaaacactttaagtattcagaagaaaaggttgtatcataaaattatatatatgtgttcacatttaaaacctcaatattctataaagatctgaattaaaattaacttagaaagtaattttgtcttatgagatgactgaatggaactattaaacacataacttattcatatgattttatttttatatatctttgcaggaaaaggtatatgtaaaatgaggtagaactaaatcagtgattcttaacccagaatcactacactgtaatagaaatatgaatgtgattccagtggtacatgtaactctaaaattaaatacaaattctctgtgtgattatgtatatatccagagtttccataagagctctgctacatctacttagactcttggatgattccagaactgctaatagagtgaaacacacaaaccttttagaaaataaatttcactaagaagaaaaagaaatgaagttctaattgtgttggtaatgtcccagtcccacccacacatcacgagagagagaaaaagaaattccaagaaggatttgataatttcaaggaacaaagtgctcaggagatatattcactgaccaattccccaagtgctcatgtgtgagcaattcaaaaattctaaaaatactattcagtgacatctcaatagttcttcaaaatatgagattgaaaaacaaggcctttttccaagtcactctcttaaatatggttaacattttcattacacaataattttgaagagtttttgagcctatggataccttagttaccaaaatactatgaatgtgagcttctgtagtcattaaagaataaagatgactaattattaatttaaaggttatgaaaacactcttaaatattaatgactaaacacactaactgataggttgtgtttggactaacactgacagcaagcttcttgtgaagtctgctggtcaagttaccaaatcagaggtgcagaaagacaagaaaattctcaaaaatgcttccacaagaagaatccttgaagtaatttaggcatctaacctcaaaaaaaaaaaaaaataaggtttaatggaggaaattattgctgtattctcttgcattatcaaggctaagaaagattattagaattattttgtatctttctggcaacatgcctcataccaaagggaggaagtggcagggaaacaattcattacaaagaatatttttctaaaaatgagtcctaggcaacaaggaaagagcttgtcttacgagttgatgttctctcccgaaaaggcaattttaagcattgagaatgttctgagatggatttctgcagagtaggaagttggattcttatatataggaaatccctgtcagtacttaaattctacgattctatgatttattaagaatagccacttgtgaccacatagggcacaacctgaaaacagggcagccgcctaagagaaggcccttaaatagttatgagtgaatgcccaatgtgaggtgaagaaagggagaggtcattagaaaggaagttgtgtacaaaacacaagattttactgccttggtgaattttgaaccacagccaaattactttcttctctgagaagatatgaggaagagaataaaactcttcaaggcaacagcatgatataaatccaaagcattttcatactttgggaacgtgcttgcatgcagaagtgtgagccgggggaggaatcttgggtgataagaaaaacacgtcagcagggcagagtggtgaatggccttcaagataaggataagtaattgaaattggttaggaaagcaacagggagccagaagaaggaattgaaatgagtaatgggaagccagaagattagaaaagctagacggattaccttgggaagcaggattttgagatggtaatggccaaaggggagattgtagaatcaagacaggaaacaaaaagacaaggatggatagacctattcccgaaacaggaatagtaccttcatgaggtcccagagaggcagtttgtaataacaaaaatgaggccttcactgaagcttgggagttatataacactgatctaggatggcatgcttacctgtcaccgttgcttggtatccatcaggaaatgtttgttgcatgaatgaagaaaaagacacagttccattctacataaaataatcattcaaaatcaccaatttgggaaacaacaatcaactattagattgttaaaatgttgatagtttgtgaacctttttttttttttttttttttttttttagcaatgacccaatgtcactgtagtgtttcttcagaactgcttagacttttgtgtagaagtaaaagaaaagaccatcagttcttaaggtctgagcctgaaaacaaacgttctttattttgaatttgttttcaatgtacaaaaggtttacatgaaaaatacaggcaggctaatattgcaaacaacatgtaatttcaaagaggaaaaatattcagtactttccctctcactttttaaattagattcagtaacatgattaactcttacctacatgttttcagaactaagatgaataaattagaggggtggttcaatttaaaacaccttttccttttagtaaatctaatgtttatggtagtcaataaaagaattgctcttttagtcatagaaaagcctcagaagctcttctaattcttctattctgttgattgatgcaaattatctctacagggaattaattttaatagttaatgaaatgaggaggctgaagatgcagaaatcagtgccttgagttatctttgtgtgtctgcaagggctaactctgcactctgctgtatagccagcaatgacaagtatcctgaattgactgaggaacaatctgaaaaaaattcacaggaatcttaaaagactcagcagcctttagccaatatccattcttaagtgtgatttaagtgacacttccaagtcttattaaaaaaaataagtaaacataactttaaatacctaagatttctggttagtaacatctaccatgtttaatgttatggtcgattttattgtagcagcttgataaaagatcactacttaataagtaaggtcattctattaccaatttgaaatgttgatttcatatatctatgcactcacttctccataatttgatgtttttgtggttgcctcagaagctgtgcaatagctaaataaagaagaaaaaatgtgactaaccaggcaacagcccagcccaaatgaatgtgttgtagtttttataaagtgctatttgtataaattcattaataaacttttattttataaaaataattgttggccgggcgcggtggctcacgcctgtaatctcagcactttgggaggccgaggtgggcggatcacgaggtcaggagatcgagaccatcctggccaacatagtgaaaccccatctctactaaaaatacaaaaaaattagcctggcgtggtggcaggagcctgtagtcccagctactcgggaggctgaggcaggagaatggcgtgaacccaggaggcggagcttgcagtgagccgagatcgcgccactgcactccagcctgggcaacagagtgagactctgtctcaacaataataataataataataataataataataataataataataataattgctaaatgagagcaaagcttttcaaatcaatagactgtttcattctttctcaacctctaatacagaaaacaaagatcttttatgtcatatttagtgcatgctcaataaatgttctttattttttcttttctttaacaccgagtgaaaaaataattttatctgaccttccttccaaaattttatttggctgacagaatgctaggcttacatagacagggaaggtcacatggagtacttgggtcattcaatatatgaaacttttccgtggaaaatattaataattataattgttgagtgtaataataatccatatcttgacattaaaagaattgctgagttttatgaaaatgattatttcccttccttccttataataactaatggcctaattctaattcttaaaagtatttttggagaagcactagattaggagacagaaagaaagaaaaaaagatagaataaaagaaggaaggattctatccacctggcatttctcagtgtctgctggttccaaaatatagcaccatttgtagtggatgatgtgaagattccccttcaagaatgaaagactcattttcctagattctacaagtgctctcagctgtcagccctctgtaaattgccttagctaaagagcaccattttgttccagcatctactatcaagtgaccaaggatataaaggcctaaccctctcacccgaatttaggacaactctcaagggcatgccagcttcggaactgtctattggctctgctgaggccttcctcaagactgcattgcagaccaacttcttctatctggtcccataattctgccttcttccctcccctccataggtgttggtcccaagaacggtctcatatatgcctcttgctaccccatctcttcttcctcagaggcaatcttcttctcttggaaacctaatctgtgaagcactcactgagaacactgaaagtacaccattagtctctgcctgtggccattcattccttaaaagagtttactattaaaattaagctactgaaaaaatgaaccttagacaaattttcacttctccataattccccttatgtacatctatctcctttgatagaatgccacataagcattcacacatatcagcctagattctttgcttgcccaatatgtttgcgttgtgtgctcaggatgtgtaacaataagcatttggagtacactaagagaatttgtccctgcaaaatatacgaaactttcacagctaatattgatatcaatttaaaatagatatcaatgttaacataattaagaggtgtgcatttcactgtggcttttaaactttccttatgactgtatatttgtttgagagatctcaagactttattgtttactcattctttttcccagaagggcaattataaaaccttgtctcctcaaccattcttcaaatctcaatactttcactaattggagctcaggaaacactcatttcaacactcaattcagatcttattgcatgttttttttttttaattccatcaaggaaactgtcagaaatataaatgcaattaacataggattgacaaacaaaatgctgaattcttttatttagtaagccagtgattctctccatgccaagtaaatatcttagtattgcacagcacataaactgaacttatccaactgtttggttatgcaaaacaaatccattgatatttaataatagtaattaaaatttaagtgtcacattccagaaacatttccatccaaaaaaagacactttatagaaatactaattttttaaactgaaagatatcatccaacatttcaaaactgaaacttgtaaaatacaactattggttaggtctacatagatgcatactgaactgactattcttcaaataatgttagcaaaaaaaaaaatttttttttttttttttagacagagtttcactctgttgccaaggctggagtgcagtggcacaatctctgctcactgcaagctgcacctcccaggttaaagcaattatgccttagcctccagagtagctgggactacaggcgcccgccaccacgcctggctaatttttgtatttttagtagagatggggtttcgccactccctgcccagcaaacaaatgtttttaagggcagtaattttatgtgagactgtaatgtaactaaattcctaagagatcatttgaatccaccgtagtgaaagtgatgtttatacgtagaagtggggtgtggtataaataaacaataagcaggacatagtactctgtaggactggagattcagtgacaagtcaaacaagaaaggaggagagaattcatacttcagaacacttcctattagcaattattgcacataggatttgtcccaattctgcatttgcccagtttattctcagaaaatacttcaaaattatgaaattggaacaattacttcaaatgtatgcttaactataattctaaattaattcattataatatctatttatgagtggggaaggagaaaagagtggaaagggaaagacaggagggaagaaggaagaggaaaagggggaaagaagaagaagggaagagagagaaggggagaggagaagggtgggaggggaggggaaaaagggaggggaggccaggtgtggtggctcacccctataatcctagcactttgggagggtgaggcctgcagatcccttaagcccaggagttcaagcccagcctgcacaacctggtggaacaccgtctctacaaaatatgtaaaaattagccaggcatggtgccatgcacttgtattcccagctactctggaggctgaggtgtgagaatggcttaagcccatgaggcggaggttgcagtgagctgagatactgctactgaactcagcttgggcaacagagccagaccaagtctcaaataaataaataaaatgggaagaggaaagggagcacaggggaggggaggaagggagagggaagaataaaataacaatgacttttatcatctagcgtttttcagtacttgctagttccagactatagtaccatatacaaaagagttgagagttgctcacctattacctgcccctggtcattcatccttgacaaaagcatcagtttactgacagactttgtggtttgaggtactttgttagcacaattgcctcccatcctatctgtaggtgttgatttgtatcaggaaggtcatgactggttcctcccaaactattggtccaataaatgaggaggggccactacttaggaaaattgttctatatttagttttaacacctttatagagatgcaactgaaataccacacaatctgcctgtttaaaatgtacaattcagtgacattagtgcattcacagagttgtgcctccattaacacaatttagaatattttcagtacaccccccaaaccctttgaccctcaatcttcaattccccataccccctccaaccctaggcaatcattaatccactatagacttgtctatagtggacatttcacttaaatggaatcatgaaattatgtcattccggcttctttcatttagcataatgttttcaaggtttatacatgtaatagcatgcattgatactgaattctttattgttgaataatattccattgtatgaatataccacatttgtttatccatcagctgatggctatttggattgtttccactttttggctattaagaataatgttgctgtgaacatttgtctatgtattttcaattcttttgggtatatacctagaagtagaattgctggatcatataactctgtgtttaacaatttgaggaactacaatattctatgttttttttcaaccattgccatatattaaaaaaaaaattctctgaaaaaaaaattaatgccaaattctgtcagtattggttcagtttgcggccacacatcttagaccaaagctcctacttaaaattgtcttagttgtttaatgaattaacactgtaagagcttgatgtgcaaaagagattcgttagctagtctttcttcttgatacaatgttccaaatattgccaataaaaattaacttaattccttgaaggtagaagcacttactgataagttcctcactgcaatacctttagtgtttttttgttgttctggaacttcaatataaaatgtaatgttggaaaagtaatgccactaataaaaatatgcaatattttacatccttgtaattgtttacaacttatcagtaactccaacctgaacatattcacttcacccttagagcagtcatttccaacctgctttattttgctgttattgttgatgagtttgttctgttttgttttattttaggctttagcagccagaagccatggtttttagcttctgtctctgttgataagtggaaaagagggatgaggaaggagcttttctggcccaaccagaaacagaaactaagaacccatgactgtattttctcccttggacacccccaccttagagcatttaagttaaaacttctctaatagaaatgataaaatcaagatttaagcaggctaagcgcttccaaatattaaatagatagttacacagctggctggaacttcatactccaaagttcaagtctagatcacttcaagttatgtctgttctaggagttaaaggaatagtgcccggctatgttcatttgtccagtctctactgtcaccttgcctttttacttcccccctcctcctacacacacaatactcaagtcacatactcaattcatgcatatgcagacacagcaagtgcatacaccacacacacgttttctatataccacagacacagatgtacattcctcatacacaatcacctcacagacacacacatcccacatacagacacctcacacacacttcagtcacaaaaaaactcatgcacaggacattcaaatatacacacatcacacacagacttcacatacacattcacaccttacacacacatacaataaactcacatatatacacactcacagaagggaagaaaagttgtgagtttgcaccaccagattacaacgtattggaccaagttttctagggaggggaagttatgtgacaaggacactcatccaaatctctcttaatcttcctttctccagtgctggccaggtaagtggagtcaagatatgctttcaatcttattagaaaccatctgttaagtccacgtgtcatgtggctgaccagaaagcagttatagccaatgacacagatctgctcttaggggaaagaaagtaggggtccctatctcaaatctaaaccacaggcaggatgcagcataggaggatgtgggcattcctaaccccttagccatattgtcaccactacgtgtgagaactgtaggaagtttcttaaactttgaaacgtcagcatatttattatggtaataatacttattggcaagttaggggaaaaaatcacaagtcttgtatggaattgggtgattctgcagagttgcaattgtgacaaataaattatactttctgagacactcttcagttttagcaattacaatagcaaataattattattcataacagtattaacatagcaaatggtcatattccttatagagatagcatttccaagaagtctttaactttttttctaatttgtcatttcagtctctcagaaaacattgtcttctacaatacctgccttttacagttgtcctaaggcctaagatcaaatacaccacataaaatatgaggcacgtggcaagaattcaataaatggtagctactactactattacagctattttcatcccaaccaaatatatacttggaaatgtaattgcaacacaagatattttgagatattgaaaggacaaatttgaaaaacaaaataaagactactcggaagtgctgtctctataaggaatatgaccatttgctatgttatgaatactgttataaataataattctttgctattttaattgctaaaattgaagattgtctcagaaagtgtaacttgtcacaattgttaacaccattgcaactctgcagaatcatacaattccatacaaggcttgtgattttttcccccatcttgccaataagtagatttttttcatcaccaataaattaaggctatgcctgtgccttactctccaaatcattagagctcaaatgaatctaaatcactgaacagattaaagttttagataaaaaataaatgtcatcatttactttctaaaaataacagcaactctgcatatttccctgtaagcttatagtaattatgccattcatatatactatctaaacatttatatatagtatatacatagaacatgtatacaatctatatactttaactcaatgaggagatattgctaacctattgatatttaattcttgcagaatattattcaataaaatcgcaattcttcttcaaactagttcacacttatgttattagttagctcacaacagcagcttaataaaataaattaaaagatagtaagtctccaaagagtgctaatacattccgcatgttataataaggctttttctgaatcacacttttattgtacaaacactgtttaacatttagcaatccaaatttaatcaatgttttgtgttattcctctgcaaattaacacaactcttatcacagatactgaaatatttgaatttccttattacataaaaattcctgttggctttaacctccctatgtaaacttataaactggtttaagggaaaactgaaataatcctttgctaaattatacttaaggtgaagcttaataaacgcatattaagtagaaagcaacgtaaaaaagaataattacaaatataccatttactgttcgcttactctatgccaggtataaggataacaaatttttaaatatatcttatttaatcctttaaaaaagcatgatagtgatattattttctgcaacttatagattaaaaaaaaaccatgaatctctgagtatattatttactaaagtctcacacctagaaagtgttgatcctgggttgctgaattaaaaccctcaagtctggaaactctattccatctacctaagaacccaaaatggagagccagattttttttttttttgagacggagtctcgctctgtcaccccagctggagtgcagtggcacgatgtcggctcactgcaagctctgccttctgggttcacgccattctcctgcctcagcctctggagtagctgggactgcaggcgcccgccactgcgcccagctaattttttgtatttttagtagagatggggtttcaccgtgtcagccaggatggtctcgatctcctgacctggtgatccgcctgcctcggcctcccaaagtgctggaattacaggcgtggaaagccagattttaaaatgagcaattgggtgtttgatgttgcccaaaggactccagcagtcaacaaatatacattgccaatgccaaagatattcctttattgcatggtttaaaaagttggttgagatctttataaataaaaaagtgtgtgtgagtgttcgtgtgtgtgtgtgtgtgtttcaagaaaagtttcagccaagcaggtggctcacatctgtaatgccaatgctttaggaggctgaggtgggagaatcacttgatcccaggggtttgagggtacggtgagctatgactgcaccactgcactccagtctgggcaacagagtgcctctgtctctctaaaacataaaagaaattttaatgcaacttaaatttttaaggtcaagccttctctgtacaatgaaaacctatgcaatccaaggagattttcaccgtcaaaggagatccttatactgggaagggatatgttgaatcagtaaataaaagcaacttttgcagatttgcaacaaatgcctaatgggagaatttgcttagaatgaatcacttgggtgggtgaacaaacttactggttctgcatcagcaaacatagagtaaatagtgtcttaattttctttccaaagaccagaagaattttgaaaagaaaaataaaaccctaaaatattgttatgtcacacaagaagtggaagtaaacaggcagaaaaaacttctaaagctaagcacttaggaactgagtgttagtaaagagaaacaaccaactgcattttggtttcctctgtaagctagctgagtggagaaaactgtgaagaaaatgaaaatcacaactgataagtgcttttcttctcaaggtgtggcctccaggcctttccgataattatgtcataagaagagattaggagtcttcgtaggtaagaagtcttaaggacagtctattcaaaaatgtttttcatttggtactctgttacagctatctcctttctctgacagtgtccagctacagtaacatctatatcaaactgcctaaagaattttagcaatattttgataactcatctatcataatgttcccttgcccagccatcaaagggcaatccttctgctacagtgtgcacgaaatggtctgaaccacaccacacatccttgagctctgaatgcatcaagataccagcagttagaagattcctattctctgacaactctctcataacaaacttgatttattaaaaaataaatattgaagtaggccgggcatggtagctcatgcctgcaatcttaccacttggggaggccgagatgggtggattgcttgaactcaggagtttgagactcacctgggcaacatggcgaggccccatctctactgaaaatgcaaaaattagtcaagtgtggtggcatacacctgtagactcagctactcacgaggctaaggtacaagaatcacttgaacccagaaggcagaggctggctgcattgagtcaagataatagcactgcactccagcctgggcaacagagtctcactctgtcgccaaaataaataaataaataaataaataaatattgaattagtaacttttgcatttcatcccttggtaatacatatttcttctgaaggtaatagtattttattctaatgaactctttctgccccatgtttagtaagcagagctcatttgtaaccatttgggcttcagacaaaaagcttttctaagttttgtttttatgaaaccaatatttaaaaccacttccttttatttattttttctctctcaaaaacaaatgtccatgaggcttcattatttttttcctcccttttctaatttcttctttttgaaagtaatttattttctaaaattgaagagccacctgactacagttactttagggtaactgaatgtggttgtgcttttgccttttaaagagttagttctgactacattcatataaggctttgttttcaaggatgtctggaattcaaacccctgggactgagaatatcacccaggaaaaaaagatgccaaattgaactaaaaggctactttacaattttgacctgtggattttatttaatgagggacaatcaacaaggctaagtaaaatagttcctggaatatgtctgacagtcatatgaataggataaaagctgctgaaacagtgctcaaagcaagttatcaccaattctgaattctgaatattgcacctaaattcacaacgataatagctatttttaaaaataccactcattatgtcttcaaactctaatctaccactcttagatcataatgccaagagtaacccctactggccagtctattttatggctaatgctgaaaggatacaggagaaagggtggttttactgatatatttataatcccaggagcagtttgccagcactgcattttcatgataatattatatatatatatatatatatattttgtcatctagctcctccagtgatactcctgaagatttaacatactttacttttacaaagttttaataactataaacatgttgaacattttaaatttctggcaatataaataatatttctaaatcaacagataaaaggaattctgctcactttaaatagcttttccttagtattactttctgaagagggcaaattatcaaatgatgtttaaaaactccattacctgctccaagttaaggggcgagacagggcacagaatgaatacagtgggggtgtgtcattaggatgctaatttacacaacaaaaattaatgacagataaagtcagcagcatgttgacatgtccagcccacatgccctacattttgtctacttacaaagtgacatatgactctagatgtttgcataagcaacatggagattcccttcattattgcatgtttaggttgctagtaattgagtcatactcctgagctaaattaggtaaataaacttgtgtataaggaagttaccatgcaatcctattaattttccatatcaagatatccaggaataaagcagaacttagacagattctagaaaaaatcacacatagggcaacattctcacttcttcctggcccactgcatctcttgcattctttatgggtttgtaaaaatcaggttaaaataaactaagtgtagttcatttcacacaggaaagaaagtataaatgagcattgtaggccaggataaagctgtggctggggataggcattctgtcctgtttgcctggggtgctaattttatgaacattatatgctattatagactatattattgttctcaacaattcactcttttgccacttgaatgttcaggcgttctgggaggggggatatattgctgagacccattgtctggttagccacaaacttgcttgggctaatggaatgtgagtggagatgacagtctgtcattttagatcaaaggctttaagaagcattacgtgcttcccccagcctcttgctctttaccctgggccacagttccgttgtcagagttccaaccagctgtactctgggcaaggttgagccatttcctctactttcttctaatggatggaatggtctaacccattgaattgacaggaaaacaagaaaatactttggctggaaagaaactcttacaagagctcaggctaaaccctaaggaattcagacttctctttgaaaatcttatttgtcaatggtcacaattcaggagaaaggacaaggtatactgcaacacctgggcctcatttttgctgacaatggagcagatggagtgattatctgtaaccttatttgcactgaccctgaatatctgttgtttgtcaaaaccatttgaatccttttagtttcagtttcccacacgtataatcttattactcataaagtttactctaaagcaaggtttaaaatgaaatctcatgagaattaaacatcatttgtacacttagattgccattcttaaaaaagttacataaattcagcagaaagaaagcactattttaagaaaaccaccttatcctctccttttaattgcttctaagaaactgggcaaaccaccctcaatgaaaataatttgaataataacatatccgttctcttatattttaattttataatattccatatgtgaaacaatggggtaaatattgaagatgagagtgggtgagagtcctagattccagaaagataacttttacttctgctatttattattaattttcttcctttcaaaatagagttttgtaaattgcagctatttctaattctactcaaacctttgacaaagaaggagatgtatacacaaacacattaaagaaaaaaataaatggttacattttaagttggaaaatattattccactttaaatatatcctaagtttaaagaaagtatttattgtgagccaaggcttcacattaaattttgcaatttgtctccttaatacttctagaacaaaagttaattatttcttaaccacttacataggaaataagatttagaaattactcaactcacttatttctgctgatatttttctttgttttttttttcctttgagatggagtctcactctgtctccaaggctggagtacattggcgtgatcttgcctcactgcgacctctgcctcctgggttcatgcaactctcctgcctcagcctccagagtagctgggattacaggtgcctgccaccacacctggctaatttttgtattttttttttcagtagagatggggtgtcactgtgttggccaggctggtctcaaactcctgacttcaggtgatccgcttgcctcagcctcccaaagttctgggataacaggcatgagccatcgtgcccagcctctgttgatatttttcaaatagaaaatcaattttaagtttttctttatcatatgaagcaaatattaaataatcattttatttagtctgatgcttgcttgattatattgtgatatttctaataatctattagattttataataacaattataataattgtttctaagcaaatgaactattttactgtatgttcaacctcctacagaacgctgtataattttctaaataatggaatctatgcagcagcgggatctatttataaattcactgcattttcagtgtcattattgggatatattcctgagtaactgctgtggagacagaaagtatcaaaatatacagcagaaatttgaaccatataaagcctgatgggcctgacaaaggttaacagaataacataacattcagctctactccttttctcaccctcgtctcatctcaaaatatatgcaggaaatgcctcctttttcaacctccttcgcattctgaagagaatgtagaactttgttttaaaattgaagccaatgtaaccaacatttgcctatttttaaaaagctcttccttcattctgattggctttagaaacaggcctaatattgacaagaaatttatagagttagtgagagttttcatgctaatatcaacattttattcttttttgctcactcagttcccaaagatggatgtatacaaatgctgtagaacttcatacatgctttcctacaccttcatttcctcctcctcaaaagattaataagctctgtttattgacgtttttgtggtaagagtgatgtaaatatctcaagccatataatcaagttgtcatgttggtctaggcacctacaatacaactagatctgtgatttaccaaggtgctatgtatgaatatatttattttgacaaacacaaatcagttaatattttgacaagtatattttgataagtataaatcactgaataacagctttcatatatattatttcattttaggtttcagaagtagtcaacagttgattcatgaactgcttgccttgcttgtagaaaatttagcagacaggagaaagaagaaagaaaaataaataggcaaatcccagactcattcctgccataatggtttcattttgcctgttttatatatcagagttttgtgaaaaatttcattcataaagagaggttttctgattttttaaaagataaaatttgaaaatgtctagcagagagctcagtgcctaaatctcagaaaatatttaaggacagagagaaaacatgaaaaacataaatagtatctgcaaataaggttgataagtctaacctttctatacttaaaagaaattcagcttcttaaatggcagagaaaattctgtatgccagattacaatgaatatattctcgtcattatcattatctttagatacttccagttttctgtggatagactttgtaaaatgccatctatctccaaaaagaatgttactaacacccaaggaaaaacaagtttgtagagtcatacatctaattaccaatataacgtaatgattcttttcattatcatgaccctctgcccctctgtagtgacatgtccccctgaaatttgacccaaatagttcatacaaataaagttgcaatgtctccagtcagacatgaactgattgtcttcctagggtctcctggggtagcaacagtcaatttgccacagcagaaacttgagtatgcacattgagttccctccaggtattttggcaagcaaagtttaaaagcaaccatgaccttgtcaccaatactaatggacagacttcagacttctctgctttatgttagcatagttgctggagtaaggttacaatgttctgaggactattattgatcctgacattccaaacaactgtgagttgatggagtaattatcttatattcctgtgaacagactttttctgcctcaggtcactgaaccatttttatttttcccaacataaaatttctatccaaaaagtgatctaatccacctgaggaaaaagactataacttcatcacattcagaataatctctcctcaggtcctctaccaaaatgttatgattgctttaatttccatattgcccatgtacagaagccaacaattattgcagcataacttagagagtacaaataagctgaaatgaccagctatgatctgaacattggcaccctcccaaaattcaaatgttgaaatctaatcaccaatgcaatagtgttaggaggtagggcctttgggaggtaattaggtcattaggcctccagccttgtgaacaggattaatgcacatattaaagaggccccttcttccaagttatagctcccttgccccttcttccaagtgaggacacagcaagaagacaccattaatgaaccagaaacctggccctcaccagacaccaaatctgtagcatgctgactttggactccccagcctccagcactatgagaaataaatttctattgtttataagctacccagttttttgtttgtttttgagacagagtctccctctgtcggccaggctggagtgcagtgggacaatctctgctcactgcaagctctgcctcctgggttcaagcgattctcctgcctcagactcccgagtagctgggactacaggcatgcgccaccatgcccggctaattattgtatttttagtagagatggggtttcgccatgttgcccaggctggtctcgaactcctgacctcaggtgatccaccggcctcggccttccaaagtgctgagattacagccgtgaaccactgtgcccagccatgctacagagtttatgatattttattgtaacagtccaaatggactaagacatgacctaccttactatcagtgccaaaaagactaattctaccattccctgggatctgaagataatttaattgtcctttctctaaaaataatagtaacaaccaacaaacaaaaaatctccaaaagtttattttagaaaaaaggtctaaggaattctatatagttcttgataatttattaaacatagtcacaaatcttttggaatttttcagcaagcaataaagtgtccctgcctaagcaggtttttaaaagctattccaaggagaagccatacagttccgtcactgcatttggatgctgttgctgtgcactttattcataggaatgcatagcgtggcttactggtactgaaaaagactgctgaatggcagattttaaaaagagtaagcaactgaattgtaaaaggtcctagcaatgatagattccacaacccgttagaaatttgcccctacaaccctcctgacttctgaattccaagaagaatgaaagtgatggcttataattagcatgattgtgttaggggcatgacagatgctgtcggccagccttgatgtcagagtaaaatctgtttcctcattcatagtccagctcttttttcacatgatggactgcagcaccctctttctgattacaggcactaggcttcattgcatgttgtaaacatatataaggcagagcctaggtgcatgcagatgataatgtgtcagtctgggtcaagtgacagcttaggaaatgtcaaaatgaacaacaaaaacagagtaattctatgaaatggacaatgtgggtggatattacatttcaatattattaatgtctaactcaaaaatttgatttgccaactgaagtccatttagcaaaacatacacattgtcagttagcctgagaattttcactaggcttaccccacttccctcctagaatttttttttgggggggaggttctgaaggcattatttttattgtgttgtgttgtgttttgctgtgttgcgttgcattgcattgcattgcattacattttttgagacagagtctcactctgtcgctcaggctagaatgcagtggtgggatcatggctcactgcagccttgacctcctgggctcaattgatcctcccacctcagcctccagaatatctgggactacaggtgcacaccattactttgcttccaagttagacataactacttgcatggtctgcttgtactcaaactcagcaaatcacacccagcatctcctcccaatttagcatcttctcatgatttccctatttctgttcctggatcattattctcccagtcattcagacccgaacctgagaatcatcttagatgtctcactctttttcaagcgccatattagtttgtgtaatatggtatcaaaactttgaaatttctgtagcatctgtccctgagtctttccatatctatagtcatcaaacttagctccacattaccccttgctgagtctaacccactagtcttatatttcttagatcacacatccagtctatgttcccacgaaaccattcaagatggatcttcctgcggcattccatcaacatctgcctgctaattctcttcatcctgtacctgagcttagcagctcactggcattttctccaagttgtaccatacttcctgtttttttgcccttgtccagtattctttcctctgtcttcaatttttctgtttatacttctgtggaaatcctatccatccttaaaccttaaaatgtggagagtgtgtccttaagactgcatataatgactatagcagttcaagtctctttgatgttgactaactgatattgaggaaatatgtcaattctgtgggattcaggtactcctctgtaattgggagtaaagggagaagaggataatactttccctgcctctgtcatatctatcatagaataattaaaatgagcaaaaactttaaatgagatgaatatgtaaaagcaagagtaaaagctaacatgctatgcacagtagaaagccttactatgatcatcctctttactgttacatattcaccacatgcagatgaggcttcctcctgggattccacttattttcatcactattatggtcaatactatgacttatctttcagaattagttagcaggtatggtggctcatgcctgtaactccagaactttgggaggccaaggctggaggattggttgagttcaaaagttcaagaccagcctgagcaacatagtgagatcttttctctacaaaatttaaaacaatagctagacatggtggcccatgcctgtagtcccagctactcagaggctgaggcaggaggatcacttcggtccaggagtttggggctgcagtgagccatgattgcaccactgcactccagcctggacagagtccagagtgagaccctgcctcaagaaaaaaaagaagaagaagaagaaagaagaagaagaagaagaaagaagaaagaagaagaagaaagaagaagaagaagaaagaagaagaagaaagaagaagaagaagaagaagaagaagaggaagaggaagaggaagaagaagaagaagaagaagaagaagaagaagaagaagaagaagaagaagaagaagaagaagaagaagaagaagaaagaaagaaagaattagttcactgacttaaaaacaggcctactgagggtcacagattcttttggaatatacatgcatatttggaggacagaatcacaaactgtttgacacattcagttaggttatgaagaaaataaaaggctttggttgtaatatgatcagatggctagttccctttattctttatttttgagatggagtttcgctcttgttgctcaggctggagtgcaatggcacgatcttggctcactgcaacctctgctcaccacaacctccacctcccaggttcaagcaattctcctgcctcagcctcccaaaagtagctgggattacaggcatctgccaccacacccggctaattttgtatttttggtagatacatggttctccatgttggtcatgctggtctcaaactcccgacctcaggttatctgtccgcctcggcctcccaaaatgctgggattacaggcatgagtcaccgtgcccggccttagttccctctattctaatgtaaataaatactctaaataaatgtataattcaaaataaatatttacataaatattgacagatgaagtgctttttgactcatgctgaagttaactagctgccccttgaaaaattagttttctccattaaattattaaaatttaactaattctggagtttttctatggcatgctggacataataggaaccatggacttgctgagagtcctagtctaggagatttccttccagcacctgaaatacttcatgggagaccacagttttcattccatattttgatgttacaatatgaaccataaaaactttcttctatttctattttttactttttgcaagactaaagacaccccccccaatagtccagaattttattcctactttcttcctttttcacttgagaatgtagaaacaataaataactcaaatctacattttatcagtcagtgccaccatttaaaacacagcattttgggcatgatttcatttaaccccttaattgtatagttatgattccataacactgcacactgtctattccttaaaattttcttaagttttactttcacattatgcaaaattaattaatgctccactctgtggactctatgccaccacaccactatcaatgaattcagaagaggcagtgggagtgttgatagaatgtaacatagcattatggtagagtacagactagattacttgtttctcagttttctcctctaaaatatggaaataataataatatatctaattcagagtttttgtgaagattaattggtttaatacatataaaatgtttagagtagagcctgacacacaagtactctgtaagtatcatctattattgttttgttattaataaaggactccattatttcacaaggtaggttaagcatcattaatctgaaaatccaaaatgcaaaatgttccacaatccaaaactttttgagtgctgacatgatgtcacaggtggaaaattccacacctgacctcatgtgacaagtcatagtcaaaacacagccaaaactttgtttcacgtacgaaagcattttaaaatattgtatacaattattttcagcctatgtttataaggtatatacgaaacataaataaattttgtgtttagatgaaggtcttatccccaagatatctcactatgtgtatgcatgtattccaaaatccaaaaaaaaaattcaaaggttgaaacacttctggtcccaggcatttacaataagagatattcaacctgtatatgttaaacatatactaattcttaaattttttgagagaaatgtaattataataaagtggaaaaaactatatcaggtatgagtattaatattttggtttaattactgcaatgatcaacatagctactttaattattattctcatgagagtttttactttttttttttaaatagatggcggtcttgctgtgttacccaggctggccttgaactctgggttcaaatgatcctcctgcctcagcatcccaagtagttgggataacaggtatgcactattacaaccagcccatgctaatgagaattttaatgcatatacacacaacatatacccacacactttcaacacacattttcattatacagagtgtttccataggtagagtagaatgagatatgagttctggttatttagcctggcaactgcagcagagtcaaatactgttagtgtatctatcctggttcatgtcctgttatcaatacaagaggcaaagtataaatggagatcaggtttccatctggttacaactaacagcatagccttgattgcctgctttgagttaggggatcaaaggaagaaatcatcagagatccaaatagcaactcaggcaggcagatcgccatttgaaaaaaaatagtaacttctctaccttaaggaaggataactcctgtttggctagcttgattcctttctaattataaaaataagcttggggtgagtagcaggggataaaaatacaaagtatcatataggagttaataaagaaaacaatcatgataattatctttctaaacagtaaagagaaaccaagtatttcttcatattagaaatataatacaattttacagccaggcatgacgactcacacctgtaatcccaacacttcgggagatggaggcagaaggactacttgagcccaagaattcaagaccagcctgggtaacatgtccaaaccccttctctacaaaaaatacaaaaatgagacaggtgtggtggtgtgagcccgtagtcccagctatttgagaggctgaggtgggaggatcactggagcccagcaagtagaggctgcaggagccatgatcataccactccactccagcctgggtgacaaagggagaccctgtctcaaggaaaaaaaaaaaaaaagtaaagaaataatttttttcaaagaaaccctttacattaaaagcactacttatgatggaatctttaggaaatgctagaattccttgtccctagatttttttctaaaggattaaaatcttcattttctaggagaactgacatttaaatgtatgattcctaaactcaagatttttaaaagatctgagttgctcgataactctatagcacactcttgaagatgagatattcatggaccctccctaaatcttggaaagtcttcaggctaacggcagggctggagctaaagttgaggcagaacctcatttctgccagtaacagcatgcctagccaggattaaaaaatttgccaagaccacacagaaagagactagatggtaagttggatttatacttctctttgcaactgaaggccattctgaactcctgcctaaagttggagaaagtgaagagaggccaaatccagaaaccattagggctcagagataattattatggaaaaccaacaagcatgtacctaatgattccccagagtcactcctagagcaaggaatgaaatgaaaaagtttatatcacccacaaaacaaagattcaatgcagtcaatgaaccaaagaagaaaaattcagctctgaaatgtgataataacctgatattcctcctcaaatctctggatatttggttacattataatttgcttgatgcacgtattcttaaaataccaacactcaattaaattcatcacctaagaaacatggtcattagtaattatttttgcataatctcttttcatttttattactgcaaattttttgtttctaagtccacaaaaggaaacttcaacttgatgtaatacaaaaagtccagagtgtatcacaaattaatttatctagaatgtaatcaccatatagaaaaaatgatgcatatgatcttaaaattgcatccaggtttaaagttctataaaaaagataaagggaaggatgttactattctgagctgatgatgtcttaccatcccaaactgtaaccattgaacatacacatttattgacaaactgctttgaaatcataacaagatgtctcacaaatgtattgtgttttgatgcactagtgtcttagctgtatgaaacagctacatccatgtttttccatctataaaaagggcaatgaaaagatatcctttgagtcacttttaactcaactttctaagtgtctccaattttataaacatgaatcatactcctataaagaagtcttccactccaccttcacgagtgtatatctttgatcaggaagtttaaatggacactctatatgcatccttgtgcttttggggatctgacaatcctttttttgatggaacagtaaatggcccaactgtttgcctaagactaggcagaatgcaatttatcttcttggtttgcagaaaatggctatgtaaactttaccacatttgccagtatttccattccttaagacatagctcattgactaggacccagttttccaagcaagtataagatgtttccttgttactagtatgtttttggaaagcaaaagagaccttccgaattacctcttagaggcatgcttcacttttgtcctcagtaatgattatttcaatatactgtttacaaacccaatcgttactccctttttgaatgcaaagtaacacgtgctaattgttgttttgatgatattagtgaatcaaaaccttatgggaaatacaattgtctcatcttccaggtttctatgtgaaatactcagaactgcacttgcaaattcctgagcagcttcattctaagggaagcatggcgccatctagtgatcatacagaaaattacatttatgcattttctctcaaagctctgtattaaaatgatgagttggcccatacattagaattgaaagaagagaaatagaataaaaattcctagaaactttacctagttatttgctatatgcaccatcctgcatggtcattattaaacatatatgggttataacaataataatatgacattgtccctctcttggggtcacttttttaacttcaacttaccattggtttagtcatgtagtttccgaaataaatatcttcacatggaacatttaattccaatgaactatatttttggttcattaaaagttaatgaagtttttgaaacaattccaaatgatctgtaaaatatatttacttaaaaatgcttcattttatttctctagtgatgccctgctaggatgctacctaaattgttaaatatttaaaaacacagaggaaaaagtaagataaaataaatagcatactatttagagattaacctattccttaatatggaaaattattcctcattgtcagaataaaacatattattgtatttctagtttaaggataatattgtacagatatcaataggataagatatgcttgcctaagccggaatagatgcccactctgtcccagcagggtttttccagttttaccctgtggaaagttctatgaagacaaggaccatgtctgatgcatcttttcatctccatacgccactactcacccaaccctcgcccccaccagcacaatgcctagcatgtcataggaactcaggatgtttcttcaatgaaccaataaattaatttattatgtctgtctctaaaatcattatttagagtctatctaccacaggaaacagcttttcacttttctattgtatgattctctgctccttttctgagatactctctctacaagtggcaccttatttgatattcacactgccacctcctaaattctttaaaatcttgagtatccatgtccaaatggctttctttccatgagttatccatcttacagaaagggcattattcatcaacacatcatttgatgaaataaatccaaaagggtggaaatgagaaactcttatttcttactcttttcaataggtagtattaatattctgtaacaaggagatttcaatagtgtaacacataagatattactcacaatttgaaacaggtgcttttggcattataggcacttggccacaatgcatagtttaatatttgtgtggctcaaaacagctaacttatcttgaaatgttgcagaggaaacttccttaatcacattcttactgtccagtgactgaggtaaatcatggcatacatgcgtcattatgaatcacatactatctatacctacacttcaactacctgtaactagattttcactatacggtgtaatgagtttcagtgagaacattcagataacccattcctcaagtaaatattccaaaagcattttatttcactgtagagaaaatttagaaaaagtagatttctccttctctagtattgctgaattgtgattcaaatctataatacacagtaaacgtctcagaatactactacttttgaagtacaaagattgccacgatgtagaatagaatggctttttgtttttaaccaacatccccatcagtacattcaactcagccttgcaactcccactcataatgtcacaactgtttgtccctaagctaattaagtgtgtctgcgagctgtagcgtgagttatgaagttatcatttctccacactttatagctgtttgaaggatatgaaatggcaatggacaaacagtcatgatatttttggcaaaatatcaaatgtttttgatggaaagtgaaagggctttggagccctctgacctgggttcaaatcctaactcttctactttatagcctgagcaagttactgaacttaagtttctttatgtgaatgtggagatgctcttggacccaaagttctaattttggcacatacctatctttaaaaacaataataattttaaaagtaattttgaaatgtgttggtgaaaaacgtaggcttttttgaaaaagggtctctcactctgtcacccaggctggagtgcagtggcgcaatcctggcttactgtagtctcgacctcccaggctcaagagatcctcccacctcagcctcccaagtagcagggactacaggcacgtgccacaacacctggataatttttttgtattttcagtagagacagggtctcactatgttgccctggctgatctcaaaatcctgggctccaattatccttccacctcagccgcccaaagtgctgggattacaggcatgagccaccacactcaaccaaaaaatatagtgttaagagatcacactgtgacctataacatttatatatttagaacacctttggagctaactgagattagggatcaagatatatgtatatgtatatacacacacacacacacacacatttaataacacaagcatgcacttttgtgaaatagaatacgtaagttctaagcaaggagagtgcaaactgcatttatttttcaaaaacaagaaaaatacagtcataagaggttttaagtaactagttttaatcaatccatatggttgcatacttagagttttcttagaaatacattttacatttagcattgaccttggtatgtctaatattttctaggtatttttcacatatttctaagggctaaaaatatttattcatttatactttcattcagtcaatagatatttattaacagctttctcttatccaagcacatgtttgggaacagtcaacttttgttttatgatacagattaaaccaaagggacatattaatttgtgatcaactaataaaccaacagagagcttctaaaagctgaaggattttctaattttacagagcataaagaaccattttattcattttaaatctcaaactatgctgtgtttcataaggaaatcaaaggatatataaggtgtatacacttaggtacacatatatttttagatattttttaaattgatacataataattgtacgtagggatgtttcaatacatacaatgcatagtgatcagatcagggtattagcatatgttccaacatttttcatttctttgggactattcaatatcctctaagtatttgaaaatatataatatatcgttgttaactatagtcatactatagtgctatagaacactaccacttaattcctcctatctagctgtcatttcgtattcttaacaaatatttctctatcctccccttctccctactgtttccagcctctagtaatctctgttctcctttttacttccatgagatcaactttttctagcttacattttttgagtgagaaagcagtagaaaagaaaatgtggatggctttaaaaggaaaaaaagagaaaaaacagccctatctccaaatactccaatcttgtgaattgaaaaaaaaaagttgagatctttttttttaatcagttgctatctatttgtatatatacccacagaaaaccatagttaaaatgtaggcattataattctaagacatatgtacagaaaggcaaatgctggggggaacatattaaaatgtttctctgacattttgcagtcttacacagtgatttaatttatacgccatccatatattagtgatctggactctcttgatccaccaaaaagcaccctacttagcatttatctagtgttttctaagtagacgtttaaggctctttttaattaatcattttattaactcttgtcacactaatagagacagcaaccaacctgaaccatctagggcagatgagcaatggagatacacagaaagctaagttgcactgaaaataattttttgagaaagaacaacgggagctgtggagttctccaaatcataagttataaagctcagttaaattacttttttgtacaatgtagacagaaatgacaaaatggcagttctatatgcctgtaaaactcaaactgaccaaacactgacacttggtaacagcaggatgtgtactgatgttactataatgatgtttagcagaagagttgaaaatagaaagggtttccgaatcagcccagcaccaaccaagtaatccagggatccagatcattccaatacccagtgagttgtcccctttggcccctcctaggtgtgacccatccaagagaagcattgtatttccctagtctacattgttcccactttgacacagcctatcatatacttctctgtaagtttatgattatctcctccattaaatttttaattcttggggaccaaaaatctcatttctctttgtatgttcaagtgctattaagcacataagtactgaacaaatgctaaatcaacaaataaataatcccatgattacttaaaactgaggtgcctgcacaaatcagcaaggcactaaaatgataaactcatcctctaacaattgatcaaataccttaaactcagtctcaaaaagagtaaaaaaaaatgtcttggcttgctttcaagaaatgagcaatgttaaatcaaattcttgctagattattttcatggtaatagtttttcacaacttcttattgtaaaagtaacaacattatttcaaaatttaattaaggtataaataaatataaatacaaggagataaagaatatttataatcctattactcagagttggtttcatactttagcccatatacttaaaaatgtgtaaagaattacattatgtgtagttttgtgacaaatttcaatgctaatatctctatcattaaaaaaaatatggaagtaccacaatttagtctgttttagttttttgtttgtttttgagatgtagtctggctctgtcacccaggctggagtgcagtggcaccatttcggctcactgcaacctctacctctggggttcaagcacttctcctgcctcaggcgcctgagtagctgggattataggcacctgccacagtgcctggatatttctgtatttttagtagagatggagtttcaccatgttggtcaggctggtcttaaatttctgacctcaagtgatccgccttggcctcccaaagtgctgggattacaggtgtgagccaccgcacctggcctgttttaaacaccaaccctccctagtcctttactattatcaactcattgacggtcaaaatacataaaataatctttgcctacttcttgttacttgaggataaatgtctacaagaggcattgttatatgcatattttgacatggagtgttaccattgtaactgtacaaaatttacaatctctcaagtaatatatgtgtgcctgtttctttacccctttcctagactgagcattaccaatctttctatttctagtaaattgtcaaattaatctcagagaagacttagagacagtcttattcacttagtttattttctctcatgtggcaaaaggcaattataataaaagtcaacgtttacttttaactcatgatatgtattacacaatcggcctctcataataactcaatccttatttttataactctgcaatcaggaaggaacaataaaatttaattccaatattgctaaacctaggataattttgtagactagagtgtctaagtgtcatagtaacaatggctgaaagaaaagatgtttttccataccaactgaaatatatggattatcttggtacaacaaaactcttctaaatttattttattttattagttttggccacatgagaaacagcaagaaattccactgctagtcctccaaataggtaatcagatatatctgtggttatcttccctccataaacatttcctagtgattttgttaactataattctgtaatacaaaccctttgggtaatactcctatagacatcccacaatatatgcactccacacaaagagataaatgacagttatcttctgtaatcaagctcctgccaacttaaggtaagtaatgtatgagaaagataacctaatggcaaggctggcaagtcattctactatgtgtactaagctctttctcaacatcaagtaaccagacttaacaatgatttaaattactatatgaagactttcatggaataatgatttaatattttgacttataacaagactaagtataagaacatcactatttattcatgattaataatgtacatgtatgtaactcacataaaaatactattaaacatattattgctttactttacacaaagaccctaatgaaaagtcttataattaattatagaaagataattttctctcaagacataaatattatcaggtttctctatttgctgtatctttgaggaagctattaatattttaagacctaaacttaactccaagtacgaaatacacttttacatttgtgtttctaacttagctttacataggcattttatccatttttaaagttaggattgcttaattccttttttgaaacaaaaagcataaaaaatacataattaatggcattgcttttatacccaacttttattatctacaataaagatgtgatcatgtacaaataaccagatatgaagagccacaaacccacatatgcatttggaatttactcagaactatgtttgaaaatactcatgcactaacatttgtcccgttgtttccagattatcctgaagtttggtccaagacaaacttgttcagattttctgatttagatcacagctctatactctaggaaaacatggatacctacacctcagttaactgagtcttaaatggtgctagagatttcttattattaaggaaaggaaattattagttgatattttaaacatagaaacagaaaatatcattccagattaatcgattcaactctagatgaaaacaaatttatatattaaaacaaattaactgatccatatttaaaataagtaacagaaccgtgaagtgagtggaagtggctgtgagaaaagaactaaccaagtgaattttgagtacagaattaggcatataaaacataaataatgctaaaagtctacttactgaaatacttttctttgccttacttctctttttccatagaggcgtgagtgggtaattctgaaagtaatttttgaaaccacattccacaggtaagaaaatcctatgcaatatataatatattgtgaataatgggagccaggcttctcaccgtaacttctcacagagttacagatacgaaaatggagaagaacagaatgagcactgcaatgatggattatcattgtgaaatcctaggtttaatgtatacaaatatctgaatatacccatggatataggtatgtgtgggtatgcatatatatgcacacatttatatatgagtatgtacatacatacactttccccctagatatgtctactaaaaggacctagaagcaaaagcacacctactctccaaattttgatttctaaaaaccattctttactgaaaggaaacagagagccctataaaagtagctgattccaaggcttggataaaagaacaagagtctcatatctaaaaccaaaaagtaaaaaagtactcaaagaatgatagtaacgtgttaaaatgacaagggagtcaactagaagtaccttgtactgtccaaatccaggacagtatgaggattaagataaataatgatattaaccaacaatattaaaggataacaacctgctaaataaagaattcatgactccacacagaaacaagcacgaagaaacatttttatgcataatagaaagccaactaataaaagaggaagaaatgatgaaattacaagatttccccttagcaaaccactatggtttgaatatgtctcccaaagttcacatcttggaagcttagaccaaaacgcaacagtgttaagagttgggacatttaagagatgattagatcatgagagcattcccttcatgaatggattactttatctgttatcataggagtaggttccttataaaagaatgagtttgggccaggtgcggtggctaaggcctgtaatcccagcactttgggaggctaaggtgggtggctcacgaggtcagcagatggagaccgtcctggctaacacggtgaaaccccgtctctactaaacaaaatacaaaaaattagccgggcgtggtggtgggtgcctgtagtcccagctactcgggaaactgaggcaggagaatggcgaacccgggaggtggaggttgcagtgagccgaggcggagtcactgcactccagcctgggtgacagagcgagactctgtctcaaaaaaaaaaaaaaaaaaaatgagtttggcccccttctccctatttcttgcccatgtgatacctttcatcatgtcatgatgcagcaggaaaaaggactgcaccagatgcagccccttgatcctgaacttctcagcctccagaaccatgagccaaataaattctattcattataaattacccagtttgtggtatctgttacagcagcattaaaccaatgaaaacagcaaccatcataataacacaagtaactgatttagacaggaatcaccaacggattccaaagctattgggtaagaaattgaggaataacagcatatttacatgctctcatattatcatggtacaaaatgctttttaattacaaaggaggaaaatagtaactttacagtggagaaatctggtaggcaccacttgaactaaatgatcaaagctaaatttgtcagtaatggtactaaacaacagcatctacctctggatataaggagttagcatccctactgtgatattcctgcccaagttgtatgacctgactatcatccccaggaaacacaaaataaactcaaattgaaagatagtctatgctttagactgaatgtttacgttgcctccaaattcatatgttgaaacttaatcagcaatatgatggtatttacaggtgtggccttttggaagtgatgagattatggggacagagccctcatgaatgggattaatgcccttataaaagagaccccagagaactctctcttcctttctgccatgtaaaaacacagcaaggagacagctatttatgagctagaaagctgatcctcaccagacagaaaatctgcttagcacagatcatgggatttctcagccttcagaaccatgagaaataaatttctgttgtttataaaccatgaagactatggtagtttgttatagcagcccaaataaatcaagagagtgtacaaaacaattggcatgtaattctccaaaaatataaatgtcatgaaatagtctttcacgaagactcagaaactgctccagtttaaaggatattaaagagacatgacaactgattgaaaagcatgattttgtaatttcattggctacacagaacattattgggacaattattgaaatttagaataaagtctgtagattagataacaacattttatccatgttaatttgctaattttaaccactgaactgtacctatgtatgataattccatgtttttaggaattatttaagtatttagaagcaaaggagtatcatgtctgcaacttgctcttaatgtgtatcaataaggaaacgtgtgtatgggtagacggatacatagatgattagatagacagaaaggtagatatgagagacagagattgaataaagtaaatgtagtaaaatgttaacatttgggggatattggtgaggggtatctgggaattccttgtgctattcttgccactttacagtaaatctgaaattacatcaaattaaaaatcaaaatcaatataatatattaactttatggcttatagatatttaaagttagaattgtcaagtgacattctggtgaatgcttcaactagttataactattttccaaatattataaagcacactcagcataaaatcctgctttttgataccttacatatttcgaggacaactagatttttcagttatgtctttataaccacactgtacagaaagtaaatatatatcgagcagaaaatagctattcgtgacaaatctcacacctgagattaagagtctgctaaatcgttccattacattttggccttatgccctatatttttatcttcttttatcaaaatgtgatttcttcattgtaatttattagtagtttttagatatagacaacatatttaaatatatagtatcaccatcttttttgtttggtagaatcataccattttagtatgccataacagaattatatacatcaatatttttgtcattcagcctggcccacatgactctgagatgttctgaattggattgggctcatagaataaagtccaaactacttgccaagacccgatgccccatataatctggctttaggccaattttgcagatttctctttgaccgtaatcccataaattccctatgacatgcaaggctctctgtactacaaaccttttctatgctccttcatataaccatgaacttgaaaatgatgcctattcaactgtcaactcctaacgagctagtcaccctccaagacaaaactcaatgtcaagtcctgctttaaatcctccatccctccctgagcactgccctcccttctttcccaaaaggttattcttccttcttctgtctcctcatatcttttgctcatacttcaaacatttctgtcatattttaatgtattctacagtattatcttttccattagactgtcatgttttatcatttttttctgatcctctcccccacagagcatagaaaagtggctagcacaaatgcagctctcgataccatttttttgaataaatggataacaaaaaacaataaatatcacagaaaaatacaagaatttttgaattacaaaagagaatggtaattattagccactaggttgtacagagtaaccttcatgaaggaagtggtaactgatttgggcatgaagaatgagtaagatgtggagatagaaggcattgtaatagaaaataagaaacagaaagaaccaagatctaacagtctctgtgtggggccgtgaggatatgctgcagacctccaactataggaactataaccagcaaagggccccaactgatgcctctgaaattcactgcaacattttagctaaggccatacctcccatgccctgcttcctggtatttactgagcacagagggcatgttgtggcagacacattcctgggaaacaggattcctctgatggctgattttggcttgaggactcccatatgcctttggctagcccaatcaaggatgctctcaccaattctctctcccttctttactcagagtcaaacttggatcatgctttgacgtttccctcagccttaactggctccctccttatattcctctacaagggcatttcctaaaattcttgcatttctaatcccattttggcatgggcttcttgcaagactcagactaacacatagagtatagagtatgtatggagtaaatagggaattaaagctgatgaagcaaattgggactttgttactgagaacaacatgccaattcaatacattgtgccaaggcaggataaatctttattttctaatacgaacataactgtctatgtagtttttagatttcacaagtggcaaggaatttataacttccttttgagaactatttcatagtttaatcatctttcacagctcacgtaggtctttactaaatcctttgtgatttaagatcatttcttccagctcttctgtggtgatagattacagccaactttagacatactaaattaactacatcaactcttagtcataacaggaattccttctacaatattatgcacacatggtcttgcagggccatttgtcactttttctatttgatacaaaattatttctcattaataatctaatcatgaaacacctgtttgttaggcactgaaaaaattttccctgtttgaaagcagaaaaacaaagatttgtatgtttacttcagagaggattttgtgatttctaataggaagcaaacaattgtttttcttttctcaagtcttttaaactactctgccttctattgacagagtaagaaattaaatcttcaattatttaacatagcattttatctaattaaaaataacagattttttttttctgccaaagatttgaaacagagatggaaagcatgtgtgggaaattctgttacctttccagatctctgcttgaataaaataaaggcattttctgaccacgataagcacactgtctgatccagatcctccaagtatgcaaatcaacaggaaaagttccagcagcaagacttacccatctgcacagagtttcaaaaatggtgatgtacttacctaaaatagaaagagagatgacattagtgacattcatcgcagcttagacacatagtgaaaaacacattctagaaggcagttagagcatctgttcccctcaccattgccaagacccagttttaaggcttttgtttatgacacaacaggccagatggtggtgtctctcactgtccaagtttactctgagtacacttcataggtatttgttcaataaatactgaaaaagattataacaatcaactaagcaagaactatgatttaataacagcagcaaatttaacatctattgagggattacttgcctgccaagcccagtgcaatatgctttgcatattttcccatttactctttagatagtggacatgaggtaagtactattattatacctattgtaaagatgaagtaaatgagcttagggaagttcattaacttgcctaaagtcgctcacacaactagaaagtgttggagctgaagttttcacaggctctcagattctagagcccactttcatgatctttatgctatattgccaaaacccactgggaaataaagatatatatcattaccagtactttgttaaataatacattttaaaaatagaaatgatcacaattttagaatttgggaaaatgaacaatgcctagtacacagcagctgttcaataatatctgttgagtgaatgaaagaataagcaaagaaatgtcactgatatttaataaatatacacaggttatatctcaacacaacaaatatttacccacagagcactctactgtacagcttatttctttcttcctacagatgactatgtaccactattttaatctgctgattatttgaaggtgagaactaaatgctcttaagtgagaaagatgatggatcaatctagaccaaatgactggggagttaccaaggagaggatggaattgtcaaatcttcaaatggcatgttactcaacatataaaatccttctgtaattgaagaagcaattaacaaacaccatttaacagttcaactttcttcagccctttggttactcattttggtagaggttctcattagcaacaaaatattaaagaaagaagcagctaagagagaaatagaaacatgagactggctatttgaaagaatgctgtaattgaaaaacaagaaatactcagcacctcaaattcataaagagataatcatcaagttatctcatgttttgacattgataacatattccaatgaatcaatttttaaaataattataacaccctaaaagaaaattaccctctagtagaatgccacaaagatactcctcgagaagagcaactccaagacacataattttcagattcactaaagttgaaatgaaggaaaaaatgttaagggcagccagagagaaaggtcgggttacccacaaagggaagcccatcagactaacagctgatccctcggcagaaactctacaaaccagaagagagtgggggccaatattcaacattcttaaagaattttcaacccagaatttcatatccagccaaactaagtttcataagtgaaggagaaataaaatcctttacagacaagcaaatgctgagagattttgtcaccaccaggcctagaagagctcctgaaggaagtgctaaacatggaaaggaacaaccagtaccaaccactgcaaaaacatgccaaattgtaaagaccatcgatgctaggaagagactgcatcaactaatgagcaaaataaccagctaacatcataatgacaggatcaaattcacacataacaatattaaccttaaatgtaaatgggctaaatgctccaattaaaagatgctaactggcaaattggataaagagtcaagacccaccactgtgctgtattcaggagacccatctcacgtgcagagacacacacaggctcaaaataaagggaggaaggaagatctaccaagcacatggaaaacaaaaaaaaggtggggttgcaatcctagtctctgataaaacagactttaaaccaacaaagatcaaaagagacaaagaaggccattacgtaatggtaaagggatcaattcaacaagaagagctaactatcctaaatatatatgcacccaatacaggagcacccagattcataaagcaagcccttagagacttacaaagagacttagactcccacacaataataaagagagactgtaacaccccactgtcaacatcggatagatcaacgagacagaaagttaacaaggttatccaggaattgaactcagctctgcaccaagtggacctaatagacatctacagaactctccaccacaaatcaacagaatatacattcttctcaacatcacattgcacttattccaaaattgaccatatagttggaagtaaagcactcctcagcaaatgttaaagaacagaaattacaacagtctgtctctcagaccacagtgcaatcaaactagaattcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacatatttaaagcagtgtgtagagggaaatttatagcactaaattcccacaagagaaagcaggaaagatctaaaattgacaccctaacagcacaattaaaagaactagagaagcaagagcaaacgcattcaaaagctaacagaaggcaagaaataactaagatcagagcagaactgaaggagatagagacacaaaaaaacccttcaaaaaatcaatgaatccaggagctggtattttgaaaagatcaacaaaattgacggaccactagcaagactaataaagaagaaagggagaagaatcaaatagacgcaataaaaaatgataaaggtgatatcaccactgatcccacagaaatacaaactactatcagagaatactataaacacctctatgcaaataaactagaaaatctagaagaaatggatgaattcctggacacatacaccctcccaagactaaaccaggaagaagttgaatccctcaatagaccaataacaggctctgaaattgaggcaataattaatagcctaccaaccaaaaaaagtccaggaccagagggattcacagccgaattctaccagagatacaaaaaggagctggtaacattccttctgaaactattccaatcgatagaaaaagagggaatcctccctaactcattttataaggccagcattatcctgataccaaagcctggcagagacacaacaaaaaaagagaattttagaccaatatccctgatgaacattgatgcaaatatccttaataaaatactggcaaaccgaagccagcagcacatcaaaaagcttatccaccatgatcaagtgggcttcatccctgggatgcaaggctggttcaacatatgcaaatcaataaatgtaatccagcatataaacagaaccaaagacaaaagccacatgattctctcaatagatgcagaaaaggcgtttgacaaaattcaacaacccttcatgctaaaaactctcaataaactaggcattgatgggatgtatctcaaaataataagagctatttatgacaaacccacagccaatatcatactgaatgggcaaaagctagaagcattccctttgaaacctggcacaagacagggatgccctttctcaccactcctattcaacatagtattggaagttctggccagggcaatcaggcaggagaaagaaataaagggtattcaattaggaaaagaggaagtcaaattctccctgtttgcagatgacatgattgtatatttagaaaaccccatcgtctcagcccaaaatctccttaatctgataagcaacttcagcaaagtctcaggatacaaaatcaatgtgcaaaaatcacaagcattcctatacaccaataacagacaaacagccaaatccgaagtgaactccaattcacaattgcttcaaagagaataaaacacctaggaatccaacttacaagggatgtgaaggacctcttcaaggagaattacaaaccactgctcaatgaaataaaagaggacacaaacaaatggaagaacattccatgctcatagataggaagaatcaatatcatgaaaatggccacactgcccaaggtaatttatagattcagtgccatccccatcaagctaccaatgactttcttcacagaattggaaaaaaactactttaaagtttatgtggaaccaaaaaagagcccgcattgccaagacaatcctaagccaaaagaacaaagctggaggcatcacgctgcctgacttcaaactatactacaaggctacagtaaccaaaacagcatggtactggtaccaaaacagagatatagactaatggaacagaatagagccctcagaaataatactacacatcttcaaccatctgatctttgacaaacctgacaacaataagaaatggggaaaggattccctatttaataaattgtgctggaaatactggctagccacatgtagaaagctgaaactggatctcttccgtacaccttatacaaaaattaattcaagatggattaaaaacttaaatgttagacctaaaaccataaaaaccctacaagaaaacctaggcaataccattcaggacataggcacaggcaaggacttcatgactaaaacaccaaaagcaatggcaacaaaagccaaaattgacaaatgagatctaattaaactaaagagcttctgcacagcagaagaaactaccattggagtgaacaggcaacctacagaatgggagaaaatttttataatctacccatctgagaaagagctaatacacagaatctacaaataacttaaacaaatttacaagaaaaaatcaaacaaccacatcaaaaagtgggcaaaggatatgaacagacacttctcaaaagaagacatttatgcagccaacagacacatgaaaaaatgctcatcatcacttggccatcagagaaatgcaaatcaaaaccacaatgagatatcatctcacaccagttaaaatggcaatcattaaaaagtaaggaaacaacaggtgctagagaggatgtggagaaataggaacagttttacactgttggtgggactgtaaactagttcaaccattgtggaagacagtgtggcgattcctcaaggatcttgaactagaaatactatttgacccagccatcccattactgggtatatacccaaaggattataaatcatgctgctataagacacatgcacatgtatgtttattgcagcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaagctggaaaccatcattctgagcaaactattgcaaggacagaaaaccaaacactgcatgttctcaatcataggtgggaattgaacaatgagaacacttggacacagggtggggaacaccacacaccggggtctgtcatggagtggggggaggggggagggatagcattagtagatatacgtaatgtaaatgacaagttaacgggtgcagcacaccaacatggcacatgtatacatatgtaacgaaccttcacgttgtgctcacgtaccctagaacttaaagtataataaaaaaaaaaatgggaaaagagacagagccaaactattttaagatgatctagccatgatgtgcaaaaaataagcttaataatataataatgaaagttgtatgtaatactttcctttcattcaataaatattattttatataggaagttcattttataatacatgtcaagtcataggggtgagataggaaagaggcacatttatggccttcattattaagccatatgaggggtaagtttagaaacaaaacaacctgggcaaaatataaattggctataagtaggtcatagatatttacgtttcttgttaaaatatatgataggaagaattcataggtttcatcctctggctttagactgtgatattacctattcatgtgggaaaagttcttcttaatgtataggaaaaaaggttctgatacgtagaatatcctttgttccatttttgaattgatagtgcaattagttaagaaataagacataggaagacttgagaacctaggtattttacagagttttaaagagagagctcttggtcttcttgggagggtcttaaggatccgctttttattgttgtattctttgttcatgtaatttgtgctgcttgccttggtttgaccatggttctatagcaaagcagaattccaaggggattgggtgaaagaagaactcttaagttatggctggttttcccagaaccagtttcttaaatagcctctaaaatcttcatctttttccaaataaacattattagtaatctctttaagagtaaaccccatcacctcatattactctcacgtactgagcttttaatatacatcaagaagattaagcacacacctcaggtattaaaatgtgtttcctctgcaatctcattttatatcaaacatcagtatggttatctcatgttgtagagtattgctgaactagattctatgttggctgagctctaatttaagtttagatacagctcaagccctacatagaagcacatttaaatgcatcgctttagcttgtttctgtagcatttaaaggttctggcatcatggaaatgattttggaggtattctgagtgcctctgttgattttaccagacttgtgaccttaggcaaatggcttaatttctcttcctcacttttcattttgcaatgagaacatgaatattaaccatttacataattataaccaaagttatgaggctaaagtatgagaagagtgacagggacagacaagtattcaaataagaagttgtttgctaaggtctatttaatgtattatagtatgagcaagaaaagttttcagatttgtgcacattaattataatattaaagctgacagggttgagaatatttgctaatttaaaaattataaagttgttcatcagaatgatgtaaatatactctagaagaccctgaaattgtatatgttttcaagttttgaataaacaacataactgaaggaaaaaaatagtaaaaaatatataaataaaataaagaaagaaaattaccctctagtaattcaagtcccctttttcataagcggtgccagagtaaaataaaccaataaaacatgagagacttcactcaaatgtccagaatctttaccaaaaatagtcaacatgaaaagtctttatacctgcaatgttttccactgcttttctcagtattatttatagatctgagttatatattaaaagtggttattaaagctaagccaaaaagaaggaaggctgataaagttttaagcagttttgtttcaagatcaaactggacagatctgcaaagaaaatcacaactatttgcgaattttagtgaaacaaatggaacttttacagcaaattcaatgtttacccttaaagataactgaacttaatgactcaaaactttaattatgaggtagttacaaatgtatgtggttccattttgataaagacctgggagaggatccaaggagcaaagttatttgcaaaaaaagttaggcaagatttgatggagtgtacttgttgaatacgaatgactgaaaagtattttttaatctacttccttgtgatgataataaggttctgtttaacattagatctgtcagtgagcagataaaggaaagaatctaaataagattcactttcaataagctcggagtagtctatggattaggatttatacctccattctactgaatatgtggatcagttctaagagagaaaatattatgaaaataagacatcaaaggttgatgccttaagggctaaagaaatacaggcaactcagaaaatgaatagcatttgaatttatactcggggaggaaaaaaaggacttcaaagaacagtcatatttattcactagattaaggcagacatttttccagtacaaagtctgtgacacaattcttcacccctgtccaatcccagcctccattttcaaatatcttggccatgcagcagtttcttttcaaacgaaatgaaacaaaacaaaactttattattttattgaaattctagtcacttccttcacaaactcccaataactcagtgtatttattcctctataaagtaagtgcagatcagaagaatgagttatacaccaggttggccgtcttcgctgggaagatggttaggtcagcttgaagtgaagtcagtagttgtggtttactctatgtctatgtctggcactgcgcagtgagcctctgttcttaaaggaatcttattttaatcttcttgggaaggcaagacattcatacttgaaacaactattaaatgatgcaaaacaacttacaattaaatgtaaattacacggtggagacatcaaatgctacaggaattaaaagaaatgaagaaaagatgtttcagctgttgtgtgggattacagcaatatgttgtaactgggtgggagactattaagagactcctgatagggaatgtgcatccagtacatcttcttcttgaccacattcagagtcccgcatagagatttctggaagagcgtgggagctgcttcagaacaaagccaatgtcttgagaaggaccatggatctacggtgatgtttgaagagcaagattaaaatgtatactgtatccctatgaccatttgctcctacaaatcacaggttattaattgattataactagtaacacacataacagtctacttctaaaggacttttaccaaacattactattaataacttttgctgaaggatgttcattaattcacacagtaactactcataggtcagctctccaccaaggaggcacagagaggtgctcataatcatgaaactttcaaattgtattaaagtcgggaccccccaggaatacccatctgacttacacttatatctaatcaaggtcagccactttgaaatctccatggtctctaaccttttaggatcttttctttcaaaatttaatgagcagctcaaatccatatcttttatttatcatagaacccaaacatccgggcttcaataatgcttctgcatttttgaaaaaaaaaaaatatcgagtcaaggagcatttattccagtgtgagtcttctgccaactgctaccctactgacccacccctcatttacaagggccccttctttactcttagctcctcacagtatattacaattgcttccccaaggcaggaactgcaccttttattgccataatattataccaaatgtcatctctgtgcataacacgttatgtatgcaacatgtttgttgaaatagccgaattgtttcactagttatctgatagtttaactactcaggccaatggtcaagtcactcttgtctgggccctagcaactctctgcatgatgcatattggaccttgaagtcctttcaagatgaactacacagactggtgacatattcaaaaatggtgtgtatttgattttattctattttttttctttttgagacatggtctgtgtcgtccaggctgaagtgcagtggtacaaacacagttcgctgcagccttgacctcctgggctcaagtgatcctcctgcctcagccccccaagtagctgggactacagacatgagccaccacacctggctaattttttgttgttgtattttttgtagagatggggtttcaccacgttgctcaggctggtctcaaactcctgagctcaagtgatccacctgcctcagcctcccaaagtgctgagattacaggcatgagacactgctcttggctgatttaattattgttaaactgatttcaactcatattatctggctcaaagtcattcaactcgacatgtggaaatattatgttttgaatcattatgtgctaatacctttagttattgtcttctttttaaaatgagaaaataaaatatgatttacacatatataggaaagaagagtaagttaactttttaaaaagtcaacttttgttactatgaacttgctggtttacatgtattatgcattccatcctcccaacaaccctagaaggtaggggcatctgggaaatgaaaggctgaaagtaaataatatgagattatatagccaagaatggtaaagccaggattcaactcaggccatttttccagagtcttagtgtataactgccaatccctacttcattcataatttcatttaataaatgtccatcaaatgactactataattgggcacttattctagggatacatcaatgactacacatcctggcccacatggagcttacattctattgaagggagacagacaataagcaatatcttaatatacattatacagcatgaaaaaaagtgacaagtgctatgaaattcattgatgtggaaagagagggtaagaatggcgctagtggagaggaatgcatttgcaatggtaaataggatgttcagggaaggccttgttggaaaagtaagtacatctaagcaatgatctgagttatactttaacacatttatttgatgagaaaccagtaaaagttgagaatacaatagagcaaaaaactgcaggaaaatactgaagctcttggtttttataaggtatttattccagtctcatactttagtcaaacttgcacatgttttgtcacttgtattatttttttaagttccttgaccggaataactgtgcttcacacagctttaaatccttccatagtgcttagaagagtggctgtcacaacagaaagtatctgttgaaggaatgaaggactaatggaaagagatacacatatgagaagtaaaaaacagaaaaaagaccacatcaatagttacaatcactggtaagaaaaccccaaaatagatctagtctagaaaataaattcaaggaagagtactttctgatcatggtaatgaaactgagagaagatatttgggaatagaaagagagtagttttgctaatcttgaggatgagaaagttgaataagaaagccttcctgatggggagtaatttggggtgaatctaaattaaaggccacactgagcagactgaataaagttattcatccattgaatcagcatttactgtgagccacctaagtactaggcactagaggaaaattcattaatagatagtccctgaatttatgtgcttatattctacaagagacagctattaaataaaaaagttacataatcaattaattataattgtgttaaatgctataaaagaggcacatagagggccaaaggggcttaatctttctgggggtaccaggaaggagaacctgagacctgaagggcaagtgtgtgggggtgggagtggaataacaggaactttctatgttctatgtactacaggtattcaatgaatatctatcaagaattgttatgttcctgcactacatacaccaacacttaccatctcatttactcttcaaagcaaaccaatgaacaaagtttcactatgctcatttaacagaagagaaaattgaggctcagagagataaaatatcttgaccaaggtcacacaggttgtgagccaagattccagtccaaacctgttcaggattttcccatatcagtcaagtgtcaggcaacctgttaccaagatctctgctattctgatgagttgttattatgtacttgctaagaaacaacagcctaggtaggggctcagagttgattcaggtcagggcaggttgatatcagctagaataaccaatgaaaagccctgttgaattgtcccaatggatctagcccttggtcctacttgatgtaacaaactttcctgcctttatttactgattttatgcagtggacaaatactgaagctctatagacatcagtttcagcattgtgaacatgaaaatgaattatacatgctcctctctcaagcagtttagtctagtgaagattcagacccataaaataaatggagtttaatatggcaaatgttacaaaaatattacaaaaacagtatagaaagcattcatcccactataagaggctcctaattttgcctgaagtcttctaaaagaaactggactttggcttggaggttaaatggagccacaggatattaagcagagggatggagaaaagcattctctttagggacaagataaagtctgccatgtttttcaaacagcaaaatgttggttggctgagatgtatctgagtgtgttgaaggcgagggaaatggccctgttcccacttaagcagatcacatagtaatcatcttgaccccggactttctacattgcatggatatttgagaagttgactatgttgtggtttactttctggcatgagcgctttaaaactattacccaacatgaagggtcaagcagaaggaaagagatctgaagcaccaccacatacacccacattcaatcctattacagcaaactttacctgtaaactgacttgtttaaaaacattagaacactaaatgtaaaaagaatgacagcccacacatagtgcttagagatattttttctatttatttatttatttgaggttgaaagatagcaagaacatgaagaaatggaatttgcgtgacagtcccaaagcaaatctattcaaaagaaaaccataattacatatgcagctctcttgacagggatgacagcagtgaatcaacattctgcgctgaagacctaagtcaatatgcatttgattcaaaaaactaccttcattagcacagactatcattagtgatcacagatctatataaggctgaaaaacctaatctctgtgtctctgaaaactgcaaaaccaccttagcagttgcctaatttccctgagagtggaggtttcacttggccattgggctcaagaggccttaaagtgggcaattagcttgctggattatgcagtgtactttgtacctcttcattacattttccaccaggcttgagtcgaacagaagagcttacaatgtcaatgactttgaccatttgagattttgaagcagaatttcttaaccttttcatttctactgtttctcaattgatctacagctggggaaatgtaattctctcataattctgttaaaaaattatattaatagttccatggaacacacagaagcaggtatgttaaattatcaaattgaatttgagaggggagaaataagaatcagaaattatgtaaattaacaatttaacatactcaatgtggcaataaattatagcttcatagctggtggttataagtacgtcaacaattaaaagaaaaataataaaataaaaagagttagctctctggccacatcttccaaaattatataaaatagaatcatgacttattggatccccaaatcatttttaaattatagaatcagcttttcctgtgggggtcttctattaaaaagatggtattaagactgcaggaaattaagaatgcaggctttggagctagaaatgtctggttcaaacacaagcagacctgagtgtccaagaagtggtagctatatataattatgatggtggtggaggtaatggtgactgcagtgacctaaacaaaaaagaggaagatagaaatgatgatttggtgatcaaagatcaatggaacctttgtttatggacactgacttttgtcatttttctgataagtacttaagaaccaataatataaaatagggactattttacacctctttttcaacctgtagcaaaaaggtatttattttttcaaaatcttatcaaggtcagattgatgccaattaagtatcagtatatccctcatttcagtcaccatctactagttagatccaatttagatagtctacctcctaagagaatcttaatagcttcatttgcacaggaatgatagactattgatcagacagcctcaggcaggatccctttagtttgagtagatatatttaatctaatagtgcattgaaaatctaatagctggtctcctgggatccctggtcacaaattttaataccctgcacaatgaaattgcataaccattactgaactctatcctgttgccaactaggaatatctagaaaaccaataaaaggaagaacaaaacattcagaactgcagggctgtgtgattacagtctctattgtttctggtttaaagtgaaatcaattaattgcaaacacaattaaagtaactttgcagtagttggctaaatagaaaaacattttgtggtattattattttaccaacaacccaactttggcctatcatacctatgacacttttattttccttctataaatcatgccacaaaggttaaaaaattaaataacgacataggccttttattacaatcaaaatgggtaagaatgtgactttgcagagattaaataaaacagctatctcttcatgattcacatttattgaataccaaaaataatatgggagaaaaaaatcacgtagatttcacacctaataaatgaacaaagaaggagaataagtgtatagatatcttatataaatgtataggcatatttacttatctatttacatgtatttacatgctagatttccccaccaatgccatggacagaacctcaatccccttattacttccaaaatttacactgcctatccccaaacctcaccttctttggtcttatttatcaattaccaatatcaactcagtaaatgactggtccccttctccagttgcattcagatcacatgccaatcatatccactaaacatttatgaaattagcattctcctctcaatcccgtagaatcacaaagctagctcaagcctatgtgatgttttgcccaagccacagcaggagccaccttttacattcccagccttcaatcttgccacttacatatttattctccattcagcccctagaatctgatcttgtcacataattgcttggaatgcttcatggtttgaggatgaacccaaagtccttaacctggctcacaaggtccccagaacctaaaccttatttatctccaggctcatgtcttgtcactgaactactaaatcatcccttcatcacaaataccatgggattccttgcatcagtgtctctgttcctgctattcctctctccctgaaatgctcttcctattcctctctccaccctacattcattctttaagactcagtttaggtcacacttttcaccccagaaaaggttaggttctgctttttgccactcccataaaatcttctgcatagtgctaatcacggcactcactacacattttccctgataatctacgtaaatatttgcttcccctgctccaatttgaactactttaatctaaattccctgagaaaaggttattatttgtattatttatgttagtgtcttcagtatacctagaacatagtactgtagatacccatacaggttttgttaaatgagtgaatgagtgagtgagtgaatgaatgcttttctctagaacaattaatactgaaaagcaaatgtaagcacaatggagaaaatgccattccttagaattcaagaatgagtgtgagggataagcccaaggagtttcacaattatggaaagtcacactcagacagtgagaatagaagtgctggttgtggaaggtgaagactccaagaggagcaacacagaggtgaggagatggtaccagcaagacaagaaggctgtgtggtgcatagttgatgtgaatcttcttcacaacttctcaaagctttagtacagttcacacatgctatgtgttcttggatcccttgtgaaaaacagctcaattcctctacagctttgcatccagacctgaggcccagcagaaggtaaaaacatataagatggacacagagttctggaggcagagagtggcataaaggtgtcaggtgtggcactaacatagaggtcatggcaaaagttaatcacatttccaagggccaagaaagcactggtcaatagaaatatgacagaaaagaatgaagagggaagctaggtgaaagaggttttcatacatcaacagcaacatcacctggaaacaatttttgattagttaggcacttactaattattccctgcttttctttttttgagatgaagtctcactctgtcgcccaggctggagtgcaatggcacaatctgggctcactgcaagctccccctcccaggttcacgtcattctcctgcctcagcctctcaagcagctgggactacaggtgcccaccaccacacccggctaattttttgtattttttagtagagacggggtttcacaccatattagccaggatggtctcgatctcctgaccttgtgatctgcctgcctcggcctcccaaagtgctgggattacaggtgtgagccactgcgcctggccaattattccctacttttaaaataaattataatcgtgctgagagaataaaaaaattaaaggaaagagttcagtgagccgtgatcatgcaactgcactccagcctgctcaacagacaacaaacaaacaaagttatcattcaaaatgtttcccatggccagatgcagtagctcctacctctaatacctgtaatgcccgcactttgggaggccaaggcaggaagatggcttgagtccaggaatttgtgaccagcctgggcaacatggcgaaacctcatctctacaaaaaatacaaaaattagctgggtgttgtggcacatgcctgtaattccagctacttgagaggctgaggtgggaggatcacctgagccaggagaggtcaaggttgcagtgagccatgatggtgccactgcactccagcctgggcaacagagtgagaccctgtctcaaaaaaaaaaaaaaaaaaaaaaattagaccaaaaaacaaaaacccaaaaagccaaaatgcatccaagtatcataagtgaaaaagtgagcttcttagcagccaatatgcaaagggaacataatctcttacacagtttggaattactcagaaaacgtggaactgtcttcaatcctaaagcgtcacatagaaatgttccctgagtctcactgggacaacacactgagcaatagctttaccagaatgttttgtgaatatggtatgatatcaagagtaataaagttattttggaaaaaaataactttagaataatcacttaaaagtctgctgtttttgaccataattgcacatggatatattgccttatataaactacaaagaattgtctatttcacatcacattttacaacttacattgcaaacctcacttcagccttgaggtacaactatcaataaaagaaacaggtcttatttttaaaactttttattattcatatccttggtgactttcagacaataattaacatgtggttagtatcaccttaatggaggaagtaccttatacttcaaacaacccttaccaaaagaacagataatacatatgtattgatacagcattacaaattgatgataattcaaaaaggcaccatgtagcttgtacttgagaaggaattttccctttgcatattgaagggggttctggtggtgttttctttgtccccagccgacttcacaatgaaatgtttctactttgcaccctttgggttcagttgttcaaccagttacaattagttagattagtaactggttgaacaactgtaatcaaagagcacagattgacttgttgtggtctactagagagagatttgctagtggtgttcagcagggctctgtctgtcctcttcaatgtgtgcatgaatgacttgaagcaacatacatacattcaagaaaaattcattaaacattgaatcatcatctaatatttgcctgctattatgacaggtcctgagggaaccaagaaaatgtcagttacatggctctgatgcaaagctgggaagaaggagaaggagtcagaggtagaggcagagagagtaaaagaaagagggagaaagtgagaaagtgagacagagaaagagagggaggccatgttacacaacaggaaatgtaacacatgacctccagctcgaaaaatttgaataaaaagatatttcaaggagtgcgagggaggtaacccttacaattattagaatgaacatttactcattgtcaacactatggagcacatatttgggaattcacctttatttatgccacacaatattatgtaggtgacaagctaacccgtcgtatttaacaatataaacaaaaacacaaatatcctactttattaaactgaaagcagaggactctcatctccccaaagcccaggccattccctgatattagtaaggatactaggtgaaactccttctttcaacatttattgtaattagtgaaaacatgcttaatgggacaccatcatctacaatgatgacaccatatctcaaatcactaatctttctgccatggacagatttctgtatcaggggacacctttgtcattttgtcatccaaattttgaggattctttttcaattctccagcattgactgagaatttaaatggtgccagcattgtgctggaaactggataaaaactgagataacacacttgagttcctactctcagagaatccacttattggattgctttgctataattcctgaatccagtgagattaactggtattttctgttgttcaaaaaactacttttcccctttttgtacagatcagcaataaacatttacatcgagattgtgtggtgtccatgaacaaggcattcagtagggtccaagtctagacttgaatggcgtctctcacatttttgactaagagacaatgtagacataaaagtatcataatccaacttacatacaaaatggaaaaaatggaaccagaacaccttaaaatgtttcctttgaaatatgtgtgtgtttccatcaggtttattttagttctctaaaactctgtaatactgaatactccaactaccaatattagtcaaagctgtttaaaaccagccttcccttatttacaaaaggcagattttacaagacaactatcagggataaacacaaaaagaaatgaaaactgttccatgtctagcaattcgccagagtaaactggctgtatattgaacacagctgtttctgtgagggatttttctttttttggaatttaatattgactgtgctcttgtggcaagaatatagtaaatgaaagattgttccaggcctgagaagaagagaggccagaaacaattgttcccctaggtcctccccttccttaataaccaaactgttgtctggagcctccttgagttaaaagcctaccatttttcatgtcaattacacacaaacaggacttttcttgtcaccttccctaaactgaggaagacacaaacccagcaggaaggcaattgtaaagataaatttaaaagtaagaaggcaagcctgaaatgcaaacataggaaagagcctcttattccctacacttctcacttttcatggaccattgaaggctgtttcttaccaaattgaattctttgaaaagagaaaccatgacaattttccccaggctacggtaaatatattttcttgcacatttagtttttgtttcataacaatcctaataaaattagatgcttttagcaccttacttaaattaagaagacctttcctgctaatgtgcccagaacctatctgggttactaatattaatagttccattttatcatgtacttaactttgtgccaggaattgtacacagcaccctatacatgttatggtatttattcttcccaatagtttgagggaatcatgcttgacatagtaatccattgatcacttcttactttgatctctacttatcctcttgtaggatcaactatgcaaagtggtggattatagcacaatgttaaagggcagtgctctggagttagatggtctgtatttgaatcctagctgcaggaagttggggaaagtacaaaatgaagatagtagtgctaccaatctcaaaatataaattctggagattaaattaggtttaatatgattgtttggtccatctctagactagtaccttgaccactagtactctttcagagatttttttatgttttcaagaatgacaaaaacgaaattctatacacaccctgatatccccaaagacactagtgccctggggattggccatgtgggttactaggttccatttatttggttatggaggatgttcttcacccaagttaatcctttcacaaaagctcatttttgttctttttcctgcagcttccctcagaagaagctgtggccagtgaggatttcagggtcgcttgtccccaggtgatatgggagtttcagctcaggaagtgactaggttagatgtgggggcaaatcaagaccttttcagccactagcttaaggctaacccaccacagacctaccttcttgaacaacactgggaatttgggtaattaaatgctaggatatcagacatgatgtgattaaatcgaagggctgaaacaaatctgacattctgtgctcaaattataaggttagcaaataagaaaactagaaatatctctcttctaggcaagaatgagaacataagtctacccaaatgtgctctacagaggtttcaggtttagcatcttgcttaaggatgatgcttcatggtttagagagaaatgaattctagaatgtatcctttgcttataggacataacccatatttatagagatattttcaatatggtggagctagtggtagggtagaaagaacataaaattgactataaggaaatataaatccttttccgagctccttctccttatgcacacatatatacatatttgataaaataatggccctgaaaaaatattagagtggttttcttaaaacctaaagaaaatggtatccacatcagtgatgctcaattgctttttattatggacaatgaaaccaaattagattaatcataaggcaaaatttcaaatgaaaccagtaatacagacatagtgtctgtaaggttttatagcagaacatcagcaagatagcagaaacttaatgcatgaagtaacctctcaaccttgttaaagaatttcttttatatttcttgataaaatagtttttgttacagttagtaacattattttaaaaactgtacgtcttcttagctgtacacagaagtgagacatcactaaccagagatttcaatataaatatcttcaagtaaaaatgacatagtacatgttcagagatagcaaatggaaaaacagtggattgatttttataactcttcgtgaataaattctttaatgcaacaaacatttattgaattactgtttttcttggcactgaggggaataaaaaatgagaaaatacagtctctgcctttatggagctctcagtcttgtggaaactcatccacaagatggtcacatgcatatgttggtctagtcccaggccttaacaaactatggccctcaggccacatctagcccatagcctgtttttgaaataagattttttttaggtttttattttttttgtttttggttctggggtacatgcacgggatgcacaggtttgttacataggtagatgtgtgccacagtggttgctgaacctatcaacccatcacctaggtattaagaccagcatgcattagctacttttcctaatactttccctcactaaaccccactccctgacaggccccagtgtgtgttgttcccctccctgtgtccatgtgatctcattgttcagctcccatttataagtgagaacattcatccacgtccctgcaaaggacattatctcattcctttttatggctgcatggtatcccatggtgtgtatgtaccacattttcttcaaccagtctatcattgatgggcatttgggttgattccatgccttgctattgtgaatagtgctgtaatgaacatacctgtgtatgtatctttgtaacagaatgatttatattcctttgagtatatactcagtaatgtgattgttgggtcaaatcctatttctggttctagatctttgaggaatcgccatacagtcttccataatggttgaactaatttacattcccaccagcagtgtaaaagcgttcctacttctccacaacctcaccagcatctgttgtttcttgactatttaataatggccattctgactggtgtgagatggtatctcattgtggttttgatttgcatttctcaaatgatcagtgatgttgagcttttttttcatgtttgttggctgcatgaatgtcttcttttgagaagtgtctgttcatgtcctctcaaacaaaccccacagctagtagaagacaagatccagaacagaactgaaggagatagacatgaaaagccctttgaaaaatcaaggaatacaggagctgattttttgaaaaaattaatagatagactactagctagactaataaggaagaaagagagaagaatcaaacagacataataaaaaatgatcttccatgtaagacgcttatcacaatgtctaagggacagaaagctgggagtctatggagcttatgagaataggctttatgatagttgtggctccttggtaacaaaagcttgccagtcaacaaaattcagtccaaaatctgctttcattactacattagacatgatggcttagttgtgggagaggacacctatgtaccttatcctctttcaattaatgtagactatgatattcaccaaaaagactctgataaccatgaagggtcaaattagctatgtcaattcatgatgattaatttgaacataaattattaattttgataaagaggtattacctaagctttaattaatgaacgttccacttctacttaggacgtgaaagtcaccctgagtttatgtcaatagcattggctgaaaagtcttaatttctcatctggctttttttttttttttaatcgaggatatcccttcctccaacccaaatatattttcagcaacactcatgccaacccttatctgatgttgagaagctgtgaatttgatagcagaatcataacattttagacttaaaaagtgctttaaagatcatctacttcttctacccactcaactaatagttttatacttgaggaaacagagttgcatggaagtaaaggaactcgactaaaatgatcaagctagagactgaaccaggatcagagccctttcccctgcagccccgggaaaaagaattcatgttgaggaaataaggaaaagtgtttaatactttcagctaagcataaaattcctaagaactcttctctataaacagaaaatctaaactctccaaaagaatcgcacccccttagctgtaacaaagtctctgcagttatttcacagctgaaagccaactgacactgattcctgggtggtttcactaaaatagaattttctgaaatgcaaactcacctcccaaggaagaatatgaatttgaaagaggaaaggtgttagtggcgccaacaacttgctaccctgctgagaagcttccagatagccagaaacacagcagggagtagcaagaaacagaagttacagatgaagctgctctttagtcacaaacttgtttctgacagctcttgttgaaaaacctggggacagctgaacagaaacgttagtccagaggcagcctcagggctcaagtgctcaaggatctcatctcagtgtaaatattccaacttcctctcatccttctcctactgaggggaggaggagaccaaagggagtagacgatttgaaggcagttgctaaatgagaatcgctgggtggtatgcagaaaatagcatggttagcttagatcctacaaccagttttcaaaaataaaggaagtaataaccattagcataatgagaatacaaatcccaagtctccattactttagacagaactctgcaggagaccacctaaggaaaatctgggggaaaagaagtttccaatcaattgcagcagatttaactgattcccttctgtgggcacagcatggtattgagagctttggggattattagggaaagagaggacatgctttctttccttgagagattctgattctgggtgagacatggtgactatgtgcatctgaatatgctacaaggatataaacaattatacaacgaaccagaactatgctggctcagtgcccagggaagtcggaagaattcaagtcaggaccttgagtcagggatgaaacaggaatggttttatgaagaagtcaatttttcagctgagttttatacatgaaaggccatctcgtttagccgaaagtacaggaagggcctgtacttagcatgagaggcaggaaagcaagaaagcctttgtataaaatatggtgaaagaatcaacaaaagcttctgaagcctacatttatatacagaacttattctttatccaaaatgtaatgtggggattcatgaagatggcagaactccagtattctgcacattaataatgcaatgagcatgtctatggcactctaatcccttaaaatttcatttgtaaaataattatccttgttctcataacagggaaaataaaatcctaggctacagtaacaaaatatattatttaacttaatgtcaatgttaaaaataaaatagtaagaaacagtctgatattatatttcacagttatcaggattgtgattgtaaatcctataaatgtcatatcctgattaaccttttaggagaaaaatactccattggtgtagttctaacactgtttttgagatgaagcaaaatttctcatcaatatttctattctgactgtttggatatttaaaagtcatataacctaatttcaattatgttataaagaatagggttaaccaatagctaccacctgaggagcactgactgaaccaggcatacggtaggaattttacatggttttatatgtgatactaacaatagcctaataaggtaccataactccatgtacattttacagggaaaggaagatgtggaaagttgaatgaatgtgcccttgttcacaatgcaggcactccaaaccacagcatattaaccaatttgacaatcacctcttagagggttctctattgtcttctctaataggacctgcagaggaaaagatacaaattccattctgctttacctctgcagtaagtatggaaatgtatctcacattgtttcttattcatgtcttttcaatctgcctatgtcttcagagaattcttatcactacattgggaaaattttctgcaagctgacatatcacacttccagggaatttttgttgatataagaccattattttgtcccaagagttctcataattgcccttagtataatcccttaagtctctttccactgcagtatttatcttcttttaaaaataatagttaaataaaaattaacaatgtaaattagctaaaaaaattaaaaaaaataatatatccattcatttatctagccaggctgtaaatactcctctgttgcataatctttcaattctttcatcatactttcttctgctctcttcactcccttcaaattgtctgcatattttttatccactaggattgagtttctgtggttgaggctctgcctaaaagctagttgggaatcacaatcaaaatggattgttcatcatttactacaacctaactataacttcctagtttttgtctaatacaagatctgctctttatgccttcatcatttccaatgccaaattattccagcgatttttaattggtagcatattattaatacactatgcatcttcttttgtatattatgatatattacttcttgttgacatctcaaccagaaaaaaatggttgaggaaaatgcttataaaggttatataatgttcagatcttattcattagcaactctcatgaaattttctttggtaaggaaagggaaacagcccaatgacatttgtgcttatttgtggattttacttatccattcactctttcattagctctcatatttgactacaatttcctttgccaattacattataaaaatcaagtacatttccttcaggccttttcaaagttttccccagtgagttttaatttgacttctgatgcatggacctgctttgacaatatttaaatagaatatttatacaaactgatgcttcttttctactcgttttagagtatataaactgatatcagaaggctaaaataacatcaaacaaagttatcctagagcagtccataagtaaagaattataatcttcagctccatctctctctaccatattcattacctttccatagtctcataatatttttctaaccttatggtctaaatgatctcgttctgtctgtctatccatttgtctgtctctttctctccctctgcaaatcagataactacattatacaaatataagaataaaggttaatattattcatatatatatatatatatatatatatatatatatatttaagttgttttattctaagttctttatgttactcattaaaaccccaccattgttaccagggatttataacagatttattagtccactgaatttacccaacattgctaccagggatttataacagagttattagtctactgaatctattctgccaaaaaatgtgctgatacagattctgcccaatgagcataaagctatttttaaaaatataataattataataatatatctataatgtatatacgctatagggttaatagggtaagtttaatttgcaaaacaccaaacacaaaattaatttcataattactgaaactagaaggcaaaggttctgagcaggggcccaagatttatgtttcaggcataataacattggtggacaaggttgtcacatttcagagatgtggttatcatatctcacatttaaagttacaattattataatgaaataaataaggttgacaactgtttaaagaatttttgagtgaatagtccagtataaatgttttactataacactggaatatttaaagttacttatctaagaatttaaatttcaactgctttggcatggatatcatcattctgaggttagaacttctgtgacataagcaactattttaggaatttgacagcattaaaacaaagttaaatagtactgttcaaactggatgcaagaactcacaggaaaaaaaacaataagtgaacatttgagaagataggcaactttgctagcaattaggaaaaaataattaaaacaatagtgacagacatacctcatctgacaggcaaaaattttaaaaatctgatttaaggaaaatgtatgcgctgcagtcaataggctgaggcagacatcaggtccagcatgactcagcaagtttggagtgcaggtgcacaattctgcacattatgtaactacaccacgtaaggcgcattaggtgatcacccacatgagcttgtaactggctcagagccactattgtctgtaaaaggtataactaccggactgacactgtacctatggtttgcacctacggctcacactcagacagtaaaggcacgttgaaactgtgcatgattcctctagtgtttttccagctacccaccactcacccactgactcccctcagacctcagttagaacctgacaattggcatcacgaacaggatcccaaggtgggcgagcctttggtccctgctgattctgggttggcaatgtggccacgacatgggttgtggtacctggtcacagctgtgctgcaagggtgaactctgttggaaacctggccagcagtagatgggtaccccacgagcacggagaaagcactgaagcagctggaagtgcagagcaccgagaaggaatgagcctttgacagcagagttggatgggcattttttctgtgctacaagaagtacactcccaatccctgagggatgcagtgcaggaaagggccttttgggcacaggcagggtgcctggaggcccagctacacagcttagaaaaagagttagaggctgccatgaatggggatctccaggtgcaggtggggtgcctgaaggcctggcatagggttggaaagggagttagaggctgttgtgaatgcaggcctgggtccgtcatctcagccagagacccctgcttggtctgggtctgcactgtaaaaaaggggaagatgccccacctgcagagcctccccatcatggaagaaaagggggccccaacaagtgacccactcacagatgtggatagatttgactttggccagggttgactgagagaaaatcgataagcagcccaatgaagtactcttaactttgtggagataactgtctcaagagcagcaattccaggaaatgcagaaggggaaggaggacattgctgtatgacctggtcccactcaggtgcttcaactcaaagactacttgctgcagccaggtggaaatgttgagctttttctgtttgattagggaactggctgaggtgcctggcctggggggacaccagacaaatagaggccacatgtgaaattagcaatccactggtcctccaccaacatacagcaagtgctggcactggtaaacaccagcgctgatatattctgggggtggatgttttacatggcctgacagccatcccatctattacagatttgatggaccgcttgatgatggaatttggacagtgccactatgtggtggacttgattaatgcattttcaattaacattgctctagagagccaggaacagttcgccttcacgggaaggtgacagtggactttcatagtgttgctgcagggatatatgcatagccccatcatatgtcatggtcttattgataatattatgttaacctctgattctcttgcagatttagaagcggcaatgctcctcttgcctagaattaagatagtgtggctgagactgacttcctggcagctaaataggctattcagcaggcacaagccctatgggtagttgaccaagggtgctcatttgagttggatgtgcatgtgaccacagatggttttggctggggcctgtggcagagcatggagtgcttgagaacaccagtaggcttttggtcccaactatggaaagaagctgagctccagtattcactgatagagaagcagttagtaactgcatatgctgcccttcgggctcatgagagcatggcaggacaggctacagttgtcgtgtagacgagttacctgatagcaggatggatgtgttcattgataacaaccccccggactgggacagtgcagacatccactttagcaaagtggggcacctacttgaagcaacagagtacgctgagtacaagtcccttagcagcagagttgcaagaggtcttgagaccagcagtcctaatgcaagataaggccatggggcctaaggacatggggcctgaagcacccctacatgctgagccttcaccatttaaggaagggcatccccccctatgcccgatggggcacggtacacagatgggtctagctggggtgctgctactgcctggactgctcacagtccagcctagtactgactccatatggtttcataccgggtatggacaaagtagtcaatgggctgaagtcagagcaatatgaatggtgatcaccaaagaggtgacacatatgataatctgcaccaatagctgtgtggtctatcgaggcttaaccttgtggttaggcacctggaaaatacagaagtggctagttggccactggcccatgtggggctaggccatgtggcaagacctatgggaggaaggatgacctcctatgaccaggatggaaacggatggtaacctgttgttgcatgccccaatgcccctaaaggtagggaaataaaaacctggcttaatgcataaagtaaattcgggtaacatcatcatggggtgtttgcccgtcataacctggagttgttgctccttgtattactgctgtggcctctgggtctggggttccaccctgtgggcatgtttctccatttaaaagactccttcagcctagggagtagaatttaaggcctatgtgtcagacctgtgtgtccagggcctttgtccccagagtgtacgtataaggcctgtgtcttagacctgtgtgtccaaggcctgtgtctcctttggcattgagggtggagtgtaaggaaaatggatgtgctgctctcaaaaataggccgaagcagacatccggtccagcatgactcagtgagtttggagcacaggctcacaactctgcacattatgtaaccacgccacgtgaggcacattaggtgatcacccatgtaagcttgtgcttggcttggagccactattgtctgtaaaaggtacaactacgctgctgacgctgtacatacatcttgcgctcatggctcatggccagagagagagtaaatccatgttgaaactgtctacagttcctcacgtgtttttccagctacccgccacttgcccaccaactccccttggacctcagttagaacctgacatctgacaaaatcaaatgttacaacaatgtgataaacaggtaaccctcatacaccgattgccagacagtaaactagtatagccattgtggagaggaattgagcatcgtatagggaagttggtaatcctcttactttaagatccagcaattcaacctctggtcacggacctcaaagaaactctccaaatgagaacaagcaaacatgacaagaatattcacagtagtactcattcattcatttatttattcatttcacaaatatccattgagttcactgctgtatttgcttgggatatctctgggactgaaacaattctccgtcttcattggtatgttccaggacactgcttttgggtactgaaaagtttaaaatcaccttaaccaccaatgaggcaacaaagtagtgtgtaatcatataatgaagccatgtaactcaaactgtgtgcctactaagcacacaccagaaactccaggaaatcacgacagctgtacactctaattttggacttgtttttgcatcagttttctgaaagattgtcatggatgcaagcatgttattattagtcattgataaaagagcacagaaagaggatgtgaggagagcccttttttccttagggataaaaccctttcatcttggctttcatgaaacccattaccaggcaaaactgatgcgaattcctgactagaagaaaatgttctcctgcctttattctctctcagatgactcccattaattgatcccaggagattttctcattttgctgccttccctgcatccagccttcatttaccatgaccatcaggcatctgcagggccttgacctggaaaagctgccaccattcctagtagaggatgaacataaattctcactctcagaaatgcaaatatttcccttgctgtggggatgcataacttcagagaaaagctaagcatatggagcaccccatgtaaattaccatctcatacaacaactcactgtaaccttatctttatttcttataaatactgtttgtaaagaatataaaaaattgaattccacatgcaagataaaggcacagccacaatttcagaatgacatctaatatttctgaagtaataaaataaatgtaaccctgtggaaaaataaaacatttaaataaaatagttacaaatgcaataggaaactaagaaaaattattaggatagatccaatgttacattaaactgaggacagctcttcactgtgctggcttcattacgatatttaagaaatctgacagttgcaataattagaaacatttaagtttccattccagctagcacagacaagcccttgacaaaacaataatagtggcaagagccaacaatagagcacttactgtaaaacagcagacattgtcctaaacactatacatatatgtactcattcagtcctccaacaaccctacttttataatccccattttgcagatgagggaattgaggcaaattgtcagttacctttgctaaatcagcacgtctcaacttcagtgtacataaaaatcttctgaatatgctgtaaaattgcaaatgctctagccattcccataacccactctgattcagtactgttggtttggtatagactgcccacaatctagtgttacaatctccattttcgagaggtctgaggattgggcttggaaaacactgctccaattacactattcccagtgatattcccatttatcttcaatgcctctctgatgtttgggtcattgtttccatgtttctgaagattccattttgtttcatttcagagtaagaatacttatttcgatccaatgaatttgattacctattctatgtccatctaaagtttaatcaaaacaaactatactgatatgtttacaccttaattatgtcagcttgaaccaaagacataagactgttgaagaaaactcatttctcttttcacaaggaacctctagtaagctggtgaacaccttccttaatttttaaaacactctaaataggaaaatctctggaatctctcctaaacagacatttgcttaagtaaggattacaactcttgaaggcatacatgaaaaattcagaagtttctgaagaatgcttggccatatcatcattcaaacgcacataaagtaattttatcagcacaattttctttcttcagggccctcataaaaggaagattctttgactcctttgcagagctataaaccaagagtaacatccatactgtaagaacagaggctgttagaaagatctcgagattgtgctcaactaaaaaaaattcattttcttattttcacagtgatgaagaatgattttatacaatgaaagaaacaagtcattgttttcttcatccatggcaatattctccctgtctttcaagaaagattgaaaatgtctttcagattgtagtaatttgaaaagttgtaaaagattgtaaaatagaggcatatttatcagatttgggggaataaattttttttgaaaaagttctcagatccttttgaaaggagtttaaattgaagtacaataaaggtacctgctctcttctgttacaactaaagccagccactcttagaattaaaaaaaaaaaaagcctcttgtttctggtttcatataaggagacataagtggcttcaatgctgaacaggaggtaacactaaaggggtgaacttttgagtcaggccatgtaccaaaatgaatttctaccccaaaacaatgggactattctaaacatgagccattggtatgctggtaaatatttatcagttggctctccaggagaaaaaaaaaggcctgatttgtgcagtatgtccatttccatggtgtaactactatcagcatgtcttatttcaagctaccaatgtgatggccctgaatgtggagttgggaagagatttgtagctgcacctcattatatagtatttccacgacacagatacgatggactacataacctcaagagcatggataatagtaaaatataatgaagtacttgggaactaatgagttttgagtattgattacctttgcatttcatataatttatttaattacgggtttatataatttaataatgcctgtgctttccaaccaggtctcaaaatcattgaatacgtaacagttagtactcctgagctggtactactacctggctccaggctaccattgcatgtatctcaccttaagcaaaccttccacaatactgatccacttttatacacatgcattaatgaatgaaattacaatattatttaagtagaagttttatcccatgaatacaagctaaggctttattaatacaactcaatatctacatattttatagcataacactatacatttcagtgttaagagatattttagagatcatctgatccaacccttcctaagactagccatgacaactattggggatgccatctttattcattctcctattccaaaattccaaaattaccactttatgcaaaaagccacattcaattcaaactctgctatttctcaagaacatccataatttcactcaactggtatttttcccataaaattctcccaaccagcatccaacataccaaatcagtggtattctcactatcttctgtaaatgctatgtttattctcccttctgaagctgtttcttccactctgtcacacattcattcatttgcattttcaaggtgtgtatgtttgtgtgtgttttaagagaatggtagactatttacacacttgttaaaatgctcactttttttaagagatgggatcttgctctgttgcccaggctggagtgcagtggcatgattgtggcccgctgcagccttaaaatgctgggttcaagcaatcctcccacctcagtctcctgagtagccaggtatgtgctatcatgccaggctaattatgtagagagagggtcttgctatgctgcccaggcctgtcttgaactcctggactcaagtgatcttcctgccttagcttcccaaagtgttggtattataggtatgagccaaagtgtctggccctaaaatgcccatttcaactacagaataagagtacctgagcaagagcatctagaaatctgctttgtaaacaaggacccctcaggtaagggtaagatttctaaagtttcaagatcaactgatttagtgagtggtaactaaatgctaaggtgagaataagagagcatgaaacacaagatcaagtggtttaatggatataaacctgtaaacagttacaactctgtgttttaagtacaacaacatagtggtgttcaagaccatcattaaagacaaggaacactgaccagtgaagggaaactccttcacaaaagaggggagggctaagccaagtgctgaagaaagttctcttttgctggttctcaggggtcaaggcccagagtggctgaaaatgaaattacatagagtctaaacaagggccttagtatgtttagacttctctaagatagaatttccattatttgcttgataagaatcacttgggttctatacaaatgtagatttccaagcactgtcctcttgtattagaggttctcatttagtaggatggagaagagctcagaaacccagcagttttaaccttaaagaaactgttataggagcaagggccacagagaagtcttactaaaatataggggagtaacactttcagatttatgttttaaactaatatttataagtcttgtctatttttctcagtttagatcgagtttagcacctagtgaatcttatctgattgttatagcccaaactgacctcttcattttatacatcattaaacttggagtttgaattatacttttacttatttcctgtgtattattatttctcttctattgtcaaccctgaggaatagaaagtttgtctctctgtattcttcgtaatgcctgatgcaggcataagaacacagacacaaagtaaaattggttctatgaattctcagtacgtagccctagtttttaggcatgttaatctggaatacaattttaaaagctaacatttaatgagtgcttatgtgctagggactactggaagtaatttacttatattatctcatttcattcaatcaacaatattgtgaggtagatgctagtattgtctccattttacatataggaaaattggggcttaatcattttccaaggtaggctgggtccagatcatatgccctttattaccaagctacactgcttctccctaccctgccccctaaaaatgctgtttaaacaatgaatagataaaagaaagcaacaatgagattataatcagtagcaataatttttgaaataattaggtcagagtcctgcataaaagatgctactataaactataaagcaatccaaattattctaaatattcccaggctgaaatctgcatctgccagctatgcatcattgactcctacctatgctcttgattaaaaatctcctctgtgtcttcacattcccaatgggagtcgcatatcaggagaggcgcatccatgggtgcagcaagagtgacaatacatcacagcctcgacatctgtgacaagcccagccttttgacagtctagtgagggggtgtgcatcttgaatattaccagatgtgtcacaatctttgttccccaaatacttactcccttttggataacaaaacagcagaagacactactcagaacaattaaaaaggtttgaatattcccataccctataattaatcttcattcaatcacaagcatttctgttcaatctattgcttgaaatgaaatgctaataaggcaagaaagcacaactttaggacaatgccaaaaatggccttcgtttctcgtcttttgacataaataagatgcttttgatcatattaatgagtgagaaatgtgcaagtctctaatacaagattcagttaaattacattcatccttggagatgaacaacctgaatttaaaaggacaatttaggctgaataaaaagtcaaagcacagtgcaactaaaagtttattctaacttaatttaaagtattctagaacctttgcaaatcttcattgtcacacattttcacccttttcctccagtagtttttttcccaacttctgccatttctttaattctttccatgttcctatgatagttatatttattctggatttcctatgtctttaaaaattgttttaggtgctggttattatctataagaaatctaaagtgagtagaatgatctgtctcaagacattaaatagaccttgttggggtttattaattatttcttatagagttacaaacagtttagagggcttataggtgaaacctatcataagaaacaatgttatatgttgaacatttaagctccttgtataccaggacattactaggaatttcacttgaatctaactgggctcagtatactcctatataccaaaagcctttattgttgaaggtgcatagtaggaattcagtatatatacatggaataaacgtgtttgccctttttctgttgttgaatgcttttggaaattcaaggaatgaatgtgaatgctttctgatttttttacaattgcttcattattatatagtcatggttcagccttctttataaactaataatcttactaaatgctttcaacactgatcaggatgtgactcacctctgtgtcaaatacagaaggtactgaagtcacatcaaaaccaaagcaattttcatccctcatattcaggtctagtggaatagaacaggaaaagagaatctgcatataccttcaatgttcttgggtgacagaataccttaaaaaaacaagtatacaaggcgtttcctaggacagtcaaatgatgaaatatgggcttcaatctcctgggtcctctagttttctcatgaccagtatgtgaatataggcaaattacctgaataactcaacatgttttcttacccatataagaaaaggagagtaaatacctcatagaatgtggtaaaactaaatgagacattacatgcaaagcatttaacacagagcctagaacagagtaaatgctcaagaaatacggactattgttatatttctgggatttggataatttttactaatgtggataaatacagatgaggcgatcctacaatgagaaaaacagaagttgtgatgtgtgagacttttcatttacatacaaacggatatggaaaatggattatggatgcaatgtccctgataggaatggcaagggcctatttgggcattatactttattcctgaatcatagaagaaatcctatcaccaaaatacccatatgggttttcacattaaaaaatatttaaacactttctttagagatgcattctgagacccacgtaaggagttgtccaaactaatattgaatgcatttgacatgacagctgggtttgaaaaagtgctttcagcaaaagcagaagccactggttaacttttctccttgtagttaattacattaaacaattttatcccaaaaagggaaagagagattaaaatccaggttatggagcattcattgaggttttcttttcttttctttttccttctctccttccctcaggtagcagaaaatcatgagcttaaaaagaagctgacctggcaatgtttcccagacttcttttattcttgacttggaaaaaggaaaaattgagggattgagggatggtgattttacttggtccttctaggacctatttgaagactcttctagagtcaggtgttggttgaggttcacagctaattaatcactggaaacctggagagaatagcctgaggtattacaataacctaggtatgaaggtttctacaccccaaatggccaaattgctggctacttctgggattatctggacacctgaatcctaaagaatatgaagtcccaggatcacttcctcaagatgtcaaattactctgatagagaaagataatttttatcttatttattttttcctttccaacctttattttaggtttagagggaacataagcagctttattacatgactaagttgcattttgtaggggtgtacagatcattttgtcacccaggtaatgggcatagcacatgataggtagttttttgagaaagatgattttcaagcaagactggaaacagaacaggtagcagttagaaaatacatgtttttgtttatttatacttaattatgcataaataaaagtgtaaattatgaagtcacgatgccagtaaatgcttttattggcttgtccacagatgtcctcccttctctaaccccctttctcccaaagtgggtgtgagtgcaccaccaggtggtgacataatgaaatgacacatagggcatataatgtcaggctgaggagaattttggaggttccaaggattgctggaaataactgcacaaacatggctctattactagagcttttgtgtacttgaggttttatttttgtttttgctgaagcccaatacaaatatataacaacattaaattgccatttatgactagaattttaaaacctaagtcaaacatactttcattgaacctggctctgcttttcatttattttgtcacacagggcaagttatgtaatatttttgaacctcacttcttcatccataaaattcaggataataatggctgccatgaaatagtttaattggaccttaagactgactatctctccaagattctttcctcttctccctccattccccaccatctccattgtctactttgttccttggctttacctttccttctggtttgcccgggggggataaatacccacttgtacatcacctcctcaggcagcgctgctcagcccatacctccgtgctcatgccaggactcatatagcctttagcctttgcattctccacactgtttagtgtcacttgtttccctgagttttgctcactgctgggcctgtagcactgggtccatatttctatgcatcttattaacctaggcattacacccaagatataaacacattgtagatattcagtgactttttgttgaatatttttaaagtataacaaaaagcctttgaaataccaagcaaaaaagagtacgtaaaagagcaagaggactttctgaaggagtatattcattgcccaaaaaaggagatctatcccttgagagagaactgtaaatctcttctactcagcttgcaaatacaactattaagatcaatggaatgcactgcatataaagttgatttatagccctggttctttgtaaatgttaatagtaaacctaatttgaaatgttatttaaaaagaagctaccatttcagtctaaagcatttactttaaatcattaaaaattactttgtgttccttctcattgggatctcttggacttaggaaacaatttgaaatcctaagggctttatttaattaaacaaactccataaacattaaagttagttgttttttttcatataaataacagataaggtccctaaaagattgattggaataaagaagacattgatttgaatcagtctctaaacaattatgtgactttggccaaattagtaaacttctgagtctcaatttccccatgaaatggttaagaccaccctaaggactgctatgagggttgaattattaatgcccacaccactgtgtctggcactgagaagggttagctctcttctttcatttcatccacacctactcttcaacatatacatttctctaaagtcaatgtgtttaattttttttaagttcaatgctaacaaatattaaatgcttcttttcccaacactataattttaacaaatgagtttcaggcatatttaaaaatgagtttcaggcattagatcatgtgaacataactaattatgtgaaacatttttgtccaacttctacataaatcatagcttcaaattatatggtcataagcctacaagatactcattgctatgcactgaattatgtccccttcaaaattcacttgtggaagccctaaccctttatgtaatagtattcggagatgggtcttttgggaggtgatgagatcatgagggtggggcctgcaatgatgggattggtgctcttataagaaaagacaccagagagcttgctctttctccaccatgtcagaaggcactgactgcaagccaggaagagggcccccaatagaacctaaacatgctggcaccctaatttcagaactttcagcctccagaattgtgagaaaattaatctgttgttgtgtaagttatccagattatagtattttgttgtagcagctggagctgactaaaaccctcatgtgccaacgtaatatcgttttagttataaatttaatattgatacaactttagctaaaggaataaaatctgtatgagaaacaatataacttttcaacagtatgaagatatagttcttcttattcataaacacacatatacacttgcatacatatatgtaaactatattttgaatatagaagatcaactatatagaagatcaactatatagccatctagtttaactcattgatcatttaattcaacagagttgagcgcctgctatgtgccaggcaatgcactaagcaccgatatacaaagataagggagatacattcttatcttaattgagcccacagcccaatagaggagaaagtcaaaacatacgatatataataaggtatgataaatgctccagattataactaacataatattaaaagttgttctcatactgtagaacggttcttccctaaaactgtatcaactccacctaaattaatccaacaatagcctcctgacatttttacttagagagactaatttagcaggcatctaaggcagaataaagtgtttacctcaacttttctatcaacaatgttagaagtggaaaatacaacataatttttgagtctcagctcctgtcaatttaaatgaaaatagacagttggttcagcatatgttgatttcttaaaatcagaaatagattttcccagcaatacgcctcagggaaaataaaatgtgtgggctggtttatccacgcattaaaagcaagcttccagctgatgtttgattacattcatgaagaaaaaaatattgtaatgagaacatccaattactctttccacaggagtaaaaatttctggtctgagaatttgtttcaaatcagtggttagaacataaacaaacaaataaaaaaggggaaataagtgagaatgagatcctcagaacagctactaaatttgagtaggcagagcatggtttctggagtccaaaagcctgtttaaagtcctgactctaatgtctactggtaaggtgctggtgggcaggtttcttaccctctgtgagcatgttcttttactcagcagtaacatggaaccaaataagacccattgatagagttgctcaaaagttcaagagaataatttgaattctctttctctcaatgcatgccatgtgtctgacctatgacaggctctcaatacttggtagacaataggaattattattattggaaggaagagaaataagaaggaacagcaacttgaaagactactattggcttcattgaaataggatctttgcattttgccttctttatctttgcatcttgtcttctttttactttctcttcacacacgtgacctaataataatagcatctgtagtaactgttgtgttatcatacagtagcacccagttttgtaggtcttattttacttaatttgtagtcagtaaacatattatccccatttgatagatgaggaaattgaggcttagacacgttaaatgtctttcccaggtcacacagtttggaagagatgacattaagacttgagctctgatctatcccgactctaaagttcatggtaatatgaacataatataaaagggaacatagtataatacaaaagaacataaaaataatacaacttatacaatgttaactttcaattcagccctccaatgtaatctgaaagatctttggtttgatttaaaaatcaagtcaaatctttgtatggcatttctcctgggaggctcaaacaagtaaacattctaccctgacgttgttctttccttttctctcctttcaagttattcaaatgctcagtaataagcagctttcaactgaatatggtggggcaaagccagctgctctttctccatgtggtagctcagatggacacctcactcttggtgttactgtgtagctgtactcccttaatagcctggccagctgtcttacataaacaattattcatgattttaaattattaataatttagaaggaaaacagatttcctgtgactatatggcacaatatagtacataaaattgggtttgaatatttgttttctgcacatcctctatagttataaaatgtaactaatgatttgtgtttaatttgtctctcaatccaattttggtagagcaagatttaaaataaatggctgtagatttcctaatttgatcagggactctcagttgttacaagtacatatgttatttcatataaatgtgaaaaaaatattttatgtttttatatgagatccacttcttatgcttataatattatggctcccagatgttattaatgtgaaagtgtttagagaatttcctctgaaaatgtcatcctatccctacacaacccaagattattgcaatagtttcacaaatgtcatggtttataaccttacatttatgaagaaactgttgacatcctatctttagagaatgagaaagaaagaggaatcattctgaacagaataattccaggaagcatcttggcctgacacataggcctgcctagactcggtagattttactaatatgtctttccaattcatttgttgactatatttagctttataaagttaaaggtgagagagcctcaatgtttaatatagcatctactccaatggttctgaaacactaaatcttctccttgagaaagtttgcaccagaccaacagaaagtttcgtatatttgtgattaagctacatttatcaaattagaagcacgattcattattctgacatgatctttaccatttttaaaatttataatagccatgattttatcaaaggataaatgcagagtataggatattttcaaaaatgagctcacctggcaaactaaaagtaggcagtgtaagtcgccacattccaaaaatcaatatttaaaattgcaaattccagaaacagatgaggtctgtagttttactagtggaaccactaatacagtgacttgagtatttttttttcacttagtatattttaactatcttcatactaagaaaatacctacgaaagtaagtctagaaaacccaatatcagcctgtcaatatttatattattcagagggatgtatatacatcttaatcttttgttgtattcctatataattctagctatatttaattctagttacaaattaattaaaaataccactcttaacttttctgggcatggggttgtaaccatgaaaccaacttcttatgccttctgaaaccaagtcaaaagtcagacaccttaaaaatgcagtcttttgtacacaaatgtacaaaatagccccagaatagaaacctaattgtgagtccttagataactaggactagaaatccttcatcgctacactcctggtgcttaggacaacagtgacaggtaaaggcactcaacagactatggaatgagcagattctaagagtcaatacttagggtgaaccttgctctatcacaatacttctcaatctaaatgatactgcagacctagtaatataatttgttccaagccggaaaacttcaggaatgtgcaagctggaatggggaagaaagaagtcaaatcctttatcactgagaagagaaaccaagggagaagcaggtatggagttccgatacgtgcaaagcttcgtagatactaaactggggacaaccaggttaaagtgaaataacattacagctatgtacaaaacatgtttctgcttccaaaccagggtaattaaaaaattagaatgcagttatttattttattagtattagctattagttgagatcaatttttaaactttaaaatgcagtcactttaattacaaacttttactttcagactcacatatgcacggaatagtggagagtagagacatttattatttaaactagctctgacaatgagattcatttaacaagctatttcagatcaaaacagaattggggactatcaatcagtttcctcattctcccctttcatttttggatcagctataaatagtcacaaaatgtgtccatttggcatcttctgtggcttccagggtttaatttcaacactccttgatatcacagaatcactttaaagaacagagaggttgcagatcaattattgtagtcatgtgccatatagactttgtgtgactaaccccagactatttgtctattttaataaaaggaggtcatgattgtgcagaaagtgaaaaactttttattaatctgaatttagcatatttatggtattatacccctaacataatagtatacaggtaatatcatctgatattttgtttgaaaacccttatgttatattgctttttatatctcaccaactaattgcttttctaatcccaccaaatttagtggtgtccacttaactataagactgtggctgacactgctgattgtatatacgatatccattctccctttcattcttatttatataagcctaatgttaatcacccaataatatgtctagttaaaaaaaacaagctcctcagcttccctggaaggtaggggcaagtatatgaaattgttcttgccaaagaacaggttgtcagagaggggcaaggtagctgggtttatataagctgaggattcctaagaaatccttgtttccctgatacagacaccatcccttcctacttcctttccatttctcttctttaccctggaatgaggagatagtgccgtgggagcagtatcgccaatggtcgtgagatgacaagcacaggacaggcccatatgctgaggatggctggcacagaagaaagaataaaaggaaatcacatatttgagggtatcatagaatcactgtactagccctagtttgctacctcctgatatccttttccacaagaccaacaaacccttagatgattcaaccattgttagttttctattgcttatagctgaatgcattttaaactgacaaaaaaagactttctaatgattttgcaataaagactttttagcacacctgccatacttttaaaacatggccattttgaaggagctggtgccagactacaatatttcaagcaaccgccttcttcctaagtttattacattgacacacattaatttaggttttgttggagttaatgtttccttcagtcatttctttgcttacaaaatactttttaaagtaaatatacacaaattatctaccttagaaaatgcaaaaaagcagatatttgtaagtcatctaagtcagctcttgcttcccttcctaaactattcattaatttggtgtaaagtgcattataactgaatgttgttcttgtatttcatggacaccagttgtcatgctaatgtgcacaaaaggttttttccagagtgaatgcatcaagtaaatcccaatcattgccactgcaaatgctgacagactaaacaaaattgctgacatcttccaaaatctgtctagatagatcactgctgcgcaaacatcattgcagttcctaatgaaaaagcaaataattcccatttgacatttatcttaatttcaaaataattattatttaatcatatctaaccatttcctatagttctcttgtaattcattgtacatagtgtgaatttcaataaaattcactttcctcttcctctgttttacctaaggattaaaaatgaagcaagctaacctgtccttctctgaaaacctgtacattaatctatgcttacaccttttgtaaaaagctatattttattattttattgttaaattgcactgtgaatttcaaatgtcaggagacattcacacacacacacacacacacacacacacacactcactcacgcacagagagaaaggaagagaaaacaaagagacagaatttcctccctaccaaaggggctttgttttgatcagcaagtttttttttggctcattgaactaaattcacaaattaacaaaactccactatgaagatctgatggaagaaggaatggaaaactcttgaccttttggatcccagtcccctgaccggcccttttcatcttcccttattaaatggaaatgatcagtatgagctttcagatttaggcaagacagctaaaagcaaaatcttgccttctgaaaaagatggtaaaggaaaaattggagctaattaaataatgaaatctgtttaaatgaacctatttatgccaatgaaataggcagaatcattcattatgtaaatatgacctttaaggacatatcacaagtaagttgtgaataataaccccatgaataattgagaattgatggtatttaatatttattaagtgactttcacatggatttgagttaagtaagtcaattccatgggcccagtgatggtatccatttaatgatttattcagcctctaaatatgatagtaatgttctgtatgacagtgagctagaaattgcacaatggagaattcaaaatgaataagacactgtccttgtttgcaaagttttcatgtggcaaatcccttaaggagaaaataacacttatttacaggatgaaaaggtcagctccacatagttgatcagcatttagagtttgaaataataattgggtgaggtcttgagggatggatttttattggtggtgatattaaaaagagagaatttcaagtatatggaaggtcaaaatccaagggcaatgaaagttcagaaaagtaatccttttgagctgggatacatgcaaaacgtgagataaaatcctggacagatataggataaaaccatgactttaaagggctcactgaagagtttagattattttgagaagtcagtcatggagacagaacaaatggatgagatgtagtataataagttccagtgtctcccataccccaataaggatgtacatgaattataatctaacaaaagagaaggaagcttggaaagtgttaggattctatttctttctgctttttctacttatgattacatggattagaatgttatctgctgtgctgaaacagagttgaaatgttactttaagtaatctggtaagtatgttattaaaatgactattttaccaagattcaaaaaattgaaatgtcaacatatgcctaatcatcaatgttgtttttgtgaatggtaatagcatccatattaccatcttttccttcctctttcttcccttcttcttcacagtctttaatttcttaattatttaacctttgtggatgagtattaagcatataagttagaaaataccaattttattactttttaaatgctgaaataattatttttaatgagagtattattgacaaccacttcttgttattactgaaagagtaaacttgagttttgaaccaatgggttaaggattaaatctgcattaatctaaatagggaattttaaggaattttttattccagagtctatggtatcataaacttctatttaatgaaatagattatcagaatcacctttcaatttcatggtctgatgtaaaaaaaattctccctgaaacagatacagggctataatcctcagattacacgcacacccaaacacacatacacaggtttgtatatatttgccacctccaacccaggtactggttttatttaaagcattcattttttttttcttaaactatgctcaaaccatggttgacagtttaagaaaagaaccaataggataaaatagtgtattctattcacagcaacagactgaaatagactcaatatctgatgttgaactttccaaatatatacagaaaattacatataagttataactcacacaactcttctatctccttattctatttgtcctaagaatttacaatagaatgaagttccttcaagtaagagacattacagtgctgcattgctgagacaagcctataaagaaaaggaagacggtttgattttgtctactgtggtctccttgtagccctggaatgtgaaaatgtacaaaataatctaatatctcataaacaaagtaaagtgggtttttttggccagatattttctagatagatatgagagaactgtcaagaagcaaaagatattaagataactccatgtattaaatcatttcgatttcattggatatgtcatggacttaaaaaaaattctcttttccttttgtaaagaaaagtcacagttaaaaaacacagaaagaaaagagtttggaaatgtgtgagggagagatgaaaaaagctctctacaactggttcagagattaacctgagtgagtccagtcacgtgcaaaggcttgcggaggtctagactgcaatgtctgtaattgaattttaaactggctttacatattcccagagagagcatataccatgatgtgctcatgaatgcaagccttaataggaattacatactttcacaagcactgtgcttataaaaccccttgaaccctattaatcctatattgaggttttatgtttcttctactcagaaaaatatcagatttatctattgcccataggatatttgttttaaagtgatacacttcagttgggcctgtctcctgaagaagttttgtataaaaattattcacttgaatgccaatggaatagttgagtacagaatcccattaatgtatcatagagtgatattgcagttatgaaacataaatcttaaagctgtgaatctctgcatataaacagattgggagtttagacttgagatgtatataaaggaatgattactaatgtcaaagaatgtaatttgaggaaatattttgttttctattaattgtattcaggcaatctgcagcccaaagtttgagttctaaattattcaccaactgccttgaagtaccatcaaacaaattctaagatgtgacacttgagggggatccttctgcctcaattttttaagtcagtggaataggactcttcaatatatcaaactctgaaattaaacaagctttacaaaataagaaagtgagaatggtacattttataaataacactgagattacatatcttgcgttattcaccaaaatatattttagatggaatagatttagtttttctaaatataaaaagcaagcatgctaagcaaaatatctatcacagaaacaaaacttttttttttcgagacagaatctcgcttcatggcccaggctggagtgcagtggcccgatctcagctcactgaaacctccacctccctggttcaagtgattctcctgcctcagcctcctgagtaactgagattacaggcatgtaccaccacacccagataatttttaaatatttttagtacagacgggatttcaccatgttggtcaggctgatcttgaactcctcgtctcaaatgatccatctgcctcggcctcccaaagttctaggattacaggtgtgagccaccccatgcctggccaaaacaaaacttctttacaataaaaatttaaaaaacaaaaaacaaaagactagaaatagttgcttaaaataaagagtcaaatttatgtgacaaaaagaaataaaatacatgtataacattgtgcacatgtaccctaaaacttaaagtataataataataaattaattaattaaaaaaaaagaaaacaaaccaacagataaacattgattcatcaggtagatattgaaagattccagcagagagttcaagcaaatggaaatataaagggtaaacaaacaaatggaaaataatattgagatagtattttataccatctaaagacaaaacatgttaagaaaattatgatattcaatacagctaaaataacagaatattctggggcactgtaacttgatataaattcctttgaaaataattcttacaattggccgggtgcagtggcacactcttataatcccagcactttgggaggctgaggcgggtggatcacctgaggtcaggagtttgagaccagcctgaccaacatggcgaaacactgtctctactaaaaattcaaaaactagccgggcatggtggtgcacacctgtaatcctaggtactcggaaggctgaggcacgagaattgcttgaacccgggaggcagaggttgcagtgagccgagatcatgccactgcactccagcctgggtgataaagtgagattttgtctcaaaaaaaaaagaaaaagaaaaaaaggaaatgattgacaaaatataggagaaatcatgaaagaagcaatcagttccacagaggttaaaaggtatgtgcaataaagatgttcacagcagcattaactataccagtaaacacctggaaacattccaaatatctaacatttgaagaataattatttcaaaggtaggattataacggttttaaaattttcttctttgcaatttttggaggcagtcttcaaacatttaatacaaaagtattactttggtaatcagaaaattacctgttaacaaatatttaaaaataatatgtgcataatataatatgaaaaatgaatataaatgtattaggttacagatgtttttcacagcaatgagaaattactaaggaaacgacttaatactgttatactctttgaaattctctttggtaattctgcatttacataataacatttaattaattatagcactattgtctaattgagtacaatgactttgatgacataacataaagcctaggcttttaaagtcgcattcctggaagtgagggcatttggaataatctttttttaaaaatgttaaaatgttattttatgactattcttggttttgtatagtttctgatatattacaaaatgcctttcggtatgtattaaattccctagctttgtttatagtagggtaattcatgcgtattggacaggcccctgaaatttttgcctagaaatcagccatgaaatttgaaagaaaaaaattgtgacctgggcaagttccttaatcttactatcattttcaatatttgtataaagaaagagttgacatacataatttcttagcaatctaataggccacggtattgtgaaaaacaactttacaaatgtaagaaattaataacataatatttcattaatcttaaattctcacagtacagtaaaacatattgttagtcttatctataaaatttcaaatgtccacatgaaaattaaaaacaagcccatttagattttgcaaagatctgaatgtttaatattatttttatatattgctattgacccaatgtttaaatcattagctggatttttaccattttcatgagtataaatgaatgtgtatatatgtgcatatatgaatccatatagttatgcacattcacatacatactatatataatcaacataacatatagaatcaaaatattatttgtcttttgacttcccggttttacaaaggcagcattagacaaagctatatttctcaaaacacatttgtttttcaagaaaaaatatgcagagccctatttttctatcagttcgtattatacattaaagatttattatgcacttgctactgatgttaaaatactttaaaattcagtgagcaagagatactgtttctatggcatattttgcttcaaatatccacatgcataaacatgaatagattgtgggacaattattatttaaataaatgtctcaattttttatagacaggctaagtgatacatgcaatgctcagtaatacacgcaatgctgagcaacacatgcaacagcatacataagctgacatatttgtaccaaacatcacatttgtcatacaatgtattctgttgtcagatttgcagaatatggggcagtacaatataagaatgacaaattttgaacaaaaagagttcctttccccatgaataggacagagaaaagtggtgtaatatttattataataaatatcttagtaaaacatataaaatgcaatcatgggggggaaggcagaattatttgttttccaaagtgcaaaaaggaactgtctcttttgaatacacacctattcaagaacatactcaagaaaagtaaacacataatagtagttacctctgggtgggaaggaaaggtgatagaattggggaagggtacactaggggccccagttttacctttagtgttgtatggtttgaactctttgatgcataaatggctacactatcatctatttttacatgcctgaaatatttaatattttaacataataatataaaatatatttctatactctagagtatatttatctttaatattctataatttgtaaaataatacctattagtttatcattcatgttcattctaaacactacgcatacttcttactcatttctttttatccttttcaatctgtatcaaaatagtagagctttacacaaatttttatctaaatatcatctttcaattattttcacagtgattaaaaacaaagtttaaaaaaaactagaaaaaaataaaggtgaacattgacctgagggtgaggaaagcttttatatgaatgaaagtcatagatcaaattttccaaaagaaaagtgattcttttgtctatagttgtatattaaaaagcaatgtaataaattagatggcaagcaacaaactgagaaaaatattttttccaaaagtgtgagggagaaagggctgggtgcagtggctcacacctgtaatcccagcactttgggaggccaagacaggtagatctcttgaagtgaggagttcgagactgacctacgcaatatggtgaaaccccatttttactaaaaatacaaaaattagctgggtgtggtggtgcacacctgtagtcccagctattcgggaggctgagatgagaggatcgcttgaacccaaaaggcagaggttgcaatgagccaagattgtgccactgcacttcaccctgggtgacagaatgagactctgtgtcaaaacaacaacaacaacagcaacaacaacaaagacaggaaatgttaatgtctcaataagacactaatgtacaattcacaatagaaaattcttttacactataaaaatatttgcagcctcaatgttaatcaattgagataaattagattttatccaacatattaattttataaatacttaactataaaaaaactcaatatttgagatggtgcagtgatacagcgatacagcagtgtaatacgctacaagcacactgctaacagtctctgaaaagcagaacacgatgtcacctttaaaatgttctttaactctatacatcatatttctgagaatgcatcttaatgcaccaatccaggattgaccttcaagtatgcttatcttaaaacaattaaaaacagccaatgtccaatatgaagagaatggttgaataaaaggtaggaatataaaatcatgttatagaagattatggaatataggatggtatgaaataacataaatataaatctcagtttactatttttaaagactaagtattaaaattctcattggaagttgaaggtttgaatcctaatcactccaacactgtacaattgcattataaaatattttctttacacattctaacacaagagttagtgtatcactagataaaagttccatatgagttatttataaaagtagaaaatactttattgctgctggtgtcctgaaactgaataataaattcatctataaatcatttagtaccttaatgtctgtgggcccacttactgtgttaagtgcagaaaattattaacagtctggactttctaagtacataattttctattgtttattctttgttttataaagtgcccacatgttcaaaatatttttgataatgaccaagtagtctactttcttgatgacctggaacagtcatccttttttttcttgctggtatttttgttctaaaagggaaaagagtgtggaaaaggataatggattactttataagcattgtcttgacgacttggcaacaataatcaatactcaaaaacttttaagttcttaacacatttataccttgtaaataggggcacaatcacgtggaattcataggcagtttgcttttcttgtaccatcactcaattttttgaattaaagattttatatgagacttcggaattaatgatacaaagatgcatgaatgaaaatagagataaacccaattgtggaattaaatatacaatcagtagctaagaacaaggagataatgatgcttcagcaatcttaggaattattcaggtaaagaggggcaagcacagcactttgcactgaagaggactttagagatcaactacccaacactctccttttaaattagaggaaactgagcctatgaggatttaagtaatttgcctgtgatcactcagctaactagtagcataggaggaacaacaataaaggtctagatttacagtaaatttatctattaattcatttctacataactgcttcttgcattcaatgcacctagtgtaagtcaaagtcaggtatgcaatatggaaaatggtttagtctctttgtactccaaatccaggatcaaaacaacagaaaaataccagaaagacaaaaacaaaacaaacaaacaaaaacctcaagagggcactgagcagagatactgaatcaatgacaagctcttcccaatctccttccgtccccatccccaaaggctctgggtcagactaaaaagactactgaactacatcaaacaatttgtgtctatgtcccacattttcctaaatgtgtgaccttggacacttttctgtgccatcctgaacctcagttttatcatctagtcaaaactcaagatgatctctgaaaggtcccttcttcctatatgtcactacgcaggtgaaatacaccaggatttgccctgccttgtctttctgttctttttaaaacccttcgtccagtcaataagcccagtttttaaaaattcttgcagtttctattcaaaagaaaaaaatctaaagggtgtgtctaataacaagtgctctcaatatgaccataattgtactattgacattttggtgtttcagggtaatacaatttactgaaaaagaagaattaactctggctatataaagttgccgtatatttatttaaaatttcacgtattttcttccacaaaacttgattttcctctttcaaatcataggatatgaagaacttttcattagtaacatgaaagctactgactacatgtctaaaagattcatctttatttacatatctaggttcttctcttttaatcaacctgaaattacgtttttctagtagttaaaactaaacattctcttagtaaaatacagaagataacaggagaagaaaaagctgactatggaaaatttttctaactgtatgtcatctaagtttaacggtaaacttctagtagtctctcgggtcctaaaatgcttcaaatgaattcataatctgaatgggcttttaaacaacattgggattaggagtctggccctaccttctctggagcaaacatattgttgagaatggtttgcaccagaaggatcttctatcaccagtattactgttgttgttactgatatcaattatcatcatcatcatcatcatcatcttcttttggggggagggtagggtgtggatggagttttgctcttgtcgcccaggctggagtgcaatggcgcagtctcggctcactgcaacctccacctcccaggttcaagcaattttcctgcctcagcctcctgagtagctgggattacaggcatgcactaccatatttggtgaatttttatacttttagtagagacggggtttcaccatgttggtcaggctggtctcaaactcctgacctcaggtgatccacctgccttggcctcccaaagtgctgggattacaggcgtgagccactgcgtctggccatcctttttgcatataatcatttataaagtacataccccacaaattatcatgtttagacacatggacaaccattctatactattcatgcatgttatttattcctatttagcaagtgagaaaaccaatgttcagaaggattatgagatttactccattttatatccaaaatatagtaaaccaggctttgaacaaccctaattctagaacttcttttatctgtacctcaatgtggtaagcattatgtgatgtaggcacaagggttttctattttcataccaggtgtgcagtaatcaggcattctaaatttagcccaagaaacacacttaggtaatgccctgaaacagtcattgctattccttatctgggaattctgttatcattttgcatttgcaaaaatagtcattctataatatagaagtattctttcacattggcctcccacattgctggaaacatttctttatatttactcttcccccaaaaaagaatgagtgggaaacatagttaatatttattttgaaagaaaatagggcttaataaagggaacaattacatatttagtcaaggtagattaatagctgaggtttaccacttagcacactgcaaacaaaatctaacacgatactattgcactaatactagagcaatcattacaccagtaggtgtgccaaatgtggaactcaataacaaagcctacttaaaatgatcaagtattataagttagtacatgatcagtgattattctataaagtggggtttgggaagctaaacaaaccctaaattttttccttattcttcataatcaaaacacattacagatagacaaaagttaaatataaaaaaagagagcccccaaaaaatggtaaagtaaaaaaagatttaagaagcttaaaatggagtcacatttctaaacatgacataaaagcacacagaggaatgactgttaaaccttgatctattcaaaacattttagaaacaaaagattaaataactccaccaaaaaatgagtacataacttgaacagacatttcttcaaagatgatatacagatggccaacaagtacatgaaaagctgctcaacattactaatagagagatacaaatcaaaacctcaataagatataatttcatgcccattaggatagctactgtaaacacacacacacacgtaagtgttgacaagaatatggagaaattgaaccctcgtgcactgttgataggattgtaaaatggtgcaaccactatggaaaacagtatgaaaaaatatattaaaaatagaactatcttaagacacacttagatatatatcccaaaagaattaaaagcaggctcttaaagagacatttgtgcaagtttcttctctcaaaagcagactcatattgtacaagcccatatgactgctgaacagagtccaaatattctttatttcctttcattgagcactacaatcatcactcaaatcattacacttcaatcagcctgacacagaactgtgttctttaggactcagtagagagtactatgtaacaatgaagatcagaaaatgtctttggaagcatggaaccagacaaaacaaaagatgacagacagatcgatagatagatacagatcgataatagatccatagatagaatgcagttaataaggtgatttatataatctaaatgcttaatgtcagcttgttaaccaatagttcctcactctcataaacagtgtttgaatacatactgccaattgtttatgcctgctcaaattcttaccagtcctaccatctgattgacctgtcaactcaatctctttaaaacattgcatcttagttctgatgcattaagtgtagattttgtatgttaattcataatggaggaatcttatttctctgattttgacatctcttctttcccactgtactgtatgcaagcagtatagaacactttggagttaattgtgactgtaatattaattctagacaaactacaacagaagacacatcatggcagaatatactttaatattcctatattgtaacccacaacttttgatcactttacaaggtcaaactttgttattgctgagcatcacagtaatccaatgactataacaaaaagctgatgaccttaactttccaggtggccctagtataaagcctgactttgatgtatctaaacaagcacaaatatagaactcatcatgaggtctattagaatcataaaatcttctgagaggaagctatctagagccaccctgcttaagagatttaaaagcagacagatcaaagcatgtgtcattgagaatcctgctggttgtcatgagagaaggggtaaaattacaaacccattcagttgtatccattactgtaatgacctgaaatagactagaatgatgaaaatgaagggtgagtagcattgggtcataataatagtaatcacatatcatgtgacagtagtattgaatttttcttttgtacagcaaagacagtgttgtatttttttcctggatagctatggtaacaagctttatttctgaatgcctgatttcctgtctatagacccacacatctgagtaatatgcctatcccaaacattcattgtgatatcaaggatgagtcaaaaaacaagatggacatatgccaaacaattttatgtgaagggtaaaatctgtatttccattgattaccaaactgaattttgcacaggtaaaaagcaatggtgtcacataatcctgcatcttatcagctttcacatctcatgctttcttcaatgaatatggtgttcagattatatggttagggaaagaagaggctaaaaatgcctacatatctagcatgctgaaagaaaaagtctagaacagaaaggttctcttttcaggataagccagtctctagaagttagagcttaggacaatctccaggggaaaaattctcgggtgatgctagttataattctatgctccatggagccttcaattgactgtgtatttcttagagttctccctttaaaatatatttctcttcaaattgacgctatgcctcttttaaatgggccaccctgtatattctgaatgagctttttccagtaaagaactgtgttgatgtaaatctacgttggcaagagcgtcatcagagtcagctgggagtgacaggcatgttctagccaattctggacagtgtgttgaaatatgcttcccaggctgcaagagcaaatgcacaaaagcaagcccacgtcttgacaggggtgacgtgctgatcagcaaagccctggctctgtgagaacataaaatacgcaccaggagcatttcttgaggagaagccaaccaatcaatcacagcaagagccacataatccttacaggttaaaaggtgccagagcttacccttttccttagggcaaaaaaaaagaaagaaagaaaaaaatgtttgcacatgttgcttgcagggcgcactcctaagacacagaagatcgtatttcctaataactgccagccagtacaactaatataaatatgcaagcaggcagtaagaaccaacaattcaaactccaaagagaaagctatacatttcatatttgttttattaacaattatgataatgaaaatattcctgtataaatgttaaaacctggcatcatcttgtaaaagtatttcatgccaacacataaaacctatttatttaagaaaagcaatatcattgtgataattatgtgtataaactgttgtgacaaatgcaatatatatattttttcaaaaatatttttcagttcttcaatatctaggctgaacatcatattcaagaacaggattttgtgtccaaatcatggaaaaaatggcaatttcatattagaaaatctgtgccagggctatacatctgcaaactagcaatttcccaattgtttttctgtatcttctgtcatctgtctcattcttggagcatacacacacggccaagatgtgagaataatatgactttaccagacaggaatgttgaagtgaagatgactgggcagacctggccagtctggtacccaccacctctcccctcaatttctataaatgcagtgaggatgaattactgtttctggaactaattaaatagaccaaagaaaccggccatcccagcagaggagtttgtgcttgtctgactacatggtcttaaaaccaaggtccttgtcttgaatacacaaccgtcaccacacaaagtccaagactgccaggtcattgctcatcaccagatggctctgtaaatcccctactttgaaatccccagccttccccaattcctgcaaactcgccagcgtgactcctagcgttcagtctgtcatcagcaaaatctccttatgctcctgtatcttcagcatgttctctgactttcctgcaccatcttgctctgacactactggctgcccaccgagaatacggatttacttcagccctctgatgcagtggctatttttccttccacatgtttgtacctctgcccctagtgaagtaggagtctttctcattcttctctgctgcttccagaccatgatctcttccttgccctaaaatgtctttgtaactcacatcattaatctgctcccctcctaatccagttttctactgacctaaaggtctctcctctcagtctttaaacattttagccctgtctctctccagcgcaaactcttacataactcataattatcttttcctcccacggtctcccagtttctggatctcccttcagataatcttacctgaaacctcctttccttaccataagcaaggccttgccatgacagataacggtgccccataaccactgttaagcgtctctccctaccttctctctttctagctcatcccctccagtattctgactccaaaaatcttccaaacccaatgagtcctccagtgcattgaccttagaagttgttctgaccctcaccaaacttatgtccccttttccttagtgagcttagagtaaatatggcagcataatcacttctttgcatatccttttaaaactcagacttcactgaaatatctcatctctgttaaaccaacctttttcaaaccgtgcttgttgtggcctaagcagtcaatgatagttgaggaaaaacacaaccatgatgactttgaatttgtaactactggcctgaggtggctccttagtgccgtctgggaatttcacatttctctagacaaagcactctctcctcccagagatgatggatcatttctcaccttctctctcctcaaacctccaacatctgttctctgtctttacattgatgagcttattattttatcacaaaatagaaggaattaagagacacttttcatacactctgaaaccagatctatcaagatactgacctcctatactctcagactgtcctactcttctttctcatttattgtgaggactgaacaatcagcactcccattaagggcaactccttggcttgtgcactatctgaacttctccttacccctattcccccaaagcctcctcaagaatattgctcctgcaattgtccccagtttctcatgatcaaatgtcccctttctgctgcttctttctcaaaaccacacaaacataatacaattgacaacacaccctttgcccatatctcatttttcttcctatcccctccaactgactttacaacaaaactccaagagttaacaattgccaccacttcttttcccatcatctcttgaatccacttgacttagtccttttataaggaggccttcacctccagatactcacaactttgagtagtcctctctcacactgtaccagggttggcacatgtgagcagaagaatatggcagagtaatagtgtgttgctgccaagtctgggtcataaaagtcgttgtggcttctactttgcactctcttgaatcactgactcctgtgcctgaggtaggaacacccagccatcccattactgggtacatacccaaaggattataaatcatgctgctataaagacacatgcacatgtatgtttattgcagcactattcacaatagcaaagacttggaaccaacccaaatgtccaacaatgatagactggattaagaaaatgtggcacatatacaccatgaaatactatgcagccataaaaaaggatgagttcacgtgctttgtagggacatggatgaagctggaaaccatcattctcagcaaactatcgcaaggacaaaaaaccaaatatcacatgttctcacttgtaggtgggaattgaacaatgagaacacttggacacaggaagggggacatcacacaccggggcctattgtggggtggggggaggggagagggatagcattaggagatatacctaatgtaaatgacgagttaataatgggtgcagcacaccaacatggcacatgtatacatatgtaacaaacctgcacgctgtgcacatgttccctagaacttaaagtattaaaacaacaacaaaaaaaagaacacccagccctttggagaagcacaaacagtgaggaactgaagtcttctgccaacagccagtgtaaagcaaggctgcctgcggacagcaccatcttagaaaactgatcttccagtcccagatacagcttcagatgactatagccttcactgacaacttgagtgcaatttcttctaggaactttagtcagaaccagccagctaagctgctccctgatttctcagaaactgtatgcaataataaatgcttgttggtttaagcattggggaaatttgttatattccactctagtcagtcctgtatcatcactactctactgatcgacttgtgttgtatgccaccaattggctgcatgttgccaatgcaatgatcaattctcagttcttattttagttgacctatgagcagcatctgccacagtttatcacttttctgttgttgttgtttctttgtttttgagacagagtcttgctctgtcacccaggctggagtgcagtggcatgatctcagttcattgcaacctctgcctcctgggttcaagtgatgattctcctgcctcagactccccagtagctgggatcacaggtgcctgccaccacgcctggctgatttttgtaattttatttgagatgaggttttgccatgttggccaggctggtctcaaactcctgacctcaggggatccgcccaaagtgctgggattacagccgtgagccaccatgcccagccacttatttctcctgaaacagtttgttcatttggcctccagatatcactctcaatttttcttcaacctcactggcctctctgctgagttttcctcattttcctgatttctagattttaaagtgccccaactgtctcaggtcttttctctatatatacttgctccctgggtgattcattcagacttatcacttttaataccacctacattttaataactctcaagtgttcatctcaagtgctaatctgtgctccaaacttcagactcatacattcagttatctaagtgaaacctccatgcagaaatctaagaggcatccccaaaataaattttttaaaactaaactcctgatccacctcccctaaaaatgctccttccacaatcttcctcagcttgacaaatgacaactacattctacctgttgctaagtccacaaacttaagagttattcttgattcttctttctcactcttcacatccaatgcatccacaaattctgttggctgtgtcttcaaatggtagacagaattatgaccttttttttttttttttttttaactacttttacctctatttctctagtccacactgccaatacatgttacctgggttacttcaatagtttaactggtctctgcttccattttccccacatctttactttctacacaggagccgggatgattcttccaaaacttatgatagactgtgtcccttcctaacacagacattcctactactaacactttttgcttcaatacatcacagtcatcaccaaggaatgacccaagtctttactacaggctcaaagcactatgtgatctgatgcctttctgtggctcctacctcattttctataacttcccccctccctcaaatacgccaaccacatttggcgtacttgaaatcacaatgaaatgtacttctgctggataatcatatagctcgttcagtcatctctttcagatctctgctgaaatgtcttacatacaactctgtaactccttaccctgacttattcttctatactgtacttgtctttctctgacccactggaatatttatttgtgtgttgtcttctcctttattagaatatgtgctctttagcctgatgcagtggctcatgcctataatcccagcactttggaaggccgaggctggagaatggcttgagcccagaagtttgagaccagcctgggcaacatagtgagacccccatccctacaaaaaataaaaagttatctaggcctggtagcatgtgcctgtagtcccagctacctgagaggttgaggtgggaggcctcttgaacccagagcccaagaggtcaaggcttaggtgagcagtgatcatgccactttactctaggcggcctggacaaaagagtaagaccctgtctcaaaaaaaaaaaaaaaaaaaaaaagtatgccccaatgtatggaagactgtctatttcattcagttctctatctccagaagaacaataggtacacaggaaacactcaaactattttttgaatggatgaaaagaaaataggatatttcactcctgactctcaccttggtgagctagtgataaaatagagaaaattaccttcagagtaagatggttttctgtgtccagcccctcagaactgctagatgtgttctaagaattgtatacttttgcaattcagtaagaaggaaggcacagtcctcacgtaaataatgcctctgttctatgcatcagaacacaagtgccactagtagaattaacacatctgatttgaatgaaaacagcattgtgtatctatttcagaaggattatcttgggaaaagtagaagagcagtagctagctgaaagatggtatagattggtctaattgaactgagtctcaaagtccaactattgaaagtgttcagtgcacatacttgtggcttagcaagcttagcatggggtaagaactcaaaatgtcacttcctgttatgtggagtgaagctgttaggaaagataacatcatcatgtttcttttatacatataaatccctggtgtgtgtgtgtgtgtgtgtgtgtgtgtgtgtgtgtgatgtgagagcgagcgagcgagcaagcgagagcaagagagagagagatgttagcaatccttcaaaatctgattccaacctaccttccctagaggcactcaaactcacctaaaccccatgtaatccccatatttgttcacactattcccttggtgagaaaacacctcctgtcacttcccctccttccacacttcactgcagttctctccctgctgaaatctcccatgcttcacattcatatcaaattccttcctaggcccctctctctttgtgaaatgtgataataaaacctaaacctaatcaagttgcagtgaatattcaatgagatcatctaagacaatgctcagtagggtgcctgggacttctctgtgactatttcatctcactcatgaggtcttaagtgattcctagtaccagatacaatgtctccctcccataaattccaaccactctttatgcttagttatggcaactattgttttatggttgagtaatcatattctaacacctgttaggtcataatccttgagaacaaagacaatgccccaataacatcccatatagtaatttgtacagtgtagacagagtatgtgagtcaaattaagcttctagatttcaataggctcagatcaccttcagtgttctatcaattgtatgtttaccttttatttgaaagtactactgtctttcaagaggtctttttgttaaatatatcatttgaacttctaaataattttatgaaacatgtatgaattagtaatagttccacttacagatgaacttaattgtgatttgtggaatttaaataaccctaggatcccacagtgagtagcagagttggactatgcaatagattcctgaacctctttgtatatcacaagactgtgctaggtgctagggatacacctgtgaatgaggtagaactggttctccccttcacaaaatttactccctagggcagtagttcttaactgaaaacaatccctcgtcccctacaagggaaaactggcagtgcttggagacattttgaattttcacctcatggtggaaattaatgtcatctagtgggcagtggccagggatgttcttaacctcctacaatgcacaggagagcccccaccacaaagcatcattctggcccagtcatcagttctgctgaggttgagcaaccctgctctagattcggcttcaaaacgaaggatgtgaagtatccataggacacaataacacatagggttgcagagataggtgcagaactgatgacagatgcttagatgccatgttaaaggtgtgaactttatcctacagggcagggatcggcaaattacggccagtgggcgaaattcagcctatttgtttttgcaaatacagttttattggaacatgctaatgtccatttgtatatctgggcttcttttgcactaccgtggtagggttgaatagttgccccagagaccatagggtccgcaaagcctaaaatatttattttctggtccttttgttcacctctgctatagatagtggacaatcaaagcagaactgtagggtaattaatgagacagtataagtaggacatccttagtgggaaggagctagtggcacaaagacaagttagaatgttattgaaatagatcaaacacaaatctaagtattaaaatacctggtggtattgggagggaacagaacagcaagagataataggtgaaataatccataggcctaggcagaaggagggcaaggcagaagtcaaatatgattttttctggttttttgggaagataatggccagataaacagaagtagaaaaatcaaaaaggggggcacagtaagcttggttttgtgcgtgttaaatataaattaagagtggatcttccacgtggaaatgtccagaggaggcatatggaacttgagcctgggaaatgaggtttaagagtagggtttattaaaagagctgacagttggaattgaacagaggagagacacttgtggtgcagggaacatactgaataaggtcaaaggaataattatgtaaccgggggtactttcaattaaggtgctggaaacagagacaatgaaaagaaaagggagatctcatatgaataaagttaatccagtaaatgagacagtatcaacaaagagggatgagcatcaatttcaaatgctaataatattttgccatgactaatactgtgcatatcagtaagtgactttaaatgcaaaggcaatgctgctttaagtttgtttgtgtatgtacgtgttcatttgcaaagaaaactctcaagatgaatgtaagataatgtttctctttaatttatagctggtccaactctgacttttcttggaacttctgtttttttacttcaacgcatatcattgtcttctgaagtttctatcaacagtgtaaaatgaggagcttatgaataaagatgttcttttaaggccaggtacagtggctcatgcctgtaatcccagtactttgggaggctgagacaggcagatctcttgaggtcaggagttcgagaccagcctggcaaacatggtgaaaccccctctctaccaaaaatataaaaattaggcgggtatggtgttgcatgcctgtaatcctagctactcaggaggctgaggcaggagaattgcttgaacccaggaggcagaggttgcagtgagctgagatcgtgccactgcactccagcctgggcaacagagtgagactgtctaaaaagatgtccctttaagacagtttctcaacgtatggcttccacatcacctgtagggcttacaaagtcgactttctgggcatcacatcagacctattgtgggtgcagggctggcttcacaggtgtgacctatgaagttatacaggatcctactctcagaagggccttgtgctggattgaatgcagtgctgttgccatcatgaaatttgtaatatttatttgcgtaacgggccctgtattttcactttacctgggccctacaaattacgtagccagtgctgtgtgagcattctagcatggaaagtaattagtttacagagtaaaaaagattacagggtagaaaaatgtggttccttacttagctctcatttatttgcattgagacatactttttaaaacacccatgtttacactctttggaagtaaaacttggaatctaccattggcaggtacagaattttccacagaacattttttttttttttttttttttttttttgcatctgtgcagctaccaggtaagaacttaataattacagtgtgggaaaacagagtaccaacatactttctgcttagggattagcatcacccaatccaagttcagtgtgtttacctgcaactaagggattgagaacagaagaacttctgcaagaacaaatgtccctcttcctatggtggaagtatcagtggttcaggttggtatattagatggtttgaggttgtacaaagatggtgtttggcatagctgatgtggcttattgaattttaaaatgttgaattaaataaggagaagcttatttcctttccaaatccctttcagtaattcttattaccttaagaagaaagacttaattgtggtctttcatatgtctatattatttgctaaatgccattttaaacagagaacagacctcaggctcagagtctttggaaggtcatggttatctagctaaacttgaatctattttgccttgtttattgtatattttttcaattatcttctatgcataataaatgacgctagttccaaattacagtaatatacaaagctttatttttaaacatatggccttttaaataaaaatgtaagtctactagaaatattaaatgtaaacagtataaatggcccacagttgcacctaaaattgtgaaggtgattcaagaatgatcaatgtgttagtgaaactgctattcttattagtaagaaggctttattaaaggaagcctggttctattcagaggagaactgtagaaatcagccttgtgcattatcagcctgcaattcatatatattttagttattagtatccataaatcatacgctgttctatttggcaatcactcaatagaaggtcataaaaaaaatcacactgcacaaaataaagcaaagtaaaacaaatactattaacctaaagaaggcaaacaagcaggaatgataatccaagtaatcttaagtcagaaagttgcttgcttcaaaaggtcaacaatacacacttcaccatttataaatgtgaaattagccatgtatgaaaaaaaaaaaccaaaaaactggtaccctactaataacatgaagaggaagccactttattttaataatagctaatttaatcagagggttatctcaaaagggtaatggggaaaaattggtctcaaattactgcaatttaaaaatgatatatataatatttaactgtataaaaatatttatattaaaataatatttctatgctaaaccccttcaaaaaggttttctattattttagttcttctgaagatctactttggaaaaatggtacttaatttctgccagttaaaatttctccaaattaaaacactgaaaatgaaactatgaagggtttttttttgcaaatttctcaaaatcttgacatttcttttgtaagcttaggtcttgatatataatttaactgttatgaattctaaaagataaggattagtcatcagaatttaacaagctagttattcagtaatttcccaagaatcatagatacatttacacagatttttttcagaaatataacaggcataaataattttcaaagtataagctaaatattaaaatgcatgtatttgacaaattattgtgacagaataataagatacagaatcattcatatacaccaaagccaactataccaatctatgtgcatgtaaacccaaaacatacacacacacacacacacacacacacagagacacacactgagtcatggtgacaaagtccacacaaatggttaatcattgagttcaaagtttttttccactatggcaatcaaaaccaacatcaccaggacttctagtctggaagggtatggatccccctgggtgttcagcataaaagacacagcaacagaaggtatgtttctcaatcgatcaaaaaacaactatttattgaatgtatattatacaggtggcacttgtaccttcacagtggatacaatgattgatgaatgtggaggttcttacttttttttttttttttttgaaatggtatctcctctgttgtgcaatggtgcaatctcggctcaaagcaacctccgcctcctaggttccagcgattctcctgcctcagcctcccgagtagctcggattacaggcatgcaccaccatgcccagctaatttttatatttttagtagagacgaggtttcaccatgttgaacaggctggtctaaaactcctgacctcaagtgatccacgtgcctcagcctcccaaagtgctgggattacaggcatgaactaccgcacccggccggttcttactttttaggaacttacagtccagctacatacttgaaatacaaacatgaactagaagacagcataacatagaaaatgacaaataaatgtcaacacattcagtctgagagcccaaggaaagaaagattgcacccaatgaaggtaggtagttttggccctgtatacatttgcttacgaaaaccaaaagtcagaccaccaactcaaatgtttccactttgtttgctcttattaaagcttacactttttaaataatatattgaatcacagaaaacaatctctgaaacactatttctgagaagaaagacaacaatattagcttctagtcccagagatatttccattctaaaaggaaatatctcaagtcaaagagactattctataatgtggaatttggcatgaaggctggcaaagtggaaatggaaggatattgttttgaggtaagatgggtcttggtcctcctctatctggccacctaggtcactcaaagagagcctgtgagtcaggccagatcttgttaccaagcagtttgctgttctgttgcttagtgacttgaactagccggccatcattcccagctggctcttccagagtcaaaccttaacagatttctgacttgatctttctccttagagctcaagacttttttctttccctgaatgattgactataaaattattctctggctggctttgtttttacacctcttatgtaaaaacaaccctgaatcaaatgttctccattgaccccttttcaccaaggacatatatttctcctacacacacatatttttataagaatattttataaggatgtcaacttctatacaagccacatgtgtaaactaataaactgagattccacaccaaaaaagggctctgtctctacctttctgttaactactattttgtaaaatctttgaatattcattgttataacttcaatacacatgcagggtagggtaacaaatgtgaatgtgattcttagcccaaaggaaggtaatgctgaaagaaagaacacacgatggagagttaggaagacttgggttcaagttttaatgctattggtttcatagctgtttagctgaaagatcttggttatgtaagaactttttctgggcctcagcagctgcatatgtaaagtacggttaacaatacttacatccaaccttggttgttttaaggggttaatgtacacaaagtacctgacacatggcaggagctaaatcattgacgtctatgttataattaatctaaggttataaagctatattattatgaacctaagtgtttttattccaaaatgaaatcatgtaatttcttctcagatcaacttttcaagatctccttttgagaataagtgcctcatctgaaatacttggagagtatttatgtccttaaaactgcacataaaatgatttttctgttttgcttatttacagtagaagagactgatgtgttaagatggtataaaattgaagtctagtaaaagagaattttaaattagaatctttacagtgatctatacatttccctatctgttacctaaaattatgcctttcagatggtggcctaacgtgaataccaccaataccttcattctgaaggccctgaatcctatttatgagtcacagaattattaaataattctgtttcctgtttttacccatgtagcatctaccttactttcttacagcagcaagttggaacttgtttctaattgctaatcttaaatagactgtagtttgttatcactttgtaaatttaattagtcattactttttacttgtaaatgccaaatgcctttataaccatatgacttattaatagagtctccaagtcaaaaaggttgaataactaaggtcaagtatcaaatgaccagaagacctggaaatatgtgatttcaatatactgaatgaatcgcagctttaaaaacatgattttttaaaaagcaaaaccattaaaaaaaagacattattttgctacattagagatagtaaagcttcttcctgaaagtgctacttgaagaacaaatttggtagctttctatctaagaaaaaaaaagtgctgaaactcctttagttatctgaatacataggagcttttcaattataaagaaatttacacaaagaatattttttaaaaaatcaaagccatgattttcattattttaatgaactttaagattcaagtttttattttcttcttatcaacatttctgccaagtttgcaagaaagaccatgtcttcttaagaagagattttaccatcagtagcaacggcttcagctcgtacgaacaggcttcacatcttttctctttaagataaatgtcaatggtcatgggaagcacacgtgaataataagctgcaaggttatccaaggttttcttcacttttttctcaatgccaattgtcataatgtaatccctgtaattccttaaacatgacaagccaatcggcatgttctttaaaaggaaaatcttcctcaggtcttttgatttcgtggaaagccaactatgcctttcaaatggtacagacaccctcaacttgcagcgcctccacctcccatgatttccacagagggcaacagccagttatgccacagacatggctgaaggttagggctgactggtcttccccaaacattccagcagcacttcctggtgtgcttctcagatgatttcccccagaaacttgctccccaccttctggtattacactttgcctacagccctcctctgggttcctagttcccaggagactggcagcaatgctcttctccgggtattattaccataagagacagagaaaagataaccttaaagctaagcagggcagaagtaagagagatggaacgagggagaaagagacctcaaagagaaatcactaaataatggctttgaaaatctactcagttgtttgtgtgtgtatatgtgtatttttactctacaaactctaagtggctgtatttctcttttataggtgacaaatggtttctttccccttctatgacttgcaaatttatatttctcttaacaaccataaaaacaactacagttgctgaagaaataatgactcagaaagcaaatgtttacttttaaatatgagcaactttacatctaatgccaatgcctgataaagagaaatttatagtaaacaaaaaatatggccaaaatcacttatttagcttcctaaacacatttaagatttattaaaagtctcctaaaaggccttttgaaagtccacctaaagaaattattttgttgttaagattgttactaagtacttcttctactgttggatatgttttaattaaaaatacatatgtgtatacaagaattataaaaattatacagttgagtattacctagtcaccatgattcctaaagatatcctactacctaatttcgcttatatacacgctggaacattttcctccattcagtgcatcgagcacagtataaattgacaatgttttcatctagtccttaatcaggaatataatccccatgaaattacttatattagaaaactgtatttggttttaattatatttggaattaaaaatgtttttgagagatatatcataaataacaaacctgatgcatcttagtgaatgctacccatgaatattagtttttaatggttaatgttttcaaagtagcttgaaaatatttcactatgtagcctaaattgactgttaaattcaggaaattacatcttcatttccgttatagtaaaatgactcaatgtttttcattgtgacattcacttagattggagtgtgatactgacagctatagtaacaatattttaagagtataaacagctgggtttttagaggcaaattgacacagagttgtgcattgcttattctaagttctgagaaatgtgtcattaggcaatttcatcattgtgcagacatgttagagtgtacttacacaaacctagatggtatagcctattgctcctagcctacaaacctgtacagcatgttattctactgactattgtgggcaatcataacacaatggttaagtatttgtatatctaaacatagaaaaggtacagttaaaaatacagtataaaagataaaaaatgatatacctgtatggggcactgaccacgaatgcagcttacaggactgaaagttgctctgggtgactcagtgagtgagtggtgagtcaatgtgaaggcctgggacatttccacacactactatagactttataaacactgtacacttaggctacacttaatttataaatatttttatttctttgatataagttaattttggttactgtaactttttactttatacaactcttaattttcttttaattttttggctcttttgtaataacacttaacttgaaacactaacattatacagctgcacaaaaatattttctctatatctttattctataagcttttatttttaatttttttttactttctaaatatttttgttagaaactaagacacaaacacacattagcctaggcttacacaaggacaggatcatcagtatcattatcttcctcctccatatcttgtcccactggaagctcttctggggcaataacatgcatggagctgtcatctcctatgagaacaatgccctcttctagatacctcctgagggacctacctgaggctgttttatagttaacttttgtatataagtaggaggagtactctttaaaacaatggtaaaatacataaatacataaaccagcaacatagttattattaagtataatatataactatatatgctatatgtttatgggactgacagcatggtaggtttgtttacaccagcatgcccacaaacacaagagtaattaatgcattgtgctatgacttcactaggtgattggaatttttctggtccgttataatattatgggaccaccatcaaatatgcagtccaccattgactgaaatgctgttacatgtgtgtactgttgagcattttaaaaaatgatccaggtatatatatatgtgtgtatatatatgtaggtatatagatatatatatgtgtgtgtgtgtatatataggtacacaggtatatatatgtatatgggtacacatatgcgtatatgtgtatatgggtacacatatgcgtatatgtgtatatgggtacacatatgcgtatatgtgtatatgggtacacatatgcgtatatgggtacacatatgcgtatatgggtacacatatgcgtatatgggtacacatatgcatatatgtgtatatgggtacacatgtgtatatgtgtatatgggtacacatgtgtatatgtgtatatgggtacacatgtgtatatgtgtatatgggtacacatatgtgtatatgtgtatatgggtacacatatgtgtatatgtgtatatgggtacacatatgtgtatatgtgtatatgggtacacatgtgtatatgtgtatatgggtacacatatgtgtatatgtgtatatgggtacacatatgtgtatatgtgtatataggtacatatgtgtatatgtgtatatgggtacacatatgtgtatatgtgtatataggtacgtatgtgtatatgtgtatataggttcatatatgtgtatatatgtatataggttcatataggtatatataatatatgtatataggtacatatatgcatatatatgtatatatacacacacatattttatatatatattcacaactctattcctatactacgtactaaaaaagagcaaactgcttaaggatatatatatatatatatatatatatatatatatatatagcttgctctttctcattttatagtatggcatattatggagatatatatacatgtaccatctctatatataaaatggtaaacacacaaacaggacacatacatatgaagttaaaagacaatgacattcaaggaagaacacactgatttcaggatcctctgcgaaggaagaagaataggatgggtgacagctttagacattatctgtaacattttattcttaaaaaaataaaagaactgatgcaaacaatgacaaaattttggcattttaaaaatctgagtctggggtcaggggagcgggtagggatagctttaggagatatacctaatgctaaatgacgagttaatgggtgcagcacaccagcatggcacatgtatacatatgtaactaacctgcacattgtgcacatgtaccctaaaacttaaagtataataataataaaataaaaaataaaaaaaaatctgagtcgtggatatatagatgtgtattataaaaatatgaaaaaattataacttaagtgattataatgctaaattactttttaaaagaatatgtgaagataacaggttttatgacttaaatatgactaaacagcaacttttaagttcccaaagactgaaaaccagcatttctaccttgttcttctaaaacttatttaggccttacaccccaaaactgtgcttaaaattcaatgacgagaaaagcctgaagaatgtgaagaacttcctgatttcaattttcctgaaataaactagtactggaagttaagttttcttcaccagagattccattgactttgtagttcctgctgatgatagagggaatcccctaccagatgaaatctgaatcatgtctataatcactagaactacaaggcattgcatgtttagtaaaagcagtcaaacagattagtgaaaagcagagacacaagagaattctaatcctaacagatggtgccagaccaaaaccagtgctcaacacatactagctagtgataaaactattactaataagcattgagagtatcagagacaagaggcgcaatagaaatctgttccttgaaggaaggaacggattacttccagttgggagaactggaggaaccttttaggaaaaccaggaatttgaaagatgtatttttgcagtgggcagagaagagacaccaaaccccacagttctgcctcagtagtatctctcatttctgccttctcctttcctacagtaataaaactgacatacactcgtttctttcaactcttgtctcttcactctaattcatccacaaatgactgacagagtaatcatctagaaatttaaacatgatcctaaaggttcatgcagaccaaggctggaataatgggcacagagtacataataaaaaaaatactagcttataatgacacccactaagggtccagccctgtgaaaccacttaatttatacataattgtacttaattaaaccacaacccccaatagatactattcccagaaaactgactaacggggaaactgaagcacacgttaagtaacttgaccaaagtcacacaattactaaatgcaaagtaagaatttaagtttagtctcttttctaactgctttggtgctgagtgacatagcacctagagtatgctgtcaattcagtagctattctttaaatggatcatgaaaacccaagagaagtctagataaaaactacctggtaaatatagcatatagaaatgaaataacaggatgtttacttaagaaaagagaagtccctttttttttttttttttttttggtgacagagtcttgctctgtcacccaggctggagtgcagtggcacaatcatggctcactgcaacctccgcctcctgagttcaagtgattctcgtgcctcagcctcctgtggagctgggattacaggcacacatcaccatgcctggctaattttttgtatttttagtagagacggtgtttcgccatgttgcccaggctggtctcaaactcctgagctcagggactccgccctcctcagcctcccaaagtgctaggattataggcatgagccaccatgcttagcccaagagaagtcttttttaagagcatgagaacactaaaatattgattaatgaatttgtttagcagacatttattaagcttccaccattgaccagccatcatgccaagcatgggtataccaaaatgaatgaatagggccctggttctctggtgggttactccaagccacttgccttagggcttcataatggaagggagcaaaaattcaagttgtaggattcccaaagcagatcttggatccatggatgatagttgcagggaaggagacttctactgtttagaagcaaggtctttccaatcaacagccctatcaaacaacagaagtgcttctgtataatcttcatcaaggaggtttgacgagaggttcaaggacttgttattacagatgttattctaagaattcaacaatggcatatgttattacagatgttattctaagaattcaaccatggcatagagggtaaatcagatagcccttaacatactatataaccaagatagattagccaccagcactttaccttatgccttggaacagagctatgtttcccagcctcctttgcagttagatgtggccatagaactgagttccagccagaagaaaacgagtataagtgacatgtgcacttcccggcctgtctcataaaagttcacacataccatcctctttcatggtctttctcctgattcatctgagcctggcaaccttgggaatcacatgttgcaaataatggaaccacaggatggtagaattccaggtccctgaggcacccagtggctagggcaggctgcctccccacaaaaagcagaagcaagaaataaaaattcactgtgtcaatccaatgagatttggagactattttgtagaacagcaagattatcttagctaaaacagatgtcttccaatattattgatttattctaccatggtataaattattggaaaccaacaaatggttcttgctcaactttgtaataattaggtacagaataaacatgttagactcagtaggtattaagtgtatgcatagcgaatggaggggaataccaggagcaggaaactgtgaggcagaacactgtactagcaacaaattagatacaaatatatttatatttatgtcagaacaatttgaaacatattttcaaaattctccatagtgcttagcacaaactgtgaaagcacaaatgagatttttgtcaaaagatgcctgtggatattatgaacgtcttggggctcattcaaccaatatggaaaacttgagatactctttccaactcccttgcctgatagttttagtccataggggaaactgcttccttctgagttactgaaaatcgataccatgatttttatttctggtttccattgctctctttatgcttttcttactgggctgtgacctgatacactaaaatgaaatattgatagaaattgtgctcatgaagtttttccaaacagcaccagaaaaggaagtgccagaaatgtcagaagaaagcctattttcatgggatttcctgccttccttacatcccgacatgtctaaatagttcagataacctccagctgaactctaggttgctccactcagactgaaatcaaacagctgagttgagggccactcattcagcaatgggtgcaatttaggaactgcagtgataaagcagcgcaaccaaaagggacactggacacggaaattctggtcctggctccgtaggaactcatgccagctctcctgctctggcacccgatgcctggccttgagccaaccttctccttcagtgcatctcccagtgtttattcatgcctttcttttattcactgtttgttgctcacaattttttccaaaaagaaaatcttcctcaaagagaagccatcatttcccaataactgctttaagacagaaaaagtcaatgtttgtctcactcctcttatggccattacatctaccaaactcagaaatgccatctaggtgttaaaatcctggggacaataacactttcccagtcagagatctagctacttaaaaccaaatttttgaggttggtcatgtctttgggtgtgacatggcttttatttcctttgtcattgactttcatctataacatcaatgcattcctgagcacggtcttgtcactggtttaggttttaattccttttactttttgctgctttcctcctaaaagccttgtttctgctttttttttccctcccattgctaacgtacatactgtttagttagttatggcaaaactgtaaaaaattatttagtcatacagtttctcaactaacacactcattcttttttgttatgttttctttatcataatttatactcatcttatcaaaatgtagatgtaatgtatagaacctactactacctgaaattatctaagtgtgtaacatagaccctagtacttggactcactgatcagagtttggaatggcctctactcaggcagaaactccaaatactccaaataagctcacatgatggtctgttttaatatttgggtttttcttcttttttttttttccaagagcaggaaaagatgaggaatcctccagaaaaatacatggaagcatatgcatgaaacaaattcacccattataaagaagataaaaatattcacaaagaaaataaaaagattggcaaaatgttctaacaatccaaattcaaagaacacaacaatactaccaagtaccagcctgcaactttctgcgtagaattcctaatccctttcttctttcctttggaaaggcatgtttaagattatgaatactgtatatcaaagtcaggagtgaggaagggctttatgaagacacaccaccattacacacacactgtatgtgtctctgtccaagtggggatcatgcagaaaacagagcaaactatgattttcctcccctcatttctggtcctttctttcctcagctgttggggaagctggcagggaaattggtttaaggaatcaaagaaacgccactacgtacgtatgggaataaaactgcattcttatttgacatctggcatccaattttcttgtaggaacttgcaataggaattgaactttgagaaccacccacctcaaccactcctagtaccagtctccaggattcttgccctgacttggacatttgtgggatttatggttaagggagatcacttggccataaatccccggtgaggaatgatgatggtcctccctccctacccccaaaattaaaggcgcgagagcaggactccctgaagggaaacggccaccatttctgcgaggtctgcgcaaaccttaccatgtatgtgccaccgtgaaacgccgctgtttggggatgttgctgctgagaagcattctgcgcagaagcctgggggaatttctcggagagatcactggagagagcttgggagaaaccgatttcctcgctgtcttggacttctcatgctgcaacaggttttctcgcaaggatttcacaaggtcttcgttcagccacgggtttggacaatgcggattatccacttcaggtactgttaaagtgtccgggcttgtctgctgagccattttcctggtcaactttgtacagctggcaagaatccagggcaacgtggttccctcgctcacggtcccggaaatgtccagggaagcaggtctgagcctgctgctgttagtgcattcagtcgcctgcctcagtctctctgtagagcctggggctgggtgcagaggaggcgagcgcactcctccgcggaagcgtattaaacgtcacccctcctctcccaagcccctgccaaagatcactgacaagctcgcatagcaaatgaacaaggagggaaagcaccgcgctcgcacggctttgtccgtgctacaaagcagcctgttaaactattggaactaatgcgccgcagctgcgcgagtgacttctgctgcttatgtacataaaaagtcctggggggagggcttaaccatcagatgcctgctgctgggttgtttggctagtctttccatttgcttattcctgaatccaaaggaaagaaaaactttgaacttgaccttcctctcccgcagggctatttatctccctacagtccacgttcataaaagaaaaatgccaatcctttgtttttttctctcttttttttttaataagggaagaataaacaagcactagctacacaaggagaaatacttccctgcttactaaactcaatctgatgaaccacataagacaaatcccatgagaatgaaattgactttttctccctctgtctctagttagaacccaaacaaacaaaaggtttcaaaatactacacatggaacgctttacaggttgcagttgtgttctacaaccttattaattagggccctttcaaagaactaacaacactatttagactcacaaatgatatgttttctctttgcatttaaactaatgcccctccagaaggacagatagttttcataagagtagtttcaattactatttgtgatatatacaattttatgtattcaactataagagggtggaatacatctagcttttcgtgatttcctttattgccttttaatgtaagatttttatgtgtgatgaatagagcttcaacaaacttattcagagagcttaaaagaaataattttgcaattggaaaaaaagtaaaaatgttgtaacaagaaagtatgaagtaaagcctgttaaatctcatttatgtggacactagaagtgcagacattaaacagcattggaaagaaactcaaacctttgcatagggaagttcccagtagcttagtgatgctacagaccatgtgggattgaaatcaaatcacatctctaacgatctaggaatattttatgtttcttaaaaacccaataacttagggagctacaaaatgcatccagaaaaaaaaaaatggagactggaatgattctttttgtttcctatgattactattaggtcaattttaaaagtttattctgtttccctgcccccctggttgctccattttaagttccaattccttgtcttttaaatgtttacagaaaagtgtactctgaggttctattcacagaaggacagggtcaaccacttggtccatctttcctgttagcatgcccacaacaattcaatgacacataagtgctatgacttcatcaaaaaatgttagacaaatatttgaatttgaagaatcaggatatgattattcttattctcataatttttaccaatataaaagtttttgtcactttacatcattaagtggcaaggtatgtgtgtgcatgtgtgtgtgtattgtctatatatatactatatttctatacagtgggctgagggactgaacggccttagaagttgtgcaaaacaggtgtgcaatgcttgccctcaaggagcttgtaacttaatggaaaggattggacaatacttagaaaaacataccagaacaactggaaaatgaaatagtcagatgcagaaaagtacaatgaaaatgaaatgcgtatatgatgagaaaactctgggtaaagtttaagaagggaaggttcagaaattaatggaaagaaagaaaagaaagaagtgcactttacgagtaaaaactagaatgaacaaatgcaattaaaaatgtatttgtacatgtttttagttttgtgcaaaacaaaacaaaacaaacgacaacaaaattaaaggctcagcagtctgtagacacaaagcctgttcaggttcaaagaaataaaaaattcagatgataggataagtgagaaaaactaatatgtattaaactgaaatggcaaaaaaaaatattttagaaaaaatctctagtttctgaagactcagttccattcaacaaacatttatgggcatttattttttgccagacactataatgggtgctctaggatatttaaagattagcttggccaggtgtggtggctcacacctgtaatctcatcactttgggaggccaatgcaggaagatcacttgagctcaggaattcaagactagcctgggtaacatagcaagaccccgtctctataaaacattaaaaaatagctgagtgtggtggcatgcgtctgcagtcccaggctactcaggaggctgagatgggaggattgcttgagcctgggaggttgaggcagcattgagccatgatcatgccactgcactccagactgcatgacagagcgagacccagcctcaaaataaataaataaataaataaataaataaataaaaaggttagcttgatactatgtctctatatctgcccttggggagcttatagcctaataggatagatgacaagtgcaaaatgattgacatgaaaaagtgcagcccaagtacccagacgagatcttggaggctggagatatttaaatgtctggctctaagtagagaaaagtgattcttagtgaccaagtaaaggaagagattatactaaaaatgatatgggcgacagagcgagactccatctcaaaaagaaggaaagaaagaaaaagaaaaagaaagaaagaaagaaagaaagaaagaaagaaagaaagaaagaaagaaagagagagagagagagaagaaagaaagaaagaaagaaagaaagaaagaaagaaagaaagaaagaaagaaaagaaagaatgatatgggcaataatagggaaattcattgaatgcaagggactctgggttctagttcttgcttttagccaccttgtagaagagcttacaaagagtaaactatttacatgctgatcttctcacaaatagtatgccatgtagaatgttcagagagtctgggcactttgttaatgatcacaattaagctaaatagtagatataacaatattctattcaaaatgcattgatcattatggttaaacatggacaaaagcattctgcagatctcccattgctttggtgtatgttaaaggatttcagtgtatttggttggtgcaaaagtaattacagtttttgccattaaaagtaatgaagcaggattgagagtttctttacaggtccccatatcccattattattattgattcaatttcctaatgcttactgttaacctcctaaatctgccaaatgatacatgatatgcatactgctttttaaaaatacaaaattaattttgttttgagaattcttggccagtccttgaaataacttgaaaaagcctgcagtgtttcaaagtcatgcttgaaaattgctgccttaggaaacacaaattgtaagattctgaagataaccaaaggtgggtgaggtttggacagactggcaattttttcttatgttaaggcagagggtcagagggtgctcttccaacaggagcactccacagcttgtgtttttcacaaaatctctttaaaattagctgccaggaacttgtctgaaaaacactgtacagtaagtgacagccaaataaggcctcaggttttaacaagtggaaatttgaaagtgggcgaaatgttttgataaagtcacccacgcctagaacagcagataacatctcttaacttcatgaaagttttcctagatacctctttgtggattttcaaaatttgtgggattttttagattatttggaatccttgaaaatgttttgtctcattaatcatttataggtggtaacaaggaagatgagattttcacaggttctgacacaaaaagtgtgcttttgtctaggtacaaacaagcaaggctagatttcccacaatggaaagagagcaatgatgtggctaattcaaaaggatggaagaaatgatttatactcagctatggaaaacattgtatgtttctccaaactatgttctaattagataaacaagggttaaaaggaaatcgctttcaaattgtccacaggatataggccatggaaatgacctgatagtgggagaggttatgttgtctactggataagaaggtatgggttaattttagaaatgaaaagtttattttgaaccccagaagtactagttactagttgtgttactttacttttcagtggctcagttccagatctgtgaaataggacgataataatgaggatgatgatgatagtagctattgcaaaagaatgctacaaggattaaatgtgttaatccccatgatataagtgtttaggagagtgcctggtacagaataaccacccagtaaataaaaatctaccattatgtgatatgaggaacttagagaaattcacacttagtagatatcaattatgtaccaggaactttgcattttatttcccttaatccttgcaatcatacttagggtgttgctttcgtactacaattttagagatgagggcataaggaggttaaataacttgccagaggtcatatagtttaccaatggcataaatgggatttaaatctgtgtctatgaggtgccagagcctctattttgactctacattatacaaacccaaaaggaaagcagatctagtatttaaaattgtttatggttatttctatggaaaacagtagacacctgggtcccctgagttcttgatctagttaacactaaattttgcccttggctattctcagcatatacactgagtcaacctgtaaacctgccaagtcatgaagttctttctgaggcatggtattgaagtaagggcagctgaaggtggaattcctgagatgttttttgtttttatgtttttttctcctctatatacctgtcttctttcaatatgaagaaattttaattaaactccatgatagttttccacttagccaaataatatattctaaaattattttatcttaaattttcatcatgattatttttcattataaagtttgatgataaagttatatcatccccttatctaaaagcacatctgaacactgtagaacatggtttttcaaatcatcatcatcattgaccttttattaggtactgggctagtaggcagagatttccaaaaaagtaaaatatctactttagaagggaatataaataaaactcccaacaaagaaaataaatactaagaatcaaattaataatagaaatgattggtgccttctgggttaaaaggagtgaccaataatttatctagacagagaataactcaaaaacaaggcagggcttgaattaagtcttgaaagaaggtacatatggaggaataatgagaggtttggagagataggtagtttaggggaggtaagatgcattggatttttagactttttactatggaaaaatcagtaacatttacgtggtaggtgggtaaacaatatataaagagatttaaataagtttaacctggttttaatatgttctataatttgcaagaggaggattctaaagatcttatttcaatatttcctattcaatatgaatttgtgtagaaatggaaagagagtacaagacttagaaaagtttgttcattggctgtatataagcttggaagtcaatagagaagtcaaaaattcatcagatatttcttatacattccacccaattaaacatcaaaagccagtaaacagtttttttaagagtttctagatttcattgaacaaaacaaatatatgtcttgatttacatgacagctatattttgagcatatgatgtgctcttctaagatcaattcattttaataaaaagaccaaatctagttatatggggtttttttcctagattaaaactaaatgttagagtgatctctgctgaaatagtaagtcattatttcacttgaaagaaacgttaacattttatagggcacaacttacaatggcattttttttttcttttttcttttttttttttttctgagacacagtccggctttgttgtccaggctggagtgcagtggtgccatctcagctcactgcaacctccaccttctgggttcaagtgattctcctgcctcagcctcctgagtagtgagtagctgggattacaggcaccaaccaccatgccgggctaattttcgtgtttttagtagagacagggtttcaccacattggtcagacttgtctcaaactcctgacctcaagtgatcctcccacctcggcctaccaaagtgctgggattacaggtatgagccactgtgcctggcctataccagcaattttaacacagcatgtttattttatttcagagaaaagttgcaatacaatttaggtaagaaccttccctttcctcctaatatagtcattctaaaaattctaagggaaattacttctaattattttgctaaaaggaaaccccagaatgccctctctaaatattactctgacttcaaagaagaaaataagttttgatagccactaaatgtttaacatattataataccctatatttctgggttttatttcagtgagaggaataaccaaacattttgtctgcaacttgtcaacaacaacaacaacaaaaatcccatatctcaatctgtactagatcatcccttagcctattgaattactgagaaaaaaataactagatgtaagtgcaaaacactagtgcactaagcataagcactttgcattattacatgttttgatcattacaatcattctaacaaggtggttactattacccacattttaaatctgagaaaactgacatacaaaaaaaaaattaaataacttcctcgaagtcatccacaccaaatgatctctaatcctcaaggtcataatcaaaagattttcaaactccccaaaattgttcattgtattacaaacaccagacatttagtgcacgaaagatcttgggtggaccttcagaatccttgtgcataatgaaattgacaagaagaaacaaacgtttgttgtctttgtccacataacagacatgataaggaacaaaatccaacaggtatcctaaattcagaggaatataacacaatagtgatctattcaaaactcaacaccaaggaacacatttccttatctttctctttcatttgctatacccacccctgaccggcccccaagaaaggatttttttggaatctttctcaaattagtataatataactggataacttccctctaatccccatacataacatctgttccagtcattctgttttttgaatatggtttctatgagacagtgtatttcactgaacatgtctataattcatagattttaattatagttggaaattttttctaaagttaaacatatctaaacaatggtttctcataaggaaatcatattttcagaaataacattttttcatacctaactataaggaatcttctgaaacctagatttttatctgggatgctttacaaaaggcattagggaaaccagagttgtattccccattttgtaataagttagcaaagtcaccttcaacaagttcattaaacttctctggaactcactttcccagtatgaagtcatataacttaactaaggtttaataacttaaaaaaaatcttatcctagtgttgaattgggagtttcatttgtcatttaaggaaaacaaatatcaagtgcatcctgagccaatatagtctcttccactttcatgcggtgttattatataccacaaatgcttttagaagaaaaatgaaaaacaagatattcaatgtttaggaaattgaagatggaaaacaagagagtgctacaataaataggtgctttactgatgcttttatggctctgaaacttgggaaacttttttccctaactaggtaaaaaatttgttctgatatctgagtcacagcttgggagatggagtgggagagcaatgcctaagttaatttaatatttgaaatcaaagcattgttttacttctaaaatagtgaaactacacagataggtatattcactgttacataataagtcaaattttctaaaacatcagggcttaagttaccttttagacaatttcagaggaacctctccactcacatttcacaaagcatgtctcaccgaagatgagttttgcctaattttaatgaatgtttcacgaaaaaaaaaaaagcattttgtgatttaaaaaatatatggagctgggttgaatacaactaaatggggctcctcagagtaagagctctccgtcttttaatatgttaatgtgatttgtgaatgtagactcgcctggctctaaatccacctgcatcctccagcatgtccagagattaatgtttccaggaacccttaactcgactttccacaaacatctccttgaacatagctgatagataatgcaaaccttcctgattttctggagtgcgttcttttttctttttgttgaactgcagccaaacggaatgcttccagcagaatgatgacttagttcgggtactggctgccctggtaacagcctccattagaatcaggttattgttatggtcctgctctcaggctaatttcaccctcctctgcaattggtgtatctccaaatgtaaaagacataaccttagcaaagactatgagagggatggggccatgcctctaaataacagctttgtggacagaagcctgttgggagactatggacaaactaacaggacagaaaaatattggactagatggtactgttggtaagaagatgtataaaggcaactgaaggccagacaggtgctcttcaaacattgatggacctacaaatcacctggagaccatgctaacataaagattctgattcagtacatctggggtgaggctcgagctcctgaatttccaaagctcccatgggatgctattgcctgtccatagattgctccatatgtatcttggccttagattatgtaggtattgatggctaatgaatacagcaaaagaaggcaattaacttggacacaggtgatcctatttctttatattcaggcatttgtgtaatgtttaaattcactgctgatattataataaatcatgcaatttctaaaataacttatataacagtattacataacaaaatcataaaccatttttttcaaaagcgcatatacactctaaaagattccattctagaagcaaactttgctatattaaatccacactttttagatgagacaaaaaaaagaagttgaaataaactcttttgcaggtgttgtgaatatctatgtctgttaataaattataaattaaaagtaataattacataattgaaaggtaaactttaagacttatagactgttttctgaatgtaatttatttaattattctacaagcatttaataagacacaccatgtgctaggttctgtgggtccagtgaagacatggtctttgtgtatctggggatacaagattcattctttgctacactcacagtctcctgggactttcagtctagtctactgtgcagtatgaaacatgcgaaggacacttaccatcaagattcactaccacactattgacctattatctaaagaattaagaaagtatgcatccgccaactcaatacctagccttatagtcaatctatggataactgtaaaagcaggtatatgcttttctttctggggcttcccaagaagttattctgacctggaagagctcaaatggttgctaaattatgaaaatcaatttgaatttctttctgaaattattattttaagctgtagtaaaatacatatgaatattacaccaatattataaaggcatatattctagttaggctaataaccaccatttatatcctgtaattatataaacattgcataagccaactagtaattatttaatcaatcagttataagggaaatcaacctatgacaaagaaatcctcttgatacacccctggtgaaaacacttcagtctaaacagcagttgcctcatgattcttgtactttaaatgctgggaatatagtaagtgttcaatagacactagacacaggtagaaaaggaaggaggaaatgattttgccgtttgttttactattttttatgcttttagatagttaacaggctaaaaaggtagggtgttcaaatcaatttatactgatctatctactaaaattctacattgttttagaaatccttttgctaggccagtgcagtggctcacacttgtaatcccagcactttgggaggccaagttgggccaatcacctgaggtcaggaatttgagaccaaactggccaacacaatgaaaaccgtttctattaaaatacaaaaattagctgggcatggtggcacatgctgtaatcccagctatttgggaggctgaggcatgagaatctcttggacctaggaggcggaggttgcagtgagccgagattgcaccgctgcactccagcctgggcaacagagcaagactctgtctcggaaaaaaaaaaaagaaagaaatcctttggctaggcatgcttttcattttaacaatgtatttgttttaaattagctagataatatatgatgtattctcattgtaaaaatgttaaaagttctgcagaactctaaagtttctgtagccctccatccccaaactcaaccttcccccaggtaactctgttaccagttgtgtttgttcttctagatctgcactctccattacactggccaccattcaaatgttgctattaggacgtgaaatgaggctcgtagaaatgagacatgaaatttttatttttatttaattttattaatttaaacttaaatagcatcatgtggctagtggctaccatagaggacaataaattctatagacctccgtgtgatatcataaataattttatgcctataggatcatatattactgttttctgaggcttcttaaaaacatagtgttatatttaatgatcaatcagcaatttattttttcactcaacaaagatctcttgctatttttagctgatgcatagtattcaatagtatggttatttcatatttcatttagccatttccctactggagggcattcagatttccaccttttgacaattacaaagaacattcttgcaaaacgcattgggaatacatgccaagtattttttttaataatagatacttagaagtaggattaactgataagatatcagcatttttaaattttaatagaaactgccaaattgttctccaaagtagattattcaatttacactcccaccaacagtctttgagatcccacgttttttcctcaaacagccttatgttgtcatcaatttccctgtactagttgtcaatgccttttttccctcgagaataccttctatttcttaggcagaagaaattaagaagagcgtcagtgagccgggcgcggtggctcacgcctgtaatcccagcactttgggaggccaaggcaggtcgattacctgaggtcaggagttcaagaccagcctggccaacatggcgaaaccccgtctctactaaaaatattaaaaaattagctgggcatggtggcaggcacctgtaatcctagctactcaggaggctgaggcaggagaattgcttgaacccaggaggcagaagttgcagtgagctgagatctcaccactgcactccatcctggaaatgggaagatgtatttcacattgcttctgagtcaatgttcaattttagctctttaacaattttagttgaccaagcatttcccaggagtctctctaatatgacaatgcctacacattatagaagggttttgagaaggaaaaagcattaactttctttttcggtaattttctggcactactcagtaaaatatgttttaaattgcttttcctataataaagatagattgtgctaagcatgtattctttgtgcctagtccctcttttacacatcagtgtagaatttgtaatgcctggtcaggactctattgctagtttgtgtaactttttccttgagcaaaatcaatggtctatagataaggcctcagctgtaaacttactgaattctggcctgacagcagtgttgctgcagcatccttagataagtagttttatgtgaatgaaagaacaggagtatagttttgattaagtcatatttgtcctggagcctgaggcgagccaaccactctctagggctcagtttccttatctaaaagcgatggtgagctgagcgcagtggctcatgcctgtaatcccagcactttgggaggctgaggagggtggatcacctgaggtcaggagttcgagaccagcctgactaacgtggtgaaaccctgtctctactaaaaatgcaaaattagccacatgtgctggcaggtgcctgtaatcccagctactcaggatgctgaggcaggagaatcgcttgaacctgggaggcagaggttatggtgagcggaggtcacaccactgcactccagcctgggtgacaagagttaaactccttctcaaaaaaaaaaaaaaaaaaaaagacggtgatagaacagaagaccacaaaggtaatcaaaccaaagttgtaattgaaaaaggagtgtaattcctacatgattggtttatgtaggaactatgtcttacttagtggttaagtaagacaaaagtgaaacaataaaaatgtatgttggaacaaggcaatttctttgctgcatctggaaagtctagaagactgtttcccccagattttttgtgctacttacaatttaatggttgcagacatgatgtacaactttaataacattttcttaatcagtttgtagacagtcaacaccattaaacaaaaaatcaattcctgggccgagcgcagtggctcatgcttgtaatcccagcactttgggaggccaaggcaggtggattacgaggtcaggaattcaaaaccagcctggccaagatgatgaaacctcatctctactaaaaatgcaaatattagccaggcatggtggcgggcaactgtaatcccagctactcaggaggccgaggcagagaatcgcttgaatccaggaggcggaggttgcagtgagccgagatcgcaccactgcactccagcctgggcgacagagcgacactccatctcaaaaaaaaaaaaaaaaaaaaaaaaaaaaaaatcaactcctgatttgtggcgtatgctgatttccatttccattgtataaatacctggactaaagctgattttaagctaccaacgttatatcagcctatgtggagttgggaataacatgtcattttatacagtgtttccatcatacagatgcaataaacaaatgacctcacaaacagaaataacagaatgtagtaaaacacttaggaagggatgagagttttgagtatgtgttatgtttttcagataacttgaagtttacataattaaactttagataattgatgcattaacaatttgcttagcaaatttctggacatttaaaaataggttcctgtgagtcagttcagaccaactctaaaatactgctgctttttcaccatatagacatcctcgagtctgaaaaacctgttcctttgtgattttctaagaactatgttgttttgattgatttttagaagttctttatagtttctagatgtgaggccttttcagatacaagtattgctaatatcttaggcttagtacccactttttaaacgggaacttgacaaatctgggattttagtgtagcacgtaagtgttcaatacatgtttggttaaataattccccgtaaaagatactgacatggagagattacatgagcccctggatacttaagccatatattacttttatatggaaccatttcagagaaggaagtctctcattttgtcttaatagcatgtttcactatctcacaggcccataaatagcctactccagtgattaccaccttttctggagttgcaagaccaggaagatcagaatcacagacttttgagattataaaggaatttaaagtcctaatggtcctgtccaccttactagtatacattacatatgatacccagcagcatcctttctgccaaagtaatacagtttatgcattcatttaagaaatagtaaatgataagcaattttgctataacaactcatgagaattttatgactgtatttggagacttgtgggaataaagaccagcaatgaaagacaaggaaatgtaaatccaatttatgtaatagaatatgatgacccaacatctcctttttgctctgtgggtttatattggccccccttcacccatgctttggactttaccatttccttctcttcctcctccaacttccctttgcatcctggccccttccaaactatgtgagtatggatgtgttaatgtattactccatccaaaggactataactcatattacccaggagattctagaaacaatgtctgaacacatcacagaaactaaaatgaggagaagctcaggcactagcagaaggcctggttttggtattcttccatctacagctgtacagctgcattcttaaccttggctgcatattagaatcacccggagaattttataaatttcagtgcctgggccacaccaccccagaccagataaataagaatctctcagggtgtgacccaggcatcagtttttttgtaaaactcctcaagttattcccatgtgtagtcaagatttggagccatcccaggttgaggtgtattgatataaaccagcatccacatctataaattaaggccatttattttacacagtcttgaataaaaaatgagcatctgtcttccactactgtgaggaagcacagtcccttaaagtaatggtaggtaataattctttccttctctgggctacataatcttggctcttctctcatgctttcactctcttaaacttccttcctcaggctcctgtaccaatcttcaattcacttgggatgtcctagtctaaaacatttatttcatttgaaaggaaaaatatcaatttctatctaaattggagtaagattccattcagatgtgtttatttacaaaacataagttgttatttatctgtgtttaattgatcctggaacattccatgtaaagaacattccatgtaaagaaccaggcaacttggccaggcatggtggctcacacctgtaaccccagcactttgggaggccaaggcaggtgaattggttgagaccaggagttcaagaccagcctgggcaatatggcgaaaccctatctctacaaaaaattagtgggtatggtggtgtgcacctgtggtcttagctatttgggaggctgaggtgggaagatggtttcagcctggaaggtcaaggctgcagtgagttggtaattgggccactgcactccatcctgagtgacagagtgagacaatctcaaaaataaaaaaataaaaataaaaccagccaacttgtctgagctcacaaaggttttaggactcatctgtgtaagagagaagtcactgcatatcaggaaacaggatgaggagttccctcccataacccacagctctccaagagaacaaagaggtacatgtctctgattcccaaaagtaacttcctttttttttttttaaaaaaaaaaaggggattgtgcttttcaaatttatggatgtaaataaaagacctcaggaattcatggattaggagcaaaagattaaagtcagtacaaatgatattctaaataggcagaatgggttcaaattcctctcaattctttctgattgaatgaaaagtaaagaataaaatctctggcagaagaatataatgaagggcatggtgtggaacaggttgaaacctgcatttctcaaatccgtattgtataaaccaggcattaccttttgtatttgttaagctaatttgttttaatattagtattgaaaacatgtttgggttgctattaacataggaattaggcagtattttggagagcctcttttgagggaacaaatgtacaatcagtcattaaaaatgtaaaagaaaatacaaattatagttttctagcaataaattgatatcaagcctgttttaaaatgggtgatgtggtttggctgtgtccccacccaaatctcatcttgaactgtagctctcatgattcccatgtgttgtgggagggacctggtgggagataattgaatcatgggggcaattttccccatactgttctcatggtagtgaataagtctcacaagatctgatggctttataaggggaaacccctttttcatggtttttctctcattttctctcatgtctgccaccatgtaagacatgccttttgccttccaccatgattgtgaggcctccccagtcacgtggaactgtaagtcccttaaacctgtttttctttataaattacccagtcttgagtatgtctttatcagcaatgtgagaatgaactaatacaatgggcaaatatttaggaaaattttactcaatacaaagaaatcctggcctcaaaactgacatgatttttacatatacaatatcatgtacaaatagtttataacttaatccacattctcttctttcataagcatataagaagaatacaagcatacctgtggtatgggaaatggaaagactacttactattcccaattttgagtaaacctagctttcatttgtgattataagaaatgtttttcctagtaaaattctgaccataatatttctaaaaattaacacttcattcattgattcactaactcattcatacagctaacgtttattgagcacctactaggttctaagaatgtattagtggaaaaagcacaaagatatatagatctggatcactgacctctcctactactcagaaaggaatctgacccattatgtaacagccaagaatggtgagctactgaaacactctttcacctcttggtatttcagaggatgaatatgaggaagaggatgctatgtacatgattagtggacagacaggtggctgttttaagaaccacctctagacaaaataatttgcaatagctctgataagaaagatgtcaacacaattagcttttgcatgcattttaaaaattttggtatggactttccagtgaaggttttgtaaactgatatctcatccataccgaaggatggtaccatgtttttgccggtggtactctaatgttcaaatttgtgaagtaaagtatgtggtttacttgtgatgcaactcctgcatttgttgccaatggcaatggttgttttcttcattaggtttcatatggttggtcaggttatgtcatgagaattgtattgagaaaaattatgagtttgttgagtgccagctctctgcagtgagaatggttggggggtgagggtggggggaactggcagtgtttcttctggtaggtgaacagaaatgcagactcgtgggcactctacacaagcctttccacatcaactggcctcccctctccccatccccggcatctattttctagcctttagaaaattgcatacatgtgtctggaaagttccatcgatcagctctttctgcagcactccacatttctgtggcttcagaaaaccttgaattgtaatctccctcttctctcaggatgcatcactgagaaaaacttaaatcaactataattttcaacagattctaaacagggatttagaaagataaggtggttactgaattgaattaaaataaattcaggctgtagtccaattgcttccagctcttcccctccctctgtgggctaacaagtgtttccaaagccatagggcattaagaatcctgaaacagctaattaacagggctgctctacatcacatgaagcatgtgggttccaggcagctgtaaaacctcagcttcctgaggctatccgagtgatgatgaagcacttggaattggatcttgacattctgctacctgcctgtggcagaaaataacctttttaacagggactttaggcgaggatagtactttgggcacaaaaaagtctcattgccatgactatgaaaaagtacatgaacatttcctcatgttcagactgtgactcatgactggcctgttaacggacagaggaagcctcaggcgttctcttgacacatcgtccaaccaagtgaaatacgggattggtgagatgctttttcatagctttgaatcaagtatcttccaaaaggcagataaaaccaagataaaagaggtcattgatgccctttttcaacatttttttttccacctatctaaagatttcgccaggagaaatagagggctagcctactatatttcacagggaaataaacaaaagcgataataaaaacttagcattttttcaaaaacattggacatgttgacatgaattggtctcatctcacatagatctgagtataaattatgtgctttattaataaaatattctgtcacactgacaatgtcttatctcttgcctccagcctataatccatttcccataacgttataacaaaagtctttctaaaacgtgtcattcctctacttgaataaccttgatttcttcctctatttcatggtagataatctgcacatttcttatgcgccttataccaaggctttcactaccggattcacagctctgtaacttcgtctcaggggactggggagaatattctggagctacagaaatttagttgccgacatgccatgtccatttaaacctattaccacatcttcccattcactttctttctgctgagttcttcgttttatcttaaggtgctgattcaatgtcacttgctttgggaatactttcttcacctctcaaacagaaggaatcacaccctttgtcacttgtattcactactctatcacccatacacatgggtaggtctgtgacttacctttttgtcccagatgtctttattatcatctgtaatatacagaaggaaggtgataaatgacttgctgaaggatagatggacagataaatggatggaattagatcattgaactatacctaaaagctcttataattctatatttttatgatttatttttaatgaggagcttttgaagtgattactagaaaatataccaattagcgaccacaattaatattcagtgacatttaaaatttcaagtgagattttaattcactccttgaatttgtatgtcttttatataggcatctcactacaacgaccttagaggtggcataaactgaaatataaaagctgggtctatcaagcaactaaaatctgatttgatggttaaaaggtaagagacacatcttaaaaatgcatatgtaaagccaaaagctgggaatgatgctaatatattgagtgacatataagcatagaaaatcatccacagatgctaacagtaggctgaattaaaagtataataggaacaaggtaaagcacaacatttacttaaaataacaagctatgtataaaacccaacattctcagcaatagaaaaatgaaaaaaatgcattctagtatggtgtatctctataagatagacatcatggaagactttaaaatgatggctttgatgaagtttaacatgtttaatgatttcataaaaatgttcatggtacagtgtcatttcaaagaaaaaaaagagacaaggtttgaaaaggtctagttaaagactatttgcaggggatttagtgacctctttggagagagctccttgtactgaagaaggagctgggcacatagagctgagcccaataacaaaaccttggctgtctgaaggaaggaggcattctaaatggaatatggcagctgcacttgaatgcttttccagggatgaatctctggatcctgggagaagcagagagcttttaagtaaagagatgttgcatataattccgtacagtatcaggaacaaagtgagaaattttaacatccattggagcagctacaaagccaaagcatggccttgtgatagctgcttgactccctgggtaacaatgagacctaataagccttggggagtccagagagctgctggttctggtggaagagcagtggttccaagaagggggatgtgttcctgtgggacacatttagaactcccagaaataatgaaatagattgtgtagaagaattgcttcagcaaatgtgggaaaaaactaatgaaatttaaattattatagttaatgtaacctcccttgttgcattaggctagaaagtcctggcaaaatttaaagattcccttacatagctatagaataggaaaaattagaaagttcacttatcaaaagcttgttataggtagtgatatgggctttacaaaaagaaaataaagtaaaaaatactcaataatgcaaaatccaaaataaacacaatgtaatcatagacctctttaacttcaacagtacaatactgtttcacagcaaacaatcacttcactgttacctgagcttggttaggatttgcctgaagtagacagccacgcgttttataggaacagagatactgatgaattcagaaatattttatgagagaagcgtctcccaaactgggaagcctcacctaagaaatatgctcagatgggcatgacagttgtttcaagtggtgaagaccatttccaggaagaaaattcacaaaaactttttgttcagaattaagaacaaaaaatgtgcaatacagagaagcaggctcacagctcagtataaaggctggtttctaaaaggccagagctgtctcatgacagatcaagctgcctggaaaggcaatatgcgttatgtcatctatgttcccaggaagaagctaccagacatgtgctcaaggcaagtcaagttctgtgccagagaagtgatgagcctgcgtgatgtctacattccttccagtgctaagattcaagatcctcagatttgtgtctggggaaaaacagtattacttggaatgattgtaattttcttggctatattgaagtcatacagtatatttaattagtcattatattcccagctttatacaggtatgaatctattcctcatgggagtgaaaactatgccctgaatgcatataaatggcattttaatctaagataaaatagaaatccttgatttagttccattagttctaggtctctgaaggtcttcatatttaatggctggcatctttacttgctccttcagggttctgcaaaacaggagtttggggtcagcgttcttctaggagtagagtcaggtcctgattcgatttcatccagaaccaaagttatgttgctctgattttagagtacacagagctatagcactgaagataattttgagccttataagctaatgtgatatttctttcagtgtgatcaatggaagttgaaaagcaggaagagttctttctgtacgtttctgcacttggtgggagtgtcattggagagagtttggggagggaggaactgacaccattcctgtctactttatgccaaacctgtgacagagacacacagagcctggagagctactggagtacctctatctgtagacgaggaaacaggagcttacaggggacagtagtttagtgacatgtagagcccaggttaaaacacagctctgtcaaatcaaaccttgtctactttcaaacaactgaacacagcaaaataattacatgagtgtttttaaatgttgtatttcagttattgaaaaaagaagccactcactcttattttggaattattaaagtagcccagaatcaagatttaagtggaaatatttaagaccaaaggcacatttttttcttaccttcaaaatatttcgggcttcatgtgaaactaaagcctttaataagttgacctcaaagattgaaaagaaaagcagataagcaatttcccggtaaagaaagattgctacaaaatcgctgtagactgtatggaaatttcaaagggtagtgaaaatgtgctctgatgcccaaagtgaataacaggatgtgtgactaaagctgttgacctacgaccagctaactcacctcagaacctacggagctgctgacgttacttctcattttctttctctttccccttcctctctttgtccttatttttgattccaccctctgcctccattctgcttcctcctcttcaatgctttctgtcatcccgtcttccttctttattgtttctctaattgagcctaatatgcaattcattgtgaaattaacatgaccctaatatgaaaatgtgttatagatcacgaaaaacttcctgtctactactatgtgtcctgttaaacccaggttgctgcaatctgtttctttctctgataataattttgctttcattgtgctcagcgtgggttcttctgagctcactccaccctcgccctgggatgtgtgcccatgtggtgagcacagggaggtgggagtgcactgttaattctcttcctaagaaagagaatgcgccttgtccctgtctgaggaagacttccgagtacacagactcagagtcctgacagtacgtccagcatcacagaaaaatctgccatggcattttatattcctaattgttcctaatgtcaacagaataacatccaagagaattcacataaatctcctgttgagaaatttactgttacaggagcttaatacttcgtaatgcatgtacagcctaaatatgttgtccttggatggagaacacattacttattaaaagccaggagaacaaacactctacttgatcttagccaaaggctaaaaagctatgaatataatggtgggagttcacggcgctgagagcaacacaaaaccactttagagaacctgcactgtgaattctggttcttctcagctgatggcattgcatgctttctttaacctcatgattctgtgttttagaatgaagacattgtgctgctaaccctcataaaagcagggtaaatgatggagaggccaagcacaccctcaactcgtattgacagaattatccctcaaactcccagagttatttgacattattaacatggtctgtagtattcattttatttattctttcaaaaatatttgtagagtaccttctcaattacagtcagtcacaagaccgggccctgtaagggttaaaaataaatactgaaatataagcaatatgaaataaattcctgcttctaaagttacaggtctaggagggagcagacagccccgggcttagaatcctaagacttgattcaagtgctgcttctgccactcactctctgagtgaccttaggcaactcacttacacctctgtctctcactttctctcctcataaatcacagattatatccagctcctgggatgttatgagacaaaacgagagaatgtgtgagaaactgccctgggtactctgactacacaaaaataatgcactgcaactaaagtattttcaaagtctagtataggatacaatgtgtggctccgaaacacaataagtgaaaatagaagagggaccttaaacaagcaaatggtgactttactaaagcagtgacaacagaactcagttctatgggctcagagaagagataaatccatgagtagtaagggtataaagggcttccctggggaggaaacgtggcacagaaacggaactaagattaattaaggatgggcaataggatggtaggcattattcccattgtactcatgtggaagctaaggcttggaaatatttcataacaagtctgaggccacagtagaaccaatacgtggcaacgcctacatttaaaaccagtttacttttattttttttcatttcaaattccgggcacttaaaatactagcaaccaactttgaggctccaagaagctgtgtgtgtgtgtgtgtgtgtgtgtgtgtgtgtgtgttttgaggaagtgggcatggagtgaaggaggaaagtaagaacaccacatggaaaaagcactaacaagggtggccaatgcaacaatgcatgtgatgtatttgggggattatggatggaaaatccagctggcatagaggtttgtgccgtgaaggagaagaacgcaaggtggtaaaagcatgctgagaataagtgaatatgcaaaggagtttggacattttccactacaaaataaggcctctttggaaatcttcaaacagaggagtgatctaatccaggtggttttaagaagatgggtttggcatcatgtaaactaattgactggggaagaaacagaacaaaaaggcccttgatctgcagagatatggctctggcttagggtagaagagacagaaggacaggaactggtatgaagggagatttgagaaaagagtgactgattggaattggaattggagctgaaggtggctgtgttaaaaaatgactgtaggcttcaagcttaggtggcagaaagaatgatcatgacattcacagaagtggggaagtcaggaggatgctgatatgcagggaagaagagtcagcttacacccattgagttcagtggcaagacagtcaaatggaatgtccgataggtaggaaatcagagcaagactagcaatctgactgcagactcaggagtccccgaggagcctgagtgagttccgtggaggtgcatgatttccatgggagcaacacactcagaggcagaatgactcaggaaccacgtcctgggagatgtccagcgtccagctgtgaataccacaaacttttgtctatagtgatgatgaaatattgactctggaattttggattttgtgccttaagggaagcttgcaaacggtggccaagcacctagagagagaactagtcatatgatttgtttatttcatgcctgctgaataattgtttagttaataaatgtccttatgtaaatcagaatttaatctaagatgcttttattctaattaggtggtgacattataaggaagtagttaactcctctcacctccaacttcactggcagttaccaatgtccaaccaaaacaaccaaaatgtgttcataataatattggtttaggtcagttgccaaaacagttgaacatgaacatctagccttttaaaggatgaagattcattcataatggttcaaccaaaaagaaaagaatggttttagaaatgttttccaggcacatttaatgcaaaggaaagctctagtaaaacaattatctgcttgacttgttcatttcacgtggatggggattagaccttctgatcaacacctgcctattcaacatttatctatatatgaaatggcttttttaatgtaagaattttttccccttaggggctcatagattaagccgtggtgacagagagcaattgcatttttaagtgttactacttaggtataaatggtgatcatctgatttaatccctatcccagtgggccatcatgaaaatacagctcatatatacagctcctgtggcgtgcaggacgttaccatgtggtatttgccaatatgggacattgcactcatgtgtatacacacacatgcacagacacacatgcacaggcacatgcacacacacagatgcacatacagacatggacacagacatacacacagacatggacagatacacagacacacacacagaggcgcacacacacacacacacacacacacacacacacacacacacacagacaactctagctatctctgaggtaattcaacaagccctgcagttggcttcatctttatattcagaacttgtttttttatctttcctttgaagagtaatcctatctgagacagaaagaagatgagtcacactgaggcaaaactttgtaggtagaaatgtgcataaatgcgcttctctaagatgctcatgaagaaaagacaaaagaacagccatgtcgctgagatgccatctgtgaggctggcacagtgaggcacgacatccctggtgcttcccggcagcctgcgagggctgcctccctccttccctccctccctcctgcttgcaggtccgctttcagagccttccctcagggcttatgttccactgacctataaatgtttactgtaattataccaattgtcacctcctgcattgtccaccattcttcttgcccttctctatttttaaaaattttgtcttcaaaatagcatgcttcacagtaaaaatctcaagtgaaaatataataaaacaaacaaaacatagttcatcaaggcattcaaaacaactctttgtgacaacagtttaaaaaacagtgaattaatgatgaattgtgcaaaaaaaagtttaagatgccatctctgatccttcatataacactttttttcagctggaaaaatccaagaatgaatgaaagagcttgtagataggcccagacagtgggcagcatggctcttctccagcctgggacacagctcatcactcagggtggatcctggagagaagctgcctgagttcagcctttgcctatcccagtactcactgtgtgcacccagaggagcttctgtgtatctgtgagaccctgtttcctcatctgcaataccaggactcatatcctagcggggctctgaaaactagatcagctaatgtaaggcttggccatgtattttctcaagaatcgttgctgtgaaagagccagtgaagtcacagagggtaaagtcaatggtcaaccttcctgattaatgaatattgattgagcattcaccatttaatagttagctccttctaagtctaatcgtttttagtttctcctgacacctgtcatgtaagaggctctatatgtgaggatagacttagggggcagttggttcctctttttggacacagaacaggaagaataaagagatctcagaaggaaaaggaaagtgggaggaggctgggtctgtgggttccccggtggatcacgctgaaagaatacctggcagacacttaatctctgcggcaaatgcatgaaagtagaaggatgaagccaactttccaaaaacttttatgaaattacttcagtgagaaaacctattaaataaattacagccattctataaaaatagaattctatgttacttctatatatatacttctactatatatacttgtactatattacagtagaaatcagtcaatccaatcccctattgggcagaagggaaacttgcctcggaccacactgtcggctggggtccttagcacggtactaggtctccacctccatgcactaccctggttcagagctggtgctatgggttgaattgtgtccctgcaaaaataggctgaagttccaaccccagtacctcagaaagggactttgcttggaaatagggtctttagagaggtaatcgagttaaaataaggtcattagagtgggccttatctgatgtgaggggaattcttataaaatggggaaatgcagacacacacatatgcaggaggaaggcactatgaagaaacaaagagagaagacggctatccaaggagagaggcctggaacaaatccttgcctcacggttctcagaaggaaacaaccttgacaacacattacttttggatttctggcctccagaactgtgagacaatgcattttggctgttgtaagccacctaggttgtgatacttccttacagcagccctaggaaatgaatacagctggggaccaggcttttagtcaaaagatcagggaggaagtctggtgtcttgggagaaatttctagattataggagtcactgaatatcgtaactttgaaaaatccattttgaatctcaccagaaacacaaaagcctgtagaaatccaattatacaaatttacagtctagaaaaggaaaaaaaatgaaattactcttcatgcacatttaagcagagtttaggactggaaaataaacaaggctttggtaactggggagtgcagtgctaacaacacagttgcaggtatgtggctgtgtgggtttgagcttggctctgccttttaccaactccgtgaccttcagtcactgcccccactgtcttcagctttctccaaaaagagtgttgtgtgtcctcttggaggccataccctggggtgctcagcacagggtttcacacacagtgactattaactggattttagctcctattataattactaatagcagataattgccttattaaaaaaattaaaggcaagcccccaaaagttaagaacatatgtacttgtttgctttttcatcttcttagatgacacttattttaagttttctttgtatgtaattcattctagctctcttattcagcagtatttctttcatttgaaaacagcataatatttagatgccaaatgtgatcatcaaatgcaagaatatggatatcccactaagctatctagttatgctcaaacccaaacaagtagaaagcccttatgtacaaagtgattcttttcatgaacttggaaatttttcaaaatcaggttgctgagttctgatttggagcagcctgtcgcaataccaaatcacctttgaataaacttatcctctcagcttttattgttcagaattgatttcgaggatagaaattccatttccttgtcatatatacctgagccgttgcatcaaattgtcagatcaaacctaaaatgcagcacttcgcagatggaggagagacattctctctaaaaaaaaaaaaaaaaaagtcaaccaagtcagaagttgtgaagctgctgaaaaaagcaaaaataaacactcttaagcaggaaaatagaagacctgttgcttgtgggaaatagattttctagaagttagatcagctggaaatattgtcatggacatgccaaaaggcaagtgaaggaaatgtactgaatgttgttggctttgcactaagaggatctcaggaagcagttcacaagagtgccaccacatgcatggaaggaccagctcgttagatgctttgggcaaataaaaattttctgtagagttattttgttctgctggagccattaagtgctccttgctacatgaaatggtatatagcccttcaaatgggggcatttagcaatataaaatatatttaccctgtccgttcttgaggatcactctttaactgtagagaatatgtcttctaaggcaccagagacatccagagatagagggctgctgatattaataacacataaactttgggtgaaggcataggggaagccagccctcactagaactccactatgcaggcaccccgatctcacactgccagcctccacaaccgtgagaaaataagcatctgttgtttaagcataccctctcttcatagggattattggagcctagaagagtgcatggacacttttcattattattattattatttactagattatcaccccaacagaataggaactgaattcctttttgcaagtaggtgttcaataattatttgttgaatgaatgaatgctatggctactatatggaatttctaggtcaaataggagcagaaggctgggggtatgggggcttgcacttgtaatcccagcactttgggagtccgagtctggaggatcacttacacctaggagttactagcctgggcaacatagggagattccgcatctacaaaaaataataaaaaatagccaggtgtggtggcccgcacctgtaatcccagctacatgggaggctgaagcaggaggatcacttgcacctgggaggttgaggctgcagtgagctgtgattgcaccactacactccagctgggatgacagaacaagtctccatctctctctctctatatataaatgcctgtgtgtgtgtgtgtgtgtgtgtgtgtgtgtgtgtgtgtgtgtttgtgtgtatgagacgaagagcaaaattcaatttagtcatcgtacccacatgtaatcaccaaaaaattttttttaaaagctatttataaccaaaaatatcttctatcaagttgtggtaatattacatgaaagcccattttgttctgctgagcacttgcgtagttctgggagttaaaaggtggatggagcaggagagacgtaaagcactaaatgccattaagtaagaaaaatctggagttcctataagcaatttttgaagtaggagaggtacggaagggtaggaatgaaagaaaaaacccaagcaaacctagcaaaaggctaacaccttccatatagaaatcactgggtaactgactttttaagaatatgaaagtctaaacacagtcacttctcacattatggtgaacattgcttccatttcttcaaaccatcagtaaagtgtggtacaatgcagaaatcccatgtgtgaacaagttttgttttgttggggcagagggaaggctggtggttgggaaaactaaggaaggggctcagttctaccttgagcctctgtggtatggaaaaaagagatgatgacagctactgtgagagaactcctaaacgcaaccaatttggctgaagcagagatgtggggcctggtgtgatcaaggattcataaaagctttggagagaaagcagaacttttcacaatctgtacgatggggattgcagccaattttatttagccctcaggaaatagggtgaccccagttgacccccaggggaaaaaattccctatctcataaacaataaaaatcttaactaaagtttaatatgatagcaaccagaaacaaggcttcctgttgtcctcagacaaccgaaagttcatattcacacacccaagtaaccacacccccagcccctgcactgtgcaagtgaacagtttcattgacaactttggggtctgttttgatcttggagatcttggagttaactgcagagaatgactggagtggattttatgaagaggtattttataaatgcttatgtgtaatgatgagggaaattgaagaaagtgaaacaaacagtaaaaccacatgggaagaattcccgcagaacatgagaaacagaacttgacttaatgaataaaataacagatggcatctcattttttattgggtgtgtaaagaatgagaacctgaaatgcaggtttggttattcaagtgaattagtaaaggagatttatggttttggaagaatcagcagtcatgggggggcaggaaatggttataagtgacttttagattctgtgcttgggtgactaatgacaaacatagcatagtaaaccatcggaccatatcatgcaaacaggctgtgtgaattaattttgttttgctttgtcttgctggggaaattagaaggcttaaacaaagcagagagaagacatctattggattgtccaaaatactgtaaaattttggcaatgtggtatctataccaggcaactacaacttctgtcttatttggtttagatacccaaggaagtacaggggtactctgaaatttacttcgagatacaaatcttcaattattcacaagctggcagcacaggtctttaagtctattgtccttgtacttccctagaacacatcatcttggcaccagatctgctttacctctcagaagtttagagcaaaattctacgaaaggcaggacttttaacactccctcactgtggggtgtttaaaaagactattatggggagaaaaatgaattgctgaataagtagtatgtggaagaaaggtctgtgttgaatgaagggaggtctagtcattaaaaaagaaaaagaaggctcaagccacagagtttttatcgtgtgcctcagccactggggaaacagtttcagtgcagtattatatatgaaatgtttcctattagaatcaaagttcccacaatggaacatgtgcgacaatactaactaaacactaccatctagtggccagttttgagaactacaaaagctcgcaaagtgcattaaaaacaccgtgaaagaaatgcaacaaccaatgaaaagatgtttaattttcccttagtatcagggaaaataattgatcacactatatagtaaatgaagatatgtgtatcaagtgctgctattctcaattacccttaaaacttagatgggcttgcagggagtctcaagtgcatgttttgctgtttatagcaccagtgtagagatatttccaccaatgacaaataggctgtaaaacataaaatcctttagaaaagtgataaaaatacaatcagtatgaggactttgcttcctcttcccctccccacccctacccccctactatccctcacacctaacacctctcacaagttgctattgtatagctggcatagctggaggagtagaaagagtgagctcacagtcagcaaagctgtgtggtgcctttgttccacacacttctggctgtttgagcctaggttagtcacttaacctttctaagactcactttctaaaaatacgcaaatatgtaaattgttgctcttccagtctccctgggtttaggggaaaatagaatgtgtacaaaaatgcattgtaaatgcaaatgtgccatacaaaattgctattagttttaaaatctctaagtgaggatgatgaggatgtgaatctgatatttgaaggtgctaaacatttttttaattttttttcaaaaagccatttttcttaatattgttgatttcctgagacaaatatctttgatctgggttgaataattgtgggaattctcaagtttatcctgcccctatacacgcagcaaaagaaagctaattaacttgtccaaatttttacattgaatcaaagacgagactgagaacaactgtcatagcttgagtgttgaagtttatcaatctaggaatcctattgtgttgttaatgtttccccagtagtttcagtaagtaatgtaaacccatgaatctaaattataaaatggctacaggtaaaccatgacaccaaatttcacttcatatttcattattctaagatacaagggcagaacctaaagaaagggtaaaataaaatggacttacattagacttactgacaccatcattatttgagaaagagctatttcctaggtatattttaggaacttatctggtgatatctatctatctactaactttaggagtggggtggaattaattctttttacaagattagtgaagttagaaacaactagtttctaattgattaaatgtaacctattttcaagtatcttcatatgactgaaatcaatctgttttattttccaaaccagtggaatagacacagagtcattacaaccagaatgacatggcattgttacaaatcttagtattaaagcaatacttctgtttttatgtataattattttataatggaaaatgtccctcaaaatcagacgatttgttccacaatgaatcatctactccaaacaactctgttccaataattaatgacaagaacaacaaacacttacccaccagatccttatggtaaagctaacttcagacaggaaatgcagaactcagcagagttcattatttttcatttctagatcagaacaagtttatctaagactccaaataaagttcatgctttgtgcaacgtgcaaatgacagttcattatattttcttgtttcacagagaaaaactcagaaggaaaacatctacaggagatacaaataaagaagggctaggtgtttctgaaaataatcttccagaaaaaaaaagtggccctcttgaaactcatcaggaaaaaaagtacttaagaaactctaaaacatttttatgtgttagaatcaccggggtaattttggcaatctctatgcccagatcacagcccacatcaattagaagagaacctctgggacatgaagatcagttttttgttttgttttgtttttgttttcattttttttttaaagttctctaggtgatgccaacacgcagccatatcccacaaacactttagttaagaaatacatactttgaagcaggaaagtaatgccctttttggggaaaacagtcattatatgatcacagattatttttataacttccatattcttttttttttttttttttttgagacagagtctcactctgttgcccaggctgaagtgcagtggcgtgatctcagctcactgcaacctctacctcccaggttcaagcgattctcctgcctcagcctcccaaatagctgggattacaggtgcaaaccaccacgctcagctaatttttgtatttttagtagagagggggtttcaccatgttagccaggatggtctcgatctcctgacctcatgatctgcctgcctcggcctcccaaagtgttgggatcacaggtgtgagccactgtgcccagcctccatattcttacatgagcaagaagcaagaattcattttatcagtatgtaaattgtgaaaaaaacacatgcaggtgagaagcaggggctataaggatgaaatcaatgggccagcagagaatacagtgcatgaattcaatagtccctgcagtgctccctgctaggcagtgcagggatatagacaaatagtggcctgatgtctttaataagctgataaatagttggggccaccaatatgtaaacaaagcaagaacatagaaaacacgctccaaatgggttacaagcagagttgtggtgtagggcagaggaagataatagatgctaatgatttaggatggtaaatacgacaacaagagtacaatctctacctggttgattccaaggagtttaaaaacgtaaatgcatgaatgaccagaggaatcctcaccaggggagtacggcacaggaatataaacgtgacttgatgtgcaggctctaaggcagtggttctcagaatgtggagccaggtctgcagcgtcactatcacctgggagctcattagacggtacataattggatcccaccgcagacctacaaaatcaaaaattctggggatggggcctagaaactccttttttttttttttttcaatttgtctctgccacccaggctggagtgcagtggcgccatcttggctcactgcaacctccgccccccgggttcaagcgattctcctgcctcagcctcccaagtggctgggattacaggtgcccgccatcacgcacagctaatctttgtatttttagtagagaaggggtttcaccatggtggccaggctggtctcgaattcctgacctcaagtgatccgcctgccttggcctccgaaagtgctgggattacaggtgtgagccaccgcacctggccccagcaatgagttcttacaaccacttcaggggattctggcactccaggtaattctgatgcatcctaaagtttgagaacgagtgctctaaggttttcttgaaaataaacaaatacatgaaattggccattttatcatcaacattcactaaagtagatggtagtatgtattcactcatgcttcaacacagacaaggtcacgtgggctaggaaccattccacaggacagcaatcttaggtaaggtcttaaaataggaaatagaaaattagttgttttaaaaagtgagggagtaaacagtaatattaatgcaaacttgctgattgcaggtactcaaaaaatagttacaaacttgtattttatatatagcttataatattttagacttctggaatgaccatgtcccactttctttttaatccctaacttttatttattcattttctatttctatagtttttggggtacagtgggttttgtttacttggacacattcattagtggtgatttctgatattttggtgcatccatcaccggagcagtgtacactgtacccaatatgtagtcttttatttctcaacttctcccaatctctcccccatccccaaagtccattattcattcttatgcctttgtatcctcagcgcttagctcccacttgtaagtgaaaacatgatatttggttttccattcctgagttacgtctcttagaataaatggcctccacttccagccaagttgctgccagagacattatttggtttctttttatgactgagtagtaatccatagggcatatataccacattttctttatccactcgttggtcgatgggcaacaagtttggttgcctatttttgcaactgtgaattggacaggcctgtgcatgtggtctttctcgtagaatgacttctttccctttgggtgaatacccagtagtgggttaaaccctaacttttaatgtttaccttaattttaaaaatacaatcacccaaaaccaaaaatgaataaattataactccattccacacttggataaatctcacaaacctactcaaagaagctaaactcggaagagtatacagaatattacttcatttcataaaacttaaaaacgaggaaatcccccttgtttttggtatcagaagtccaatagtgattattctgggtgtgccaatagcgttgtttctttttctattttttgttttttcttttgagacaaaatctcgctctgtcacccaggctggagtgcaatgacatgatctcagctcactgcaacctctgcctcccaggttcaagcgattctcccacctcagcttcccaagtagctgggactacaggcgcacaccaccatgcctggctaattttttgtatttttagtagagacggggtttcaccatgttggccaggctgatctcaaattcctgacctcaagtgatccacccgcctcggtctcccaaagtgctgagattacaggcatgagccaccgtgccctgccacattctgtttcttaatctacaatacatttgaaacagaagactttcaaaatgtatgtaatgaccctgtgtgtattccactggtttggaaaataaaacagattgatttcagtcacatgaagctacttgaaagtaggttacatttaatgaattaaaagctagttgtttctagcttcactaatcttgtaaaaagaatcaattccaccccacccctaaagttagtagatagatatcaccagataaaaggtcctaaaatatacctaggaaacagttctttcttaaataatgatggtgtcaggaagtgtaatctacaaagtccccttctagttcaccctttctttagcttctggtgagccaagtgtgttcacttagtgaaaattcattgacttttacacttacaatttgtgcacctgcatttatgtatgttttgatgcaaagttcaaaaaatataagaataggatgaatgctatgttagagtttaagaagtcaggacattttcacttccctttggcatttaaagatgtgttggatgttggggtactgctctcagtgaatgctggagacaggcaatggcacatcatccaatacagtgaacaaaggcaagtggatagggatatttagtccttgggattctaaaaatctcaaagaagaccacaggaatgaatggtcagtttctgacgatgcaaggcaatttattctggctctaataagacctgagttaggacaaggcaaaactgtgaagtagatgagattgtgaacagtccccgaaataactgttgggtggcctgtgcctgcaagcacttttgccacctccccgtctgtcagggtcactctcctattgagtctctgccactgtttccagccattctccaaatcttgatttaatgcttctttgcccctctcccactattcctccctactacccctcttatcctccttatctccttccttttcatcaaaacctacctgttttctgtttcgttatctcagaatctttgttattagccagttcaataaaccactgggctccccagccatgctaacaggcaggtcagagctgagaagctctaagctggttatgaaactgagggagcttcactcagacagcgttcctctccaaagccatatctggattttactggggcctgaggaccttaatgaaagggggaaccaactcaccttggagcagaggttctctggctagcgcagaggtggcacagtattgacttgctctacctcactgttgtcactgatgtccctagacataccctgagcctttttctggagacctggaaacagttaataccagagcaagtccccacttatcaaaaggagcagcctgccaaaaacaatgttgtttttagacaagtatgttttaaggcataaactgaagggctaatggaacagccattgttctaatggatttttaatgaggtgtaaagttctcagctgattgacagtcaacaaggtgtgaaattttacagaaatattgcattactgtgaaattaatctcttttattcaagtttattatttcttgaatctaaaagtcaagaaaagcatgagaaagatgactattaaaatttctacttccctataattaataggaaatagttacaggactacagttaataactatattttttcaaatatttttgaaaattgttaagagagtggattttaagtgttttcaccacaaaaatgataagcatgtgaggttatacatttaattagctcaatttagccattacacaacgtgtacatatttcaaaacaatatatagacaatgaaaacatgcaatttctttaaaaataaaatttctattttcctttaaatacgatttgaaatcaagagaaaaattatttttcttggttttattttatggagaaagttatggaagtggaagggacatcataaaggcaggacttttctgagctcagtttcattgactgcccaggtgccctgggagtgataatgacctagtagcaaccaacgagcccctttctggccagcactgtgagatcaatgctccagggcattgggttctaagcccagggattcagcatctaagccacttgggttcaatacccctcttagaccagacaaaaagaggtcctgccctgggagccttagaaggcccactctttcccttctccagtcctgcctcttcctttgcaggatccttggaatatggtcacgcagagccccaaaccaatgtacttttagaccgtgacctgggagctcatggcccgtatcagctaacagggcctgtggggtcccatttcccccatgcttcttctagagggcagacatgtcaccagtgtgcacaaccctatgcctgggggtggctacatatgtagtatgagggtaggaggtactgggccaaaacgcaggcacctgggctggcttgtccccacacacacacagaggtgcttcgtggttccagacagagccagatgggaagagaagagcagagcgggtggccctttccctcaacactgagggattggaattgctgaattggaatccggccttccagacaattatgaaagcatatttgtcaaggaaaaaggacagacctttaacactgagggagcagatagaaccgaaacattcaggttctgcatttgaacttgatcttccaggtctctgtataggcttaagttgtcaaggaagtaggccagagcttccttcacagttcattaggctgatttacaacttttaaatatttagacaagtggtatgcaggctcccacctgtattcttacctcacaacctcaaaatttcagaagcagcctgctctgagccctacccaagacctacggagacagacgtctgtggtggggttgggaaatctgaattttaagaagctcttcagatgatggatgcccatcattcatttgcctatcactaccttagacccttatctccactgtcattttttaaatgctgagtccatgtgtcaacaaagtagcgttgaataactcatttgtaaaaagtggaagcagaaaaatgacagatttcactggaacactaggcatgtgccaaacccagctctgttctgctcaggaaacaggcttcctgagcccccatgggcttgtggcttccagtctgattttcctcagcccagtgacatcctgtgggacagctgtcattgtcctccatagtcattccaacttcagataatgctccctcttcaacagaactttctcttttaagattggccattcttacttcctggttcctgaggccaatttttgacccaatatctattttcttctcctaattcctctactctgcaatgcccaccattttggttttaacatacaagtgtttaacccagagctctttgatttctcctggtaggtgagaaagagtatttgtttgggcaaagcctgctaataaaccagcagtacattgagatcacctggggagtcacaaaattcccaagcctaggccccattccaacctgttacatcttgatctatgacgtttgtgtgtgtgtgtgtgtgtttgtgtgtgtgttaaaagcatggggaacagataagtttccattattctgctcacacatcaaaagtttcaaagaacccttttccccagataccgagagattttggccattcctttagtatttttacagcattaaacaaagactgattatgaatataaccccagcttattgaactgtgtgcattctcttaatgcctgcaaatgctgcttgcaagagtggcctcacaccaaaatgtaccccaagttcttctgtaaagacaacttgcagccaaggacagctagcaccaacactactgtcttccagaattttaagtggaggctgaaaggctgaattagttaaaactcccaggccttcttggttaggacagtgttcttgcattcttttttttggcaggggggccgggggcactattcaaaacattccagtgacatatcgagtcactaccccgtaatttaaaaatataatgtaatatatgtactttatggaagtcgaagagttgtgctttaaatttaagtaccgtgccttagttggcgcctctaacatagggagttggacattgctaatgatttgccctcattaagcaaagatctttgagatgcttctatccattaaatactgtcaatgtgattcctattctagctagttggtatagagcaccaccattttcaaaattattaaggaaaaatcacatctaaattaagccaaagggactagacccatcgaaagtgagatataaagggctttgggcaataaaatcaaaatcatttgttagttgtgagaaaacttaaatcttaccctctagtttaatttttaaagtgtcgaaggaactacaaaatacaaatttcccaataaagaagaaaatcaagaaaaagaagacagtactagaataaatcataccatttggtacatttatgtaccaaatttaccctgggtaattcctattttctcaatttcagcaaagaggagtaattttaggatatagtattgcctgcctggattataacgatgtgctaagaggctgagcatgtgtctcttatgtacatctccagactgtgcaggcggagctcaagttggatttggcatcaaggtccaagtttagtcattaatctattgatgaaaactgtactttattttcccccattgaagaagggacaaaattcaattccatcaagcagtcttctttgtacagctctattctactcctgacttagattcagagtcagaggaccagagttagtgctcactccaaactattaacctttcatctagggcccggggtccatctctgcctagagagcatgtgggaacccctcgattgctttattgcatcgtttattattacaaagaataatacacatattgaataaaaaatgtatactgcttgaaaggcaattaagcgacttctcataagtcacgtgaatcctgaaatgtctattatgttttagaaacccaaagataattgtaattccattgcctggttaagtcatgctcaagaaacacggtgctccttatggctgctcgtcaatcctctcagcggccagcagatggcgcacacttctcagaaacatcaaaacgtggcgtgggaaaacccgattccgtggggaaggcgggccgcctaacacaaagctgtctttccgtaaaaatcagtcggccttcacagggttacagaaaattattcattatgtacaagagcaatgacgttcagcaatgtatacagttgctgacagtcctaaagtgggatatggaacaggatggttcatgcccatttttacgtatttgaatttatttcttctctgggtactgtaagtaaatgaatgttattgatttttccttatgtgttaagtgctgcaccgatattttaaatgatgactcgtttctactgggaacttataatgaaaagatggagcagtagaaatagaaaacctctgggccatctccttggtcaaggttagcaggttagtcctttggtctagctctgccattcagaaccttggaccatgcatttgctcccacccctgggatccaccatctctccctggctccttccaggtccaccagcctcagggtcactgcagtctcagaccacctgaaacgcagaagccccgcctattttgctagctccctcgttcctacgtattcccatttttccggcttatttaaagaataaaacaatacaaactttaatggctatttgtactttttaaaaatcagtgcattttcatttgtgtactcttgtggatttgggcaacagctgaaaaatcaaaataatttgtatctttattgatcttgaacaaatgctctaagatgcatacatttagcagatggactcacttatcatgtgggcttcttttcccaaatgcagatgggatggaagttgacatgaggaggcagtataataagttaggaagaatctggacaaaggtataaaggagctaaacggaggctgcagaatgtggagtgaagagctgggacaggtaactcaaggagaaagcagagagaaggaaagtgatagcacagaggcaaagggaattgactgacatccagggaaatgtgtgaatttgtccagaatgtcctgaaaactttgtgccgtgggacagacctaagacctggactatattcataaaaagaaacatgattttccctggggaattttagaccaatcagaaagactcctaagctctgtcttttcaactttccactctacctcattatccaccaagctacttttcccacctctgttcaattgatttcggaaagagatgcacataccaaaaatatgcaagtctgccacagatttattctttctcactttagctgtgtcctcagtcgccattttaatcactctcaaagaatgctctcccatattagctacaatggatatttcaaaactctcttttcaaactccctgacctggctggtcttcactctcattaaatgatttcatgtcctactttcctgactctcagcctctctccatgagctcaggtttccagaaagcagtcatgtccccagcctctctgccttcgagaatgatcctcctcttgtctcaggctaacctcctgtccagctgcatgaagcctcagaacagagaagaaactgtgtgagtttcagactctggagttttaggtttgaatcttggagctgccactatctaggcacatgctcctaggcaaggtacataacttttctaagactctattttctcatatgtaaaaacgtggtgataatacaacctcctttgtatgatatgggaatttcctgtatgttatttgtgaaaacactttccctactacttagcaataaattccctcatatctctaccagttgactgtgaagaattttaagcccagaagtacattactttccccatcgtgagggttgagcctagcgcgaggaaagtgactgagtcctggtcccacaaacctgtgaacctaccctctcttatgtcccaaccactgccatcttttctgatagtaccattttgttctcatttttaggctctactatgttctcctgagccttacaatggcctttcctccctctgcatgtctgttcttggatgatcctgtgcactgtgataactctagtcttggaggtgaatctgaggtccacgtctgaaacctgaaaggcatctccttttatctactaccgctttcaaggagatgctcttcaggtgccactgattctggcatgccaaaaagttgcatctgcaggatggttgtagccctgtttataaattcacaggctcaatttcaagaccttatgagaccctcaaatgtatcaagtggggccaggcgtcatggcacctgtaatctgaaatcccagcactttgggaggccgaggcagacggatcacctgaggtcaggagtttgagaccagcctggccaacatggtgaaaccctgtctctactaaaaatacagaaattagccaggcgtggtggcgcatgcctgtaatcccagctacttgggaggctgaggcaggagaatggcttgaacctgggaggcggacgttgcagtgagccaagatcgtgtcactgtactccagcccaggtgacaaagtgagactccatctcaaaaaaaaaaaagtaaataaataaaaaagtaacaagtgagacaagtgagataaaactaaatccagtttataagaaagccattcctacagccaatgcaatgttatctcttatcttcaacctgaagcacaagctgatattattttgcaatcttattagcagctcaaacagctgtctctgccagtaatatacacaattgaagggatgccagagggcaagcaccgaacctggctgcaaagaaggggaaccgttccccaaattttgccaagtcaggctgctgtatttcatttaaagtgggagacataataatattcctaaattctgataccaatagggttgtttatcccttctatacctggaagacttgctgtaatattttttctcatttgtttctaagtacttaatatcctatgcagggggctattttctgggcatttgcttatggtccaaggacaatctgtttggatgcttacttgctgttctggttaagcaaacctaatggttcacaactcccttacaacaatcagggagttttggcaaagattactaaccaagtcaagtttacattggctcaagcctctcctacatgaatgccaccaataattgttgctgtctctttattacacgtctttgaggcactgactgcctccataaaactggagaaggcatatgtgtatatatactatatataatgattacccaccagtaccagctttaatgttttcctctccacctaatttctttttgctgttcaattttcacaagcatacacttgtacacacacacacacacacacacacacacacacacacatatgcctgtcattggttacctttcccccggggaattaaaatccgtatgattcaataaggtagatttatttgccattagcagacaaacatgaaaataattcctaagccaataaaattattttcaagtttttcagttttccttttttcttataatggcaagaacatttgactaagagtctagcaggggaaaatactgtattcacaaaagcaatgggaaaaaaactcaggcctgttaaggaaactctcctataaaatcaaattgcaaatttttcaaagttgccaatgcttggcacatcactgtctgggcaggataatctgttcttaccagtctcaactcagaaataacctatttatgattgcaaccatcatcttggcctcagggaggcactataggtcccttaatgtatctaaggcacagctgaaatacttaaaaattacctctgaaagtctgaaacatgacagaatggaaaaagaactcacagaagataacataaaactctatattctgtccctaagttaatgtaagagattcatacgccttaggaagacgagataatttagcgattgcgcttagaaaaataagtaaataaatatgagttagagatatggttggtgacactttttttcctctgggtctcttccttattttccccttgttccttcctggcactagggggcggcaaacgatgggctcctttatttataaaaaaagacagtttttataaataaagctttattgggacacaaccattcccatttgtttacttattgtctgtggctgcttgcatgctgcatcagtcaagtagttgcgacagagactgtctgtcccacaaaacttaaaatatttatgcttgagccttttacagaacaatttggctgacccctgcatgctatctatagtatttaacaatggatatgaaagtgacaatggtagatctaaggaacttcgatatgtgtccagccagccaggataggggccagcttcctaagacacatgtctagaatatgatgaaatcaccacctgccagtgagtcacatgcaggcaaatgacaccaacagaagaaacctaggaagcatatccagaaactataaagtattggtcatgaaccttgcaggggaggacataactggtgttcgcatctctgcttccagttgacagttcaccaaagataaaaacaacaaataaaatccagacctctcgccacaaaagggggtttggcttcaggcaggggcttagggctctctgctggggaccagctgcacttcacaatgctgcaaagcctgcatttgttcagaaatgtaattcctgatctgattataagagttcaaagctgaaaatgtggtaaggaggaggaaaaaaaaatgggttatgatggaagattttgtggtggtggtaagggggcatgataataataatattgaagaagtgccctagtaatttacatgagaagggaccaagaaggtggctaagaacagcacagagtctcagatatacacacgtttttgcacagagtctggctaataacacaaatgagagattttagcataataatgctgtattatcaaggaaatagacatcccatctgtggggaaactgtcaacatgagagataattgtggtagagaagagatctagaaatgaaggataacaaaagaaatgaaataataggcgcaagtccctggccctcctatgtgccacagtccaggggaacaggagagctgatgggagacctcggttgggaaaatcttatccattccaaaaggaggaaaggtcaatctctgaaactatttcatagttgattttagtattggtccctgaaaacatttcagaactcacttaatcagcagatagttttagaacgcaagagggtgaagttatgctcagggcagcaggcctggttggtgaggatggaccacaggtacggtgtggagggtaggtgggtaggctccagagctagtctgctgggttccgagttggctgtcttacttcctagctctgagacctctgcaagttacttaacttcgctcttcctcagtgtttttagttctcaagtgggcatagtaatgaaatggggtggttgtagggattgagttaatacatataaaagagttagaacaaatccagctgagactagtgccatgcaattgttagctagtgttcctggtacaactatcagaccaggggccaggagaatgctacagacctggctgaaactgaatttcaacaaagcatttcacaaatgcatacaaaatacagccaaggacctgctggaaaagtggtctgaggaacacaaatacatagattcatatttggttttacaactagaaattcatttcagcctaaggagacttctttaatttcaagccttgtgattatcctcagccctgtcctgatcgacatttttcatcaagaagacctgaaattattttattgtaaaaattgtgaatattgtgaagtattccaagcatacaaaaataactttcgggatttagaactgacaacaatgtggaaaagccatacatatctaaagcacgagtgaattctttcttactgaacctattcaaataaagactgaaagacctggcagtgaagggttggaagtgtcacatgaggcatatattgagatgaactttgaaaattctattcacacatgaagatgtttatgaagtattttatatatgttaggcattgtcttaggtacttggaatgtatgtaaacaaaataaacacctgtcttgttggacttacattcaggtggactccttaataacctgtaagttataggaattactagattttggtttaattctgaagtttgtcactcactatatataaacctgataagctccctcgtttttttctcatctggaaaatggcgataaaatgccatcctttcatatttaggatcattcattcgctcaacaagtacttcctactttgtgctatgctcttgggaaaaaaaatgaatgagagaaggatcctgccctcatggtacttgtatcttatattatccagaagataaaataaggcacttaccaaaaatactaacatttacatatcaatgaaaggctatgcctattatatctaatgatagcagcatggcctgtgagtctttggtcgtctttttggggatatacaatgtatattttggctgttacctaagccattctccaatattacacccctcactaccgctatgtacacagatagtctgctccacactcagaaaggtagggacaacaccctaggatttccataaagcttagaaggatttccttcctaagaaatacccagttttgctgccaaacactcctcccctcctacatgaaggcctgagtcaagagatatcgtgggtgggagaagttaccctgcatgtcaccagaacctcagcatgcacactttaaaatgaatttccaaatgcaaatttgttcctagatccacagcatggcaagtgagatgcagaagcctggttcctggaggaggagccagcattgattcgtggagggcagtgtcctctcacaggggtaagtgagcaggggtaaatcatcgttcccatgaactcctctccatctgctctccccactctgggaacactagtgtgctgctccacctccttctgccccctcctgggatgggctccagaggatgataggcagggcacctaaattcccagctgacggaaacgtgaatgtgctcagtagctaaaggtggctcaggaagtttggaagattagatgagatggttctccctctccctcatttagatcacacacattttccaacatgtaggggagaagagggagctctgtattttttatttatccaacaaatatgtattgaacatctaccatgtgtgggacagtgtcttaggtattaggaatacaacaaagaagaacctcaaatccttactggtatttagattactaataccgggaggagtgggaaagacacatagtaaacacattaatgacctattaaatatatgctgggtcaccactatggactgtattgcgtccctcaccccaattcatatgttgaagtgttgatatgttcccatcaattcatatattcctatcagctcatatgttcatatgttgaactctcaatgtcactatatctgaagatagggcttttagtcagtaaataagtttaaatgtggtcataagggtagggtcctaatctgaccttataagaagaggcaaagagctttctctttctccctacacaggcatgcaggcacgcgcgcgcgcgcacacacccacacccccccccacacacacacagaaaggccatgtgaggacatagtgaaaaggtgtctgtgtctgcaggccaagaagagacccataaccagcactgaaccaagctggcacactgatctcaagcttccagcctccagaactgtgagaaaataaatgattgttatttaagccaccccatctggtgttttgctttgtagccttgctaacactgtcaggtagccctaagtgtgctgaagaaaacccaagtggaataaaggggtggagagagatcaagagaggtggttagggagacactctgaggagggacattgagcagagagcccagtgaagctcacatgtatccaaaggcaagccctggcctggagtttaagaatggcaacactcaggcatggcagggtttgtccttagaagcaaatgggattgctgttttatcagcatgtttttgaaaaatagactgttctcttgcagagaggaaatgtataattggtgatcgcctagctgtgtgagcttgggcacgttccttaaatctcatgtcccagtttgctcagttgtgaaatgggataataatcatctttaccttgttaggttgttgggaggtttaaatgagttaatatatgtaaagtgcatggacccatgcctgaaacacagtcagtgctcaataaatagtagctattattattgctatcaatacaactactatctctattattacaacaactgctactactattactattggaaagccacaggcagaacattataaaagaaatttcagcaatggcatctttcaattaaatcttttctgagcatcttgggcctcactacctctgggaaaataactttgcttctttgtctccctcagctcctcagaagagccaaaccaatgattaagctcacgtgttgtgaactgcaaagtcatttgaacaatttcaaagccatcagtgacaaaggctttctcctgatggatctttctgcccattgaactagaacactcatggaaacatgttcaggctccctcactccatgtaggtcagactacaggtaaaatatcctttctggtgccaaaaactcttatcaggatgaagaattttcctctagtttccctggggaagagcaaaaaaaaaaagtagataaaaaaaaaaacacaagaaatagagtagcaggagtgaaggagaaaaattgaaaagaaagagataaatagggggggaattttaaggaccattagtaatttactgtggtccccaatgttgacacaagcaatcaaaatggacctggagaaggggattatatgggctgacattgtctactttgatctatacgtgccttatattggtagatctttaaagaagttacttggtataaagtttatttgagtgcattaaaatgagtaaataatattgaaaaatgttttcatccaggctatgcttttatggaggcaattttacaattacttaaagtgaagtgaaattgttttgaatctgccagactgtaagtttcctaagggtggaatctatgcaggttttattttgagtattctcgccttctcaacgcctggtaaaactgagttcataaatggtcaatagctgcttatctagcagttatctggcagcttcttgcatgttttcttcaaaaggactccaaatctactactttccatagactttcactttttttctcccattcttccagacttttttttcaacatgttgtcatcagaattttacacaccacagcattgcccatcaaacagacctattactcataaatgctgatgttatttctacgtgataacgtagagttgtcctccttgattttggtacaattttatggaaagcaggtggtctgcccatcattttattttgctttttggaggaaaacttgatatttggcactaggtatgactgtacaaaatcttcctcactaatgtgattacaccgtgagtcaaatgaagacttgaagggggaaaaagaattttgaaaatgaggtcctttagcaagactatttggacagtagctatctttcccctctgtagctatgaaattaagtgggagaggaggtggtaaaaaagaaccagaaattagaaagttttcaggcaagcgtgtgcaaattagaactgcagtagaatgtgttgatttctaatttgaggcaatttccctagagacaacagaggcgttttgaaaagaccataggatttatcatcagaagccatgcattcattttctgctactgctgcatactagtggttttgccttcaacagtcatttgaccttgaacagccccttggcctgtcagaaacacaatgtccgtgtgtgtaagatgaaaacaacaatatttgcatcccacagggatgatgaagatgctatgggtgggggctttatgaacaatcaaccaagatttaaataccttttccaggattcatctctatgtttctttttcttgcctctcccattttctaaaatcttcaagacaatgttattatttcttcacacacatcctccatttcgaacttctgcccactcctgttgtttatcttttcattcgtttttattcaagtggctgctaagggctactctgcaaggtgcgtgaacacactctcctcaggctatccccaaatcaggacaagtcagctcagatgaggctcacttttgctgaacttcagatgcttttatcattttccttacaattctctcctattttttgaagtttagaggaagaaaactgcctggatgctaagtgttgaaggaatcagacagagcttattacaaacaatctgggtttctaagtaaaaagcaacatgaaatccttttacccacattcagataggtctcttgtgtttcttgaagagcagtcgtgggactagctaacaacctggggtatcagtggaaaatactttccttcatctgacacgaacatgcaggaaaagtcttaatgggacattgcagttgttttgcaaaaaaatgaaagaaaaatcattctatgggcttgctcctcttgacatggtagcgctcaactcccaatatatatctatgtatcttattcaggataataaatgaacattaaaatattgtttgtgtttaaggtctcagtaagcgataactactcacaacctggttggggtttataggagttcataaaatatgccaagaacgtctaagctttcattcccttgtattgaatctatagtaagggaagtataataaatgaaaattagggccaggcacattggctcacacctgtaatcccagcactttgggaggccgaggtgggcagatcacttgagatcaggagtttgagacaatcctggccaacatggtgaaaccccatctccactaaaaataacaaaaactagctgggagtggtggcgggcacctgtagtcccagctacttgggaggctgaggcaggagaatcacttgaacccaggaggcggagattgcagtgagcattgatcgtgccactgcactccagcctcagtgacagagcaagattctgtctcaacagcaacaacaacaacaacaacaacaacaacaacaacaacaaaagaaaaagaaatagaaaattaggatttcacaaaaacaaattttaagaggaagattacaagattactcgctaagttagtgatgccaaaaaaggtaactccattttgaatcaattatggcttatttaaaatatctcatttttaaggtggagacatccatttacacacttacattgaatgaataaagactgtctatttcatttactaagtttatggattacatctaatttatttatattgttacttaatagtttttggatgtgtacaattctgaagaaataaactaaaatatgccagtataatcatgtgttttaaataaagtttccttacatttctaatagtttttgtcttatagttttagttgctatattgttgagcacatgtgcatttcaaataattttaacttcatcatttctatcccatggtgttctagtaaatggttagcaattggctctagaggaggggaggaagaaagccctgatttgtatcatttccaatttctacggtgtaaataatcacactgtggccaatttcaatatgatgttattgaacatggagttaggaagatatgttaaccataggctcttacaagctggtaccagctaacgccctaacaccactgattttacctttttttggtgtttaaacttgacatttccccttgtctaatcttaatattgttactgctgaattgttttggtttggatttgccctatgtctttgcatatttctttattcccaatcgttataaataaattttaaatgtttcccacaaattgtatataatgatttgtgtgtgcatgtgttttggaatgacaggctactgtttatttaatctgatactgacgaaaaattggtctatttatatatgatataatatggattttactttctttttgttatttatatgttattagaaagggcatatataattaaactttatactcaaagaattagagatagggaaacccagttttatgaacatccaagtaaatgcagacaattctcttcattgaaacaaacatgcttttatgatcttggatgagtagaactattgtaatttttaaattttgttttctatatacttttcacagtgaaggtagatagattaatctcactttgtattggaggtaatgatttttaaggagaatttttattatactagaatttgttatatttcattttatttatattttatgtaacttccccttttttaaaccaatgtaatatcttagcttttagaaaaagtgagtagagagggaaagagtagaccatgaatgaaatgctgaactttggcatatttaatacttgttcaaatgtgatgtttaaaatgttgctactaaatagatctttaccactctaatttgaagactcttctcccaagtaaggcattttacaaggactgctgaaaccacagctgcccagctgtgagtagaagccactctgcatacctgtccaatccagctttatacgtggcctaaaacaatgcagcccctgataactcattgtcaattgactgcttggcagcttcaaatatgacagtcaagttccagcaactgtctcaaactaaggctgtctcatacagtcatcatggtcccccaaaatggccggtaagcagtagggatggaaaacgctttcctcagctagactgactgctgaaatcctggctcatctaattgccatttttcctaatggtcttgtcacgtaaaagagttataccctggtttacagaatggacagccatccttacaaatcagtgtttttaacaaagcaggcttgattttctctagctatagagctgcagtgtcttctactcttttcaagattatctgaagcttcagcagatttgtactgctttgtgctgtgtctcttctcaactcaggtcctaggggttcttggagctttaaaaagagtttcatctctcacctaaggctaataaaatcaaactcatgtccctttcgccccctgtttaatgccttcctgtataatgctccaatttgtagactccagccaagggccaataaagcaatttcccccacatttcatgatttcctgcttataatgcattctttttttttccattctttgaaaaacaacattaacagtgatgcttttagtttatctccaactgcctgcagaatgcaagaatggagggaaggacagagcttgcccagcaaagctttagccaagagaggagtcgaccagcttggcagcctctcctttcccccagaggctccatttgaaagccttaagcagcctctggaacccttgtctgcgattcaacactagaacagtctttacacatttttctgctcctacctcatgaaacagatagagaggtctttctaaaaatgtaaatcagttttgtcattctgctaggaactcttctgtagtttctggctgcacttcaaaaacatcccatcttacctccaagtctgcaagttccttgagccctgcctacttttctgatttcctctcatacaactctccttcagacttattactacttaacccttccattttttttttaagataacaagccattctttgggacctttgctatttttctatctagaatgctgctcttcccacagaaattcatctggctggctcctgcctatcatcctcatgtcagcaaaattgcatttcagaaaagcctcctttggctggttgatttaacgtagtctctgtcgctctccattgcatcacccagttttactgtcttcatagcagttctcactgtgggaaaacatcttgttcatttatttgtcaagtagttcattttttgactcttctttcaagagcagcactgtccagcagaaaggcaagccacctatgtaatttttctagtagccacaagtaaaagaaacaaaacacattttagttgtgtattttattttacctaatacaatcaacaactatcactttgatgtgtaatcaatattaaaaattttattaatgagatattttacattcttctcttttatacaaagtccttgaaatccaatgtgaacgtcgctcttctagtacatgtccactggaactggccacgtttcaagtgctccatcacgacacatgctggtggttactgtaccactgtactgctagtgaagctctagaatgtaacccttctgtgagcagggacctttccggtcttgttcactgcagcatcccttatgtttatagaaagactagtgcctgacacacagtggccattcaataaatatttgttgagtaagagaatagttcaaagaattttgagatcacaatggaattcttaagtaaagattgagtatctatctttatatacaatttcaaaggctttcaaaaatctaaataaatcaattaattaacttggatgacgacaagtacttatttaataatgtaagtatgaatttggcgggaaagtcccagtcttttgtatgcttcacaatctcctggatattgcccagctcccctctggcatccactgagcccttacatgcaatgccctctctctgctcacctcactagagccttatcatcccagctcaaattctcactacaatgagaagcagatctcctccaggcacacttggacacaccttcacttgggatcccactgcactgtggatagtgatatattacagcattatacctgttttcttaaaatagaggtgtcctctttctttgtctcaatttctgaaaggagacttctgataccactcttggattggtaatagcactagagcatcactttagacctcttcacgggaagacataattaatttacctcattagtaagatgaaaaaagtctgatgtctactggtctctgcgtgtcaattgggtgcaatcaatgtatctcaactgtccttaccccagagagaaaggagtgtaactgactccacagagcctttcacatgtgatacattggagataaaatgttaagcatacaaaagcatccaataaaaataaaaaatatctttattgttgaaaaatctggattggacattgtaagtaaagggttagcatcaggtctgagctaacccaggcctacgctgaagaaccatctcagagttgccttctcatagcactcatagtttagaagctacagagttaagaagaatacagcatgccatgtctgccttgttggtggtggcactgcacatgggtggggagctgcagggtagcatagagacctgggcatctaaaccagaacagttttgaaagactagttggaaactgaggacagagtctctgtggtaaagtgacccccaggtgtttagttcttgtccatggtggccgcacacactctgtgaggaagcaatggaagctgtgtacctgggtgggttctgtctcatctgatgacattaagatgcttcacctgctgtgtccgttgccctgtatccatccataaagctatagaactgtagtattaggctaaagcttattgtgccttctgagttgaacaacttgagctgtacttaactggtactttaacaaccactgcatcagggcagagacctgcagccaggatcaggctttctaattattcccctcatcttggtcctgagaatcagcagctgggaggaaactgctcatggaggacacttactcaattgttctgcaattaattgagccttccttctcacccatccagtctactggggaaagctggtgatgggaataagaaatgagagaacaagatcccctgtgctcatggcttctaagcacacctttaccccactggaaggcttgaaccaagggatgtcaaattcttgccacttgccagttaaatcaatcaattcctcatggataggagtgactcagggtggaaagaatttgtgtttttctgttacaaattcagagactaaggaacatgggcctgctaatattttgtaagcatgattctctctccagtgcaatactcactccttcaagtttgggccttgttcacctctatatccctagccaagaactcgagtaataatttcaataaatacatgaatttaaagtgaatgaccattcagtcatcagcccttaatttctacattatacaaattttattgtttcacttcaccaaaatttacagtagaagctacggaaagattatatgtatgagattcgcgttgcttctttcttctgaagatctccaagttgtgcacatgaaaaacatttatgcaaaattaatcttattcatgttcttgctaatctgcaaagtcggaactatcatcagtgttggaaaatcgagaactttttttttttattatactttaagttctagggtacctgtgcacaacatgcaatgcagccaaaagacacatgagaacattttgaataagtaccaagtaccaaagaggctatttcaatttttgcaatttcacacaaaagccaagtgttttgggaatcataaagatcagtttctgtaaacctgtatagctcttaacacagcagtcaattccaagcaagggagtagaggctgggaaaatagaaaatagtcagaaaagactgcttttttaatagataaagggaaactatccacacaaggaaatgctactatcaaattggtgccaaataggaatatacaataaagaaattatttgaataatctgactaatagtatctctaagagctcttcctgacacactgtgaagagttaccattgaacaggaatcgtctataggaatgttacaggtgtcacaggagaggattgatagaattgaatctaaggaaatacacaaaaacatctagactgttactcaagccaaaactttggggatatgattaattttcaatccagatttaaggtaaattatctgacttgaactttgaacttatgatcagataaaaaattttgattgcctctatagtcattttttgctaagacaggcccaatgaacacgagatagaaaagcaaggtgagcaatagtagttaagactggttaaatattagcctgacttaattaattaaagctagatagtgatcctgtgaaaaggataaggcatgagtcaacaagcagaagtagtctatgagccagaatctcttaatgcactcaactaagtttgtggaaagcaagaatgatttcaggaccctaaagaagtattctgttgcagtagcctgcaagtgttaaacattgttgcatcattgaaatgtgtctttatctgatcacagatactaaaattaatcttcaatcatcttcaggattattatgcacatgctttactttcaagttcaactgcacatcttgctgattaattaaaccattcaatgtctgtttacacgtttcacaattttgtctaatactcactcaattttactgcccagaaggaggatgctaatttagaaacagaaaatactcatcaagaaaatataatttagaaagagaagaccagggacagaagaatcagttcaggtcagggctagttcaggtctaattctgagagatgatgctgggtgctcgggaggagcattagagaaaggatgggcagctgggtgtccaaacagctcaaccagaatttgatctccacaaaatgccctccattgttttctttgaaatagtgtggctgaaaaataatatcataaaagctcccattaaaatgtacatatgaaaaacacattaaaataaaaaattggctcttggaattatctctgccatttccacttgtattaagacagttaattgaggtcatattgtatttgttaacttattattttcacataattgtttatagagattaggagaaactatatacttaatagaaaatataaatgcttgcctgatagcagagggtcggtggagagaaaagtaacaaaacaaatggaaaaaagaaaaaagatggctcaaataaaatacttagtaaaaatgatttgaggccaagttaaaaaaaaatctggtgaatggctttttaaagatctaaagcaatttcaaaacctaagagaaaagagagagaaaaaatgatctagaaatagagcaaaatggaactagaaaaatactggcttgaaaatgtgaaactataaatctaaaattaaaacttccagatatatgttatagaaaatatttttttcctttttgtaaggagctaaggatttgggagtgagggggtaatcagactgtaagcaaaactaaagatgactaaaaagaaatgtgagggtataaaatacatgtattttttctttttggtaatgctttattaaatgttccaaagtaatgacctatagaaggcagacccttattttcaggaggtatctatgcctcaagagtctggggatgctctttcagatttgtcctacgagtctgctgcagggcattgttctatgcatggttctttaatttggggctgactcagtactcctatcactgcttatgaagctgggggagctgcagatcagcaggtactggcaaacctcagcaagagtccttttaagagccaaaaaatattggcctgaccccattgtgcgtcctgttatatacaactgagggaataaaacacacccagggattctggaaacaaaacagtatgaacactgcatctcatgagccctagtagataaagcactgagtaacactgtgaggtaaaagtaagttatgtccattagaggaccggcaggtaggcctccttccaagggccagttctgattcattcatggcggctgtctggagcacttctttgggaatgatgcctaggctaagtctcaaatcaaagggaaaaaaatactggaaaaaataaacttataatgcaggggtaatagaagtcattcttaacacatatttgtcactcctgagataaatagtatctagagagatttacttgtgttgctgatggaataacccaaaagtaattgtagtgagattaagcatatagtcccagaaagacatcatatacttatctacacacacacacacacacaaacacatgcacacacacttgtaacaagggatgcaggatacagtcacaggaaaacactttttttgtgaaaaatagcacacattagaatagatactttttttggtttatttaaaaattggttccttaataatcaactgcttgtagattagatttttctgtatttaaaaaaatagcttagggaagaaatccatttgtatatatacccaattatgtaaattacttaacatttacacaattatgtgaattacttccttactctcttcacaattaattatctctgcagccagctgtgtggggggctggcagctcctgttataacacagctgtttttcccacatttcagcagcactctcttccggtttgtcagggatcccagaaagaaaagttactctcattacaagaaatcttgagattttggttaaccacaaagaactaatggcctcattctaatgcacattccattgaaaaaacataaaaattcattagtaagacctacaaacattttgtcagtgcctatgttaaggcattttaaaaccctttgcaaaatcactattctaatctaattatacaatgatcccttattgctcaattttttactagtctatttaagtaggtttttatttgttatttgcatttcccatattacttaaaaagcagtagggcgagagaggccatggataaacctggcgtcacacataccggatgtatgtgcaattggaattcaccttctttctttaaaataccctggaaaggtagtttttgtttttaattttaaaaaaaatctcctttagcattgtttcttcttaaaattctgaggtaagaagacatataactgaaatgctcagtgtcacactgttactgcatgcttgtccctatttagttaccagacaagtacactgtttacaagtacagcaagccttagtagaaacatcaatatgggatgtgctcacattggcaagtgcataagagaactgacaggcctttgtgtatttgagttaatgacaagctgacagatagcatcttttcacctgtaattggacaacaaaaggaccagaagagagacaggctcccttgctagtgttccagcacctcatttgttagctgcctcgctctttaccattagggatataaggattaataccgcttgagtttttttctaatgtctacattatttttaagcctaaactatagaaacataaaactcaaaaggctgaaaaagaaggtttaattttcaaaattagtaatttctaaaaaaatctatgaatcaaccatggaaaaataaatttattcattccaaactaatctttcagtcatcatccaagaaagcaacgtctgccattgtagtcggagacattaagggaagattaacaggtaaagattactttcaatcagatatctttgttattgtcatcatcatcttcatgtagcctttaccaaatacctttctgtacatttcattaatagccaactgctgctttgggtattaattaacaaatcagaatattccacactgacagagagataaagaacgtgtagagaattgaaaaacatcaaatatatgggtcaaaaaggtaaagtgcacattcttattttatgaataggaaagtattgcaaaacggagagccatgagaattgttattttaattgggttcaagtttcagttaaacagtttttcttttctaactatagaaattttaaaaatagcttagtaatccttcaaaataaaattgtgttcacctatcattttaatggttaagaaactatccctgtagcacaatttagttagggcacagatagcaagaagctgtaaatgtgctaaaagggcttttcttttgggacagtaatggtttgactacaagcctcagcatattaaaaatataagggtttgtaacctgcttaaagaaggagaaaaaatagtttctgaaatggaatgagaaagggtcagaaacaaaaacaatctattttttaagagattggtttagaagaggcatgttatttagaaattattgttgcctgacaagaaaacactagaatagaaaaacagcactttttggcttatgggaggaaagctcacagggccattaaaattgaaaagttagtacatgcagatagaatggtcaagatgaggccagacttgctgccacagaggtcataaattattctcaaaaaaaaaaaaaaaaaaaaaccgggcaaataagatgaacaatatcactgacttccaagcttggtggccaagaacaagattctttgaaagaatgggttatttttaataatgataacaacaatggtagtttgtagtaaatgtttcaaatgcatcaggctccatgccaggagttttacatgcgctgtctcctgtaatcactgcaccaatctgatgtagtggtagactcataaacattacaatccacttttaaatatgggaaaacaggcttagtgaggttgcatagcttgactttggttacattctaagtttcagagacagtagttaactcttctttgattctacagctcttggatctgttctagttactgttccacattctctgagctatctactgcctttaaatgaaagtgaaatcctaagaagcacttgcaaaatgcagtgcaggaagaaggcacaggttgcctagtagttagtctcaagagaaatatgatcccagtagagttgacgcagtacagcaaactgcaaaacatatcagataaaaagaagagctttgactatgaaagcctttgactcagcaacataagtcagcaccagaaagggctctacgagacaagccagagatgagtgagaaacagaaacatgggcatagcagaatggcagccattcatatagaaatacatatctatttgaatttcaacttaagtaaacactggggtaacccaaagagtgatggtagcctacctattctgaaattttactgctagaaaagaccattggtctggcaaggaaaagtgcgggatcgaaaaatcaaatggcattaggcagttcaagcacaaagcctgaggtccgctctggccatttgtggcttttgctcaaatagaaattcctgaacttgcatagactcaaagtagtgtggtttagtgacttggtgaggattactttcgtttgattctgccagacctctaattcactaacatcattgtcctaagttccatgtggaaactcaggtacagagtggatttcttaggaagatgttgggatcatggaggagagaaattggaaaatgagtcgtgatcaaaatgctcttttttgaaagctattttatgacaccagactgcaagaattaaaatcacattaggatgtcagtagcaacatttacacactgcctaaaccagcaatggccacttttttcataatcatgaatccccattgcttctacagaatatgtttagacaatatatgtaggatatatatgtgtaagtcagtagatttgaaacattgtaacaatgattcctaaaattagagtattacaaaatagccctgagatctcaaaagcctaaacatttatgtaaaggcaacttctaatctcatttttaaagtttggtactttctattactgtgaaagaaatatggattggctatcaagggacttccaccactaatcaatattggacaaagatcatctcacttctctgtgtgtctatgtcttcacttttaaagtgagagagacaggctgagtgtttatactagaaaaagctttaatttcaaggaaatctgactagaatcccaacatggaaaaacagatgaaaacgggttcattcgttgaagcagagatgggggccggaaggaacgtaaggatgaaatggagggatgggggaaatggagaggtcagtgaaggtctgacaagtagaagcagcagtggcagtgacatagttaaactgggaaacaaacaggatgtggcaactggaaggcaggctgtctgaactagggattttggaagcagaccggtgttgcatcttaaggacagatggcaagggccagagtgtactggcatctgtggtgcagagaagacaatttgtgtgaaggaaaccacgtggctccggtgatgaatgggttgacatatggaattaagttggaaagagtgactgacctgatgcagaagattctggaaaggcagtgagtgacagcacaaggagggaaaaatggggtcaacttagcaccagcccccagcaaggagagggaagaaaaatttggaaatgacaatggaggaaaaagcagactgtgactcagtcccccagccctgagatgagtggatttgaaagagtcaacagtaaatcactgggagatccagaggggaacaggtgatgtcagttaagtcaatttcaaataattttcaaatttcaaataagaaaactcagaaagaactttctgagaagccattgggtttactgagtttaaagaagaaattctttctggaattactgaacggtagccgtgtttctcctccaggcattatccaatatcaacaagtttgagatttatagttggctcagattccattggtcggtcagggtggtgatgtgtgtggtatgtgtggtgtgttgcaggcagtgtgaaaggggtgtgagagaggaggtcagatctggtctcctgaaaaatcgcttacaggattataaaaaccactatgctcaagcatcacatataggtattcaaaaatgcatatgataaacatagataacttgatttttctcttgtgtattcagttgatatgctaaggcaataattttgatcaagagaaacacacaacagagccctaagtgaaaggtctgaaataatgttatgtcagttattaactgacaagaaaccagcaaatgtttataattggaagaaaaaaatcaatagttttttatgacaaagttcagcatcaaaatgatctggagactgccctacagaattaaaggctcataataccaagttgcatttctctgaaataaccaaatacaaatgcagtctccctctgccacttctctctgtctaagcaaatacacccactgcaaaaggaaccaaaggaacaagaaaactacatcgtaagtaccaaaaatgatgactttattgaacacctattgtacttactttgctttattatccacagctaatgccatgctccccccactcccacctcccatcttacccatcgaaagagtgaggcactgtaggaagggaacatgctttgctacatactattagataatatcatcagctggacagtattgacatctttacatacataaaataatgatcatagttgcattagaataaccacattagcaaaagatttaaaatgagataattgtacagggaaccatttaaaatggaatgattatattttaattttacatctgattgtgcaaaactgtaaatgcaaaccagaggctgtgtggagtagagaggaacatgaattcaccaacccgtggataattatcctttgtaaactccaaattcaaaggctaaacatttactacgcttcatgctctttgatcgtactctttaggcgaagaaagtgttgactgagcattgttccccagtaaggcttgtgaaaatcaaatacatttctgaactgtaaatacaatttcataggctaatagtcactaatagcttgtaattaatgaacagcatattaggtaaataaaccacgttgaaatttcagctgaagcttcatacttgaagggttctcctttcaattattctgaaggcagtgaagtctgtgtccccagattttttgggaatttgcttgcacattttaccatctaccatctcaaaactctcttccagttgctactttctccctccccattaaaacctgctttcaggaaaggatctaaaaatataatacacaatcagatagtccttgaattttaaatggtgcaacaagctttgtaccagtgaacagagcaatgcaatttagttgaaagacatagcagtgattttggagaaaggaagtgagagccatattggcctaggtttgagtccttgatttgttatttgctggatacatattcttgagaaattactcaatctttctgatctttaatttccttatttacaaaatggagataatcattcccaagacaactctagcttctgtggaactttgtgcatattggaaaagcctttccctccaggtagactcatcttcttgggttcatagatcatcaagaggagtgcagcctggatttgagccctatcatccctcaggcaaatgcctttattcagtacacaaacagtactagaatacatgacagccctgatgacagttaccttgctgggctgttaccatcatgaaaggaaatggtatatgtgaacatgccttatcactgggctatggcccagtcattactaattttttcaaagctattttcttacagttctttcatcttgtatttcataatcatacacacctgcatacatatacatcacttaataagttggataatacgtaaataataataaatttatgttaataagtaattcataaataataataaatgtacttgaaacagagcatggagcagggtgactacctttctcagggtaggtgcccacagaggcaagttgcttatcacttacagaaaggccaagtgtgattatctggtagagtcagtttatagtcaaggttaggtaggagcttctgctcagagtagatggtcctgggctcgaaatctatgtgtgtgacttattctagaaactattccataactcgaaagcaggctgctacagagttgtattattaatataatttggtagtgcccaaaaaactggagcctgaccgtctgggtcatttcctacctccatcactttgtgttgtatgactcaggccaggttgcttatctctgtttcagatacctcatctataaaatatgctaaaataaaataaataggagggaggaagaataacatctattgaggctgttgtgaagacttcatgcattaatttagacaaaggtttagaacagtgccttacacataatcagtgggaggtatgtgttcatcattgtcatcatcatcaccatcaccatcttcaccatcagtatcattattacaaaagcatcagcatcattacaatacttagcacagtactttattatttatgtaaccatgttttaaatgatggccctgttttctgatattattattttcctaacttatctgtatctctaatttttcttcaacaaatatgtatttctttggagtaaaaacaatagaatttacaataataaaatagtggttaaaattatcttggtgctaagaaataaatacaaagagatatcaaaaataatctcttctaccaagaatgtaaatatgtcgatggggagtcagagtatattataaacaaataaataggcagagtgtaaacagggattggattgaaggctgagctcagcttcttaccttgccctgcagccattttgaggctatactcactactttttctgtcttaccacttccaagatgtatctatctatctatctatctatctatctatctatctatcatctatctacctatctatctatctacctatctatctatgtatctgtctatctatcatctgtctaatagatatctagagatagagcaaaaggagatagagatagagggagaaagaacaggagagcatgagagagagaaagagaaatgttttgctaagtgttttgtgtcgatatggggaagagaagtcacatccacactggatagctccataataaaattctcatcatacatcctggtttttctttacttctttgcaccctcagaggctctttggctctttcctctatcttccccctacattctgtctcagaggttcatctatcataacgtcgaggcatcttggaaaatattcacacttttgcttctccatgttacacttcacttccccctcacctttccccaacttcaaaacctttatcgtttacagttctccatctctcattcaaggcttccttcacccaggctcattctaaccccacttccctaaattacacacttattatgtaaatgtgtaaactgtctattcagtcagtcctggtttttcatttattcaacacatatttattgagcaactactatgtaccaggcaccaagccaggaactatctgtctaattctaccccctgtccagtgtctagccaggtctaactctctgcctcctctggaactactatgtagcacttagtgtccacagaagctatcttagcctttaactgttttaggtgttgacattttcctaactggactctccttgcaagaaagagcttgtcatatatgtctaggtgttcagtctgtcatctagaatatatgctccactagggcaggaatgtgcattgtctgttttgttcctttgtgaagccaagtgctgggaaagtgtttattatatgactgatgcccagaaacattttctaaaatgatgaatgaatctccctcagcaactagcaggatgttaagcacgtattatttgctttcaatcaacaccaagacaactgagtgtttaacataaattatgagatttttccctaaatgtctacaaaactacataatttttgagcagttccaaaaaatactgtttttgtgcccaaggacatactaacagattcgagagtttccatgcagttgtggcaagaataactaggacaccattgctccttaaagatgaaagttcaccaatattttgaaaagtacaaataattaccaaatgaactcattcttctatacattatccacagcttatcagttgtatgcatggctcactgataggttctactttcaaggatttcattaattgtattacttggtgttactaacaacactgctcagtaatgatgacaatttgttgaccattaaagatagttgtttataatttacacactttagttagaatgctagaataatgctatcatttcataatcaagcattgtttgacacttaaaaaaactaggattttataaataactcagtgtataaagacaaaaaagtggagttgttctgatgatactggaagaaggagagtaaaaagagtgcagagccccacctgcttactacacctccttcatcttcacccaaggcatccccacctccacgtggcactaagcagaaccctacagtcatgcagaacacagttcaaattacactgaaccagcaccagcttcttacctaacaaagaagaaaggaatgtcaaagaggttaagagacctgccaaatttctttcatatccccataagggatgccggatctccagtccaggggtgtttccaccatgctataactgcccctaaaccaaggtcatcactgacagttggcattcttgcctaaattattccaggcattttcacacctccaaggagggaggcctacttccatcctactaggctagttttgattcctctctctactttcccttcggttttgaatctagtttttaggaaatgtcagattaccaactcgtttaacactttttttccatgacccttaaattgttctcctgaaacttccgtcatgaaggtagttagattagcacttagaggtgttctagcataatatttagtgcctatagaatgcttttcacctcaaaggcaactgtctacagggcaattttcatggatgaaagacgtaggcaaacagtcacatatgttggtgcatttataaagcagtttcatttaaagccccaaggccttaaatggtaccttgacaaacagatgtctattctttttattattattatacatttacacagacacacatcattagttctttattgacatcctgttttatttttatctggttttaatgctagctgtgaatgtcatcataaaactgtcttctagaatacctgctgatagggaagaggaaaaggatgaatcaaaacttggtaccatattggggaggagagccctcaggatccctgctgcctgcatgactgaacagcagatgaaacacactgaacgttccactgaacgttgagtcagtggaagatggagcttgcaaggctgtcttggagagtatcagtgctcccagcttagcattaaaatgcagcctggtggtcactggagttctcagctctgatgtctgaatgccacaggcctggggaaaaccccaggcctgtggctgctggagggaatgcaattagggcctctgagagagagaagaccaatatttaattggctcatcccaagttatctaccaacagttgggcttctctccttcaactcctgcctggttgatattactcagtttttggggttttttgtttgtttgttttttgttttttgtttttcaggttttttgctgtcatttttgttgtacttcatttttttccttaccattcaattttgcttttggaggaaagctctcaagaaagacactttcaggaccatccagattatctaatttcaatgactgactgaacttcaaatatgtaatttaggctttcccaagctgctcgatgatatgatgcagtgttgctttagactgtacattatttttcatatggtggaagtgtaatgtgaatcattctaatagctcctggcatcacatccacctactctctctctttgtgcaagtaatattcatgcatgtgagcagtgtgcatcaaagagcatataggaaatcacagtggaactgtggggatagcatggcttccacaaaagtcatataactgtagcttgcatccatagaaatacagtgcccactacaaggagaggttataaactggactgctccagtcaggctatatgtgtagctaagtgttaagttttgtccagacacattttaagatgggtattgaaatactgtcatttagaatacaatctgagttcttgtcctgtcctacatgagcttgtggtggggggctccccatgtgcattatcaggccatcttccaacactttccccctctgagcatcttttttttcctggctcaggtctagctcattctacccagggcctttcacttacaaagtcctcctgcttcaaaacctcttcctcttccatgctagttaattatccccattcaggtcttagagaaacctccctgatcatctgaaggcttgtcttctagtttcacacgtgcactgccacacacacacacacacacacacacacacacatcccttgtcactctcctatctccctttgtcattttcatcttggcacgaatcactctctgaaatgatcctctgtgtgtgtgtgtgtgtgtaacgcttatcttatcatctgattcctttgctcctctgtaagcctcatgagaggaggggccttcccttccttgtttctcaccatatcaccagctcctagagcagtgctgacacatggcaggaactcagtgattatctgttcaatgaatcataagtaaatgaagagagtatgtctggtgttggctgaccagggttgtgaagggacagaaggggcttatctgaaaaactactgaagcatagggaatttgagcctggaaaaagggagatttagagaagtcatgataattgtcctaaacaatttgagagaccgccacacagaagagggtgtggtgaggtcagaggcagggaatctgggcacgtactgttcagcccttgttagggagaacattatggcaaatagagttcttgaaaaggaagggcttctttgtaatatagtgctttctggaaatgtgaaatattcaggggaaaagcttgaagtaactgtctggtgtagaaggtaattccattttggaaataagaatatatgggagttatagatgagagaaaattgattcttgaagaaagattacttattctaattcttcactcaatgaaagaatcaaagagtaagagaggtaaaatgttttgtcccaaggtgtagcaaacactgttggctgactaatcccacacctattccccaaattattgtctcttactcattttcaacatagagtgtgggaatgctaaaaactaatttccctagtttctcttgcacttggggtggccactgagataattctagcccatgagaagtaaatgaaggacagtggggacttctaagatatctttgctttcttgatgaagaaacagggtggctattgctgtctctcattctgcttcttgaactggaagtggatgtgagggaaggagttactgtagtcattttgtgaccattagagaagcactgagatgctgcctctaacattgtattgaaccaaggccagcatctgactccttttagacttccttatttgttttaaaagactgtcagtggggttttcttgcagccaaaagcattcctgactgacacacagatattacagaaagtggcaaagtttagattaattttatatttcctaatgctcaggcaggtagatttttcattacatatactaactcatttgtcaactattattaaatgcctactgtgttccagtcacagggctaggacctggggaatttgttggggtcactggcaatacaaaaatctatcatgctagaaaggaaacactagtgaagacatgattacaattcaatgagatgagggctatgacagaggaatacacgggacaccaggacaacagagaagcccaagttccaaagtgggaacagagagagcatcctcaaaaatgacatctacttagagttaagacttaaataaacagtagaagttaaccagattgggggaggtaaaggactctctaggcagaaagagattgtagtgcagagagcaaggtccactcaagaagctgcgaagagtttggcaagactgaaactccgtgtgtgtgcaggaagggggctgcagagagatgaagtgggaggtgtcaaaaggtgaatctggagggataagtaggagccaggtaagaaaagggtttcctttgcctaggtgatatgttggaatggtttctaggaataggtgctaggaagttattgaaggttcaaaagtagggaaatgactgatcagattggcatttcagagtgatcaccctggtttccaggtggaacatgcacaggaggggaggggttgttaaggtgcttcaagactgaaagtcagggaggtgagttcggaggcagagatggtgggacttgaaattttagaggacatcttcaaaatgttaagaaggcagaagtgaaatgacttggggatcattaggtagagagtctaatgcagagtcaagagtgactgaaaggatgataccacctatccaaacttagggaaatatcacacctcctcaagactttagtgtattccatgtgtagagtctgttttctattcctaaatctactgccctagaaaaagtaccaatgaaataaaacgtgaagtgatttgagcaccaagtgggaaactggggattccttaactgggatgctgattttcatatgttaatattttttccaaatgtacttcctcatattttaagtggaatatgaatttcctagaaattttacaataattttgtattatgtaaagatagttgaataaaatagtccctgttgctagtaatcataaagataaatttaatttccactggccacataataatttgtctcattatcttatagtcacagcttgtacacatataataatgtcaccaaatgtcacttaaaataatatttttctttttaaatgttaaaatgattcttttcagttagtctaacaaaagcttttttaaactcacattcacattttcaaatataaagtgagtttcagtagtacctgtgtttcattgctaaacttttgaattctgcttttttccttaatgataaaactagcatcacaatgattacttctcatctatattcataaatgtacctaatggctacactggccaaatagctaacataatttcaatttctagaaaacaacatttctagaccacatcctccccaaaatattttttaaatgatttcttatattttttgctcacatttcactaattgtataaaaaatataaaatttatttatttatttttttacctcaggaaacatatggtgtaaatgcttaaggaaatgtgagtcatgtctttgatgaggcaactactaaaaaatcagttccttctgctacaatataaatagcatgataagccctatcaaaggtcaaaatctaattttaaaatacgtatttcaagaatttttattttagccatcttgccatgaattagaaatatggtctgttcagtggccaactctgacattttctagtgcacttgcttttcagtttttggagcaagagagaggaaatacattttgttatatttcaactcaaagatctctgagatattgcagagccaaaaaaaaatcatctctatccattccctaccctactcccccccagaaaaatcctttcacctcccaaacaatttctaaaaatacatttttcttttttgttaactgctctcttgaaacttgaagatgtgtctgaaggatttggttgtcaatgttacttatttctaagttcccatctggttctcaaaaaactctttcctcctcttcctaagtgaacacctctgaaagttgtaatggatttggcagtaggcaagctgcctatgtttataactctgagcacacaggtgatgtcacctatgataaacagcacttggcacctctagccatctctgtctaactgtgagcttcaagtccactgggtgcttgggaaggagagctgattaaataccccatccaggaaggagctagattgacagacaagagttcagcctacttgcttgcatgctacttgcaattgagacctgtgacaagaatggaattttgctcccctcaatttttagatataagaaaattgaggtagagggaggttaattgctttaatgcctccataatttaaacactagatttcttgctcaatgtttagtgatgaaacatatcagagtaggtctgttatactcaccacccttggctgaagctggacttcatttccactgactgatccccttgtttgtacagatcatgcgcagctaattcctgagcttgtttttcaacctctcaaacacctggagtacaaaatttgattccttcaaagagactgctcaaattcatttgtttttgcaagtaccatgaatagttttttaattaattattattataagagaatacatatttattgtggcaaattttagaactaagaaaagggacaaagaatctctaactcatccatactttctcacccagagatatccatggctaacagatggatgtatttacttctagtcttttaagatatgcatatatatttccaaaactgatactatgttatataaacacatatcctgattttcccatttaatattttacggtatgcagttttccattttttaatatttcaaatattctttgtaaacaggtattttaataattgcataatagagtatgcataggccattaaacctagcagtgcatgatctggccaggtcagcattccagccttagcctcagacactggaaattgctatcctgtcatttaggcctccttcatatatctggttcttcctgcctggaaaatccttccttgtggtaggcacaattttaagatggcccccaagattctatcctctacatgcatgtcctatatgatctccttctcttatatgtgagcctaatcacgaacaggatgaacagtcactcccatgattaggttattatgtatggagaaggtggagggattttgctgatgtaattaaggatctcaaatcagttgatttttgagttaaccaaaaatggcaattattttgggtgggcctgactgaatcagaagaacatccataaggaggagttgggcccttcctgaagaggaacattctcttgctggtcttgaagtaagtggccacgttgtgagaggatctgccaaaggatgaggaactgcaggtggcctcaaggggctgagagctgccccaggctggtgatcagcaagaaagtgggaacttcggtcctaaaaccacagcaactaaattctgccaacaacttgaaggagcttgaaagaggaccctgagccccagacatgaatgccatctgcaaacacctgatgtcagcctcttgagactctgatacgcacctgactcctgacccagggaaaacatgagataatgaatggtgctttaagccactgagttagtggtagtttctgacccagcaatagaaaaccaatgcattccctttctcttttcctctggtaacttccactcagctttcaggtctgagctgtgagatcacttccttcaaggagccatccctggcgccacctatatattgtcccagctcatttttacttcttccatgaacagcaatcacagatagaatggcagttgcctattttctcacctgcatgtctcttgcatgataaacaagtgtggatactgagcctcagagaggtgaagttctatttgtttgatggctaaaatatattgggacatctcaggaaatagcaacacatgtgaatacaatgcaaacttaaatttagcagatttgccaacacaagacgtggctggaacaaaaatacagtaaatttaccataatgtgtaacatttaatgtattgtctgaaaccaatttcagataatactactgaagcaaatttcatcgaataattcatgtgtgcattagctgtgtggatatggaacctgattctatatacaatttacggccttgtcagtttttatgtaaaaatcacttagagtgaataaaactgcctatttatggtaatttctcatttatggattacttctgaagaaaacacacagttcttttccctgggtttcaaagcctggttagccaacaggatcccagaagcagttatgtgctggagctgagtgactcatctgggagattacagtaggtgagcatgctctacatgctaattgcgtcaagctgaaaccattcagatattaggaataaaagcaaatagaagggtgatattttaattctgcactaaagataggggttaaaataataactcagctaaaatagatacaaaagcccaatgactccctgctttttttaggatgagtaagggaaaaaactaaattaaaaatcactagattatatgcaaaactgcctgtttatttaccttaccgatggtggtactggacacacactgaaaaggttagcattaattggcttttgataaggacaaaattctgcattttcagcactgctggactgatgagttagaattacagtatttcctaaaactcatcagttccctctaattgggtctgcccaggagaagagctgtcagatcggagaagaattcaataattctcaagctttgtttcataaaaaccacccgggatgcttgtgttaatgttcctattcccaagcctttccgtagaaattctgactccttaggtttgaggtggggccttatcatatatgttttaaataagcccccaagatgattttgatacaggtagtttagctcttacattttcagaaccatcgagtagaccatttaagatatttgtcatcattgattctcagaagacttgctcctaagaccagaagatatttgcctggtgtctgctctgcctgagaaaacatcttcaatgtgcatggggtcctgtaatgcatatgaggagtagagagctcctgggcctgcagcggacaagtagggtgcaaaggctgaaacgtcacatggagaccccagtgaattagagtcacctaaagaaaagccaccatttaatgtgcagcattcttggtaggtgggaatgtgagcagggtgttgccagatttgctgttttctagagaaacagaaaacatgaatttttgtgtaaactccctcgattttttaaaaaacactgggttttaaaaataaaatctgtaattggagcaagggctgcgagttttcaacctctgccttaactcatcaggataattctccataaaatttgagaaatggcagagcctatttcgttgacagaggtggtgacatgagaacaggaatatgaactccatgggtgagagatggaagggaatacccaggcacacaaggctgctcaaggaaagacaattgagctgccttttcatacaactcggcgctgtgaggaggaagtgttttctagtgtccagaatatgaaacctgtaaaaattggatttattcttcctcctcctccttctcttctgcaaagggttttcagatattcattcccattgtatctcacacctaatcacccatgaacctgcggagtaggtcaactcaaggttggatctacaatattttaaaatgctataaagtagatttcagtccctgagttgaattcaacctcattcttcaggctggccaataactgacagggtctttggctgtgcagaatgctaagtgtgaggtgtacggggagggtaccagttcaggtaaggctacatgccagactgttagctgtgttccagggataacaggaacctttcttttttaccagtcaaattcttcacgagtcatggtaccttttagaaatattagaaaccatctaaacctctcaaatatcaaactacttttcttcctgaagtgtcagtttcttctgaacatgttctttgtttttggagaaaatcctggagagcactgataattcccaaattaggcaaacaaccaggaaaacctctataatctgagcccagtaactccatatggcaaatttgacagaagtctgctctgaaagtcctgcctgaaaccattggcctgcgccaagttatagaaaaatcatggcaatgccaattcctctgctccaaaaccactaagatcaaatactattttgagcttctcagcacagcttttttactgtgaatatcataaatacaaaaatatatctgctatgcggggcaggaaggttcaagtatttcattatgtttcttatttcataacatataattgagatcttcatgattacaatgggatatttctaaatccattggtgagcattataaagagcaattcttcaaaagaaagcaaggcttagctgaactgtgaacatgtttttgacgataaaaatctggctggttttatccctaaagctatttttttattttaaaagctttaaaaaataagagtcactggtcacctaattgcataaagaaaagaccctctagtgatagtttatgcctttgggatatctgataggtcaaattatctaatgcttgtacttatcttgtttattgtaatttcaagtgaatttagtgcttaaaaaagttaatgtaatgacagaaggtgttctgacaactcacctgtttcattgtcttcatagcactcctgttgtttgagcattatcattgctagttgcattaaatccattatttttggtgtgccaatatttagttaaaatatacacacacatatattaggacatgtctgtctttatgtaagtttttgcagccactaaaaatgatgttcacaaaaaaattttaatgacatagcaaaatacctttctaatgcgattaaatgcagattatcaaactgcatgtatctatgtatatgtagaaaataaaggaaaatatatcacagttttaacaataaataacctataataacggtattaagagtgagtaaagcacatcaaaactacaatgagacaccacttcataccccttaagagggctaatataggaagtatttttaaaagaagataatgcatccattagaatagaaatatcagctgtaaagtgttcaaaaacactgggttttaaaaataaaatccgtaaccggggtaagggctgcaagttttcaacctctgccttaactcatcaggataattctccataaaatttgagaaatggcagaacctatttcgttgactgaggtggtgacatgacaacaggaatatgaactccatgggtgagagatggaagggaatacccaggcacacaaggctgctcaaggaaagacaattgagctgccttttcatacaactcggcgctgtgaggaggaagtgttttctagtgtccagaatatgaaacctgtaaaaattgtttttttacagatatacaactgtttaaaatctaaaatgtattaaattcatgtctttttgcagtaggcaggtgggataaataagataaaagactcattaatcattcatttaaacatttggtttaaatagtcatctggaaaactaaaaaaaattatagaatgctttttcaagaaaaaaatcattatttaatagagatcatcttgagtacggaatgatgttgaaactgttttattttatatgattttgagttattgaacaatgactgatgataaaaataaaaatttaaagaaacaagagcaacaaagagacatgaagttttaatatttccagtaaaacataaataacttgtaaagaaaaggagatcatgtagaaatgtgctctgtgttcatgaaattcattgtttatatccacaggctcctagaaaatatgagtgtcccctgtgagctgcactcatctctattatttatatgttttattgacttgttttaaaaagtacaaagatgagcctcagcctgattttcctaaaggtcaaatttcttaaattaccatcagtgagttttttttttttaaatcatacatggacaaaagagagttcacagtttggtgcctgacgttttctattgtttttgtcccttatttattttgttttgtttttaagagataatttctgaagtgtctaatgcataaaaatgttttgaaactcttctgtaaaactcaatttttgttatagtttgaagttggatgacatggaatttttaaagttaggctgggtgctatgatttgttgctaaaagcaagtagtattgaaaacacaatatttaggcagtgttctcattgtctgggtactatacatatgggcagttgatatatttacttggtaatatgaagccaataagctggtcatgagactggaaagaagtttggaaaggaagaggggggcaaaatataactatatccatactagagatttgcattgattaacgtgttgattagccagcagtttgacatatccaaacttcctttgtcccaggagaaataaatcaaatgtcagattttcaacttcctccctctactctttaacacgtacatactgacacatgcacacacacacatatttaaaaaaataaaattcaactgatttggtcagacacactgaaaactggttaatagattagaataatcaaagttgttatttttaagctagttgcatagagaataacaaagagggttacgccagaacctccaaacttttcttgagtctatgtttttaatcattatgcacatcgggttaggagtgcccatttgtaaaatgagcatggtaataagatttaccacaaagggttgttataagaataaaattgaactatccaatgtgtgatttagcactgtggctgcctcgattttaggacttgcatagtcactattatctgtcgttcttatttcaggcaaagagaacaggaaaagaaaaggcatagagacgtgaaattgcttaggatgttttggggaaacattaagaggtccagcatgactgaaatacaaaaatagttgggggaggtgaaggggaatgaaagggatgacgccagagatggtacagattatgtcctcaagtgcctttacctgcagggttataaccgtgggaggagtcatggctttaaggaggctatttgaagcgttttgaaagggatgacattggaaacaaggacaggacttataaagctaccgcagaggtccaataggagatgagaacttgagtagactatggcagtgggcatgacagagaatggaaatattccagaaatctctttcctttagttttttaaatatttgttttgttgttgttaactgaggttaacaagaaagcccagatgatatttgcctcctgctattcatggtgcctcctatattgcatcaggattgcccaacagaatagggcagaagcaatgatgtgtaacttttgaagttgggtcctataacacattgctgctttcctctcatcctctttgatctctccatccaatgtaaatcagcaaccatgttatgaagacactcatgcagcctggagagcatttcatttgcggaagaaatgagacctgcctgcaacagccaataccaacttgatcatgtgagtaaatcaccttagaagcacatcctccagccccagtcaagcctttatatttctatcaccctgactgacttcttaactgcaacttcatatgagtgccaaagccataaccactgaagaaagatgcttctgaattcttgacccatagaaactgagaagttagttatgctattgttttaagccactaagttttggggtaattaattaccccataagagtaaactaacagagattgatcttatttgcacatagacctggtatgttagacagattctaagattcccatctcctcatgttcaggccttgtgtaatttccacttctgaagtgtggatagaatctgtgaatactacgagataccactcctttgattctgtttttttcagatataattaaggttactaaacagctggctttgagttaataaaaaggactattttgctggtgggccagatataatcatataaaacctttaaatctgggtttagaggtcagggtcaaatgaagtcagagaacccaagcagtaggaagattcttctgttggccttgaaggagtaaactgccatattgtgaagagggttacgcagtacagaatggcaggtggtctctaggaacaccagtctgtcagtcacaagtgactgaattctgccaacaacctggatgagcttgaaagagaaccctcagctccacataaggaccgcagccatggctaacaccttggtttcaacctcgagctaagaacccagctaccctttgcccacacttctgacctacagaggtgtgacatgtaaatgggtgttatcttaagctgctacattttttaaattatttgttagacagcaaagaaaactagtacacctggcttagatgataagatcttggacttcgagctgatgccataatagaatgagactcttgggaaccacaataaagggagtatgttttgcatgtgagatggaagtaaatcactgagggccagaaagcagtcttcttcactggtagccagcctccaagatggcacccaatatgatcctactcatctctgggaattcattcttttctgtagtcccttcctcactctcacattgcgtagggctgacctatgtgaaaaaaaggatacgttgggaatgacattgtgtgacttttgaggctctatcataaaagacattgcagcttccaccttaatctcctatggatcacgcacactttgtgaaacagcccacaaaccatgaagatccttaagctgccccatggagaagaccacccaacaaagaattgaagtctccccccaacagcaggcactaatgtgccagccatgtgagggagccatcttggaagtgaatcttccagctctagtcaagtattcagaagaatgcagtcctgatgtatatgactgtaatatcatgagagagtcagctataatcacccagctaagtttctcttaaattactacagacctaaagaaactgtgggcataataaaatttcattattgttttaagctgctaaattttgggtatatgcagcaataggtaactaattaagaggtgtataagacagtttctaaaaattgagtcccctctccaggttatagtggacaatcagtttgcaacagaaaaagagacaggaataaaaaaaaaaagagtcgttcagtagtattttaggggaggtttccagataagcacaggctaaatctgtggttcttgttcccatagttaatagattatatgtctctgattaaaaaagtgatggctaaagacaaaagactttgacaactggaccagatgaaaagattaagagttctctctctgggctcttctccttaacaccttgattatatttaacactcccttaacacctttctttatatgtcttgtacaaaaacagcagcaaaatagaagaaaaatccttttagaccaaataatgacaaagtggaaacacatgcctcttagacacaatgaaaatcgtgatatgaaggactcctctgtactgtagaacagtggctgtattctgggaggaggaatttaaatgccatacagaagtgtaacttcgactctgctaatttttcactgaatttcaagagaaatttaatgtctgtaaaattagattggaaatatagaggccatacaaattcacaatttgagattgaaaataagcaaataagtttagaagggagtcttaaatgtaatttgttctggttataaaaatcctaaagctaattataaaaattttgaaataaaaaagtgaagaatataaaatttatccataatccccatatttagagctaactactcttttcagtttcctatgcatatgttataaattgaaatatttctgccattaaaattttatattttcgtctaatttaactagcattaataaaataatttccctgtgctattaaaattatttttaagctatatctaagtgccacttttaacagtctttaaactataaatgtatgctcaatgttaaaatcaaagaggcagggcagaaacaggcaaaaatttgggaaaaacataacccagaattaacattcacttttagtgtaccagcttccaatcttaaaaatatacatgttacacatttgcatacacatttgcaaaaatgacatgctatgtatactgagtttatcttgctcttttttggtttcaattaaaaaattcaataaaaatattgtttacaacatgatttaatgggtgcctagtattctatcatatggacataatttacatatttatgaatagttcccattatggtacagtttggtggttttctttaatgaaaattttgaacatgtatcatttcagttttagattaattccttaggataacttctcaaaagtataattattgggtgaaaaatgtatgcataaattcatagtgatagatatagccaaagaatttcccataaatattgttgcaatgtatatcttaaccaagatgaaagcagatccttttctccttcactggttatgagcgctttctcatttttagagaaatctgatagactggagatggcatcttggttgttttcacttgcatgtcttttatgagtagtaaaactaattttttcatgttatcttgacattttttacatgcccacctattaatgtcttatatctattgaaaatcattacatttatccttttattgtcttgtaaaacctgtttctatgttaaatttatcaactctttgtctatgcatataatttttttcaatttgtgacttcctttttaattatcttcattccttttcaagtaaattaaattttaaaacatatatgtactcaaatatgtcagtattttccctaatgatttcttcctttgaagttgtgcttagagggtatcaccctaaacatccaatattatataagcattgaggatattttcctctgaatttatgtggatttgatttttataggtggttctttaaaactctgtatctgaaccttatcttgaaataatatgtgagattagaatctcacttttatcccagtagtattatttaaaagcaaaggtattgcacaattaatacagtcaccctatataatagagacaagtaaaaagaaaaaaaatgccaactctaatgtgagttattaacatttattcaccctctctcccactcagcctctctcaagttgtcttgcttgaaggtgtgtgttggcaggaatgggggacagccatgtatgccaggcaccgaacacagcagctttacatgtttgtatttaattctcgactagacttgtgaggtagaaattactctgtttcaaagatgagaaaggagggacttggagaaatcagaatgctggagattatagagttcagagcctggcaaatttgagtgtgtatatgagttcctggtaatgttgccaaaatgcgggctctgatccagtaagtctagaaggggcctgagattctcccttctaaccagctccctggcaatgctgatgcaaatggtctgtggaccatactttcagtagcaaagacaaagatgacaattaaataatggaacttgatgtacccctaggtctttggacttctgtttctttccacactatcacgcttcctctagctgctgtcaacacatgtgtgcttgtacttttaacaaggttccatcctaaaacaaagtcaaacttcttaagcctcacttttatttacaaagatacacgtaataacaaatatttaagaaatctgaaagtcaaaatgagtgatgaaaagaaatttagaaggaaaacctcaagagtgtatgtcacaaaaatgttccaagcatgctctccaagggaacttgtgaaaatccattactaaaattaatttttaagaccagaggattatatcccacagaaaaaccagaagggtagaaattttcatagttcatatttaataatctacccattctctaaatatgaaacattcacaattattgctcaggccaatgcctactgtgaatgtttttgaaataagagcattctagtctcataattttatatcctcaatgtattcttaggaggcaggaagaagaaattattgccattcagtatgagactaactttttttgaaggcaagcctgaaaagaaagagcatttcttcacacaaatacatatttttgattcacataattattatatctacagaagacttaatttgaactcaataaaaatgatcattttaaactatgagtcaagtattctacgatattgcccttggattgaacaaaaattacatatgatgcaggcaatctttttttctggtttgttcactaaaatatgacaactataagacatattacagcttaggactagagaatctaaagagaattaccctccaaaaatgagatgacaatccgatgtgaaaagtagactgaatgtagagctcataattctacttcaataccactatttcctagtaatagataagaatcatatcatttttagctggaaaaaaatcttagagatcattgaattcaccccttgctcttgttaatgactttgctattgcctttatttatagaagtggaagataagtggtatttctcttttggcattggaattctacacacagacatggttttgctcttccagcttactgagccattctgatgttcatacttacaatacaggcgaagagaagactattacaaaggatcattttagtggaaaagaaagtcagaattaaatatctcactaatctataaaaaattatttctgtaggtgcatgtttctctcatcaatgtgtacgacagttaaatgcataaatctcccacacatcaatggaaaaataaatctcgtagtgatgagcacatgacagatttcttttcagaatacgggaaaatacacagtcacagtggctgcaagtaattttgtaattgccttactctattaccgacacggcatctgctcaatgctctgagaccttttcctctcatcactgaattttgcatttaatttgcataatgtgtcaaagaaagaaaataatggatctggctgaactttcaactgaagtaaatcatggggaagcaatgcagaagcagacatctctctagaaatgcattaaaatacaagggaagtcaacaaggagtcttaaaatgctcatttccaagtactgaaattgcattttttcaaacttttacatgaaagctaaaatgttagtcctctttttaaaatattctttcaaaagcttatatttcaaagaaaatgagtattagtccttttttttctacaacccacccacttggtaaaaggcactagataaggccctaagcatcacagatttggaaatacaaggaatgggatgatgaactaacttcagcattgattatgtcacatacaagagtcctggttgcccaaacaatctcttcgtcatctgccagcttctaaatcttattcccgaatttagattcatgaaatgccccgcaagtgtgcaaagtcagcaatcagccgagagcctacaccaagtgcaccaccttggtcatgtgtgctaaagctacagatctacatctcccttatgcccttggtcaatctgggtttacacatcacgcatttgtccagagcaggggatacctgtaacttgcttggtatggagaataatattctattgttatcacttttgttgtactttctgataaatcacctttatctctttaactggtttatgggtgatggactagcaccttcctaactccagataagtcattttttattcctcttttcaagatgctagctcccagaatacatcaaagactcttatattttcaaaatatatgaaaaagaatacttgaattttttcacctcaaatttcatctctgaatatcacaaagggagggattataaataaattatgactaaaaccttccaggtttatttccctgatgagcaagttatttctgaatcagtattgatttttttgtgtgaactatcaaccactacctttagaactagtaacattttggaagatgaaactggaagacatttctcaatgagtttgatgcaccaataaatttatcagccagactctgtttctaagattcataaaatttactccaaggaatacaggtgaggaagagctaaaaaaatctataacatcaaatgagaactcattaactagatactcaaatgataagaattgaagaaatataagggagagagggagaaatggaggaaaggagggagagcagaaggaaggaaggtgggaaggaaggaaggaaggaaagaaggaaggggggagggaaggggggagggaggaaagcacataggcagtcaggaagtagggagaatggaaggaaggaaggagagatgaaggaaggaaggaaggaaggaagtagcgagggagggagggagtagggaggcatgcaggcaggcaggaagtcaagcaggtaggctgggttgtttccatatgggactctttctatgcaaagacaaatatttcaatgattctgagttttactttggctcatgatataaaattggtgcatttcataggtatgtgagtatctgagaggtgaatgagtgttcttagacacttgggcagcagctgaagctcacctggcattcctacttgatgctctcatagttcaagtctcaactatggtgattatttggagcaaagggactggagggcctagaatttccctgtatcctacctctctgtggtaggatgtatcatctggccccaaatccctactccttgcatctatgtattcattctgagccctcccatcaagggtgggaggacctgccccactgcttgtctttgccctcattcacgggatgtcagtaactgtcatgacagagacttgaaaatgtgcttttgtgttgggcttgttttcttccacctcttccatctccacgagaagaacacacccaggcaagctcatcagtcccagaagaaagatgagagagaatgtggaatggagatgcgccagctcacatagatgtctgattctatctgacactcacataactatccataagttcaacatagatcaaccaaacaccagttgcccctcagatttgttaaaaataataaataatttcttgttttaagccacagtgatagctaatatattttccttttgccttcatggtgggatctaacaaaattagtcaatatctttcaaattagagaaaatgggtaccagtctcaaggggatttctttggtctttgtcaaatattcactcagataaaataataacaagaatgaatgtaagtttttacaagagactctcacggaggaactactatacgctggttgatattgaatagaggctccagaacaaacactgcacaagtactgaagcaacatgggaatttatgctttgttggtaaagcaataattcttgcaaattcactagtgttattcacaaagacactaaaagcatctgtttgtttaaattgatagccattataatctttagtaagtatttgtttttccaaaacaactaagaagtgaacatctttcatttcctagggagaaacaattcaagcaaaatttcaggctaatacctgacaaacaataacctattttccagaaattgccacttagttgttttcttaaagacatgagaggtgcctctcatttcctcagctctgccttttctgcttcctaaaggacagttcgctatgtttgatgtaaaaataggcagtgtaggtgtatagagggtggtttctaatggtcatacttcaccattcatctgatttctaccatttccttctcctgacaaggagttcttaggcctccgacagaaatccatgtatagagggttcaaaggtaattccaaacagttcacatgataataaggttagtaaccctcccctaaactcatagcaacatgtgtcatttgtctttataaggtaagattattctctggttttttaaaagtatgtctaatgatgtgctttttgaagaacaggataataaccaactaaattttcaccaaatttcctaaaaattgactgaaattgactccttttgtgagtgttaaaaggatatgaatttacatttccactgctggataataaaatggtgtgatgagctgtaccatggtgagattctacacaagtgaggcactcatgaaagtggtacttggagcccaaggtaatcagggaagatgagctcctgagtgtggatataagagcttatcagtttggttctttgttcctagatttcaagattgatatgatcaagtttacaaattggtcctctaaaagtacaatggctaatgctaaggatgggtgtgcagggattgtagttggaagaggcccacagactcttaaacagaatttgggaagaaagggatatttgacagttgaattggagtttattgagttatacattgctccattttcattggcatagtaaaaaggttaaaggagaaatcaacaagatattagggatagctataaggacccgtcgagtaaggtgattttcccagtgatttggggataatgggtcacatttcctaaaaaataatggctctcatggctttttactgtgagaatggataggttgagcaaggataacaagaatcagcctggggcccatggagatggatgctgtgaagtagatggatgcataaacttgaaaatttgagacactgaaataagtcacttgttattgattatcttcatgaaaatgatgccattggatgtaattaagagcactttcttcttaattgaggaattctgtgatgagataggtagtcttcaccttgttccacatacatgcaccccactaagtgatttttttctaaatatattatacaatagggaactgttattttacttattgaagttaatagctactattgtaataatttagtgacaacatttgtgctaattgctgagcagaatatttaaatgaatcacttttaaaatatatacttgcaagatgaaaataggtttaaatcctaaaagaccacattctaataaaaacactgaaaatgaaatctgagaatcacatttaactggcttttagtcacaaagtaagcagaaataataagcataaacataattgcaaataaaatataaaccgaaggtcctccaaagaatccaaactacagtattctttctcattcaagatactaccctacttaataccacataaattatcattagtttctgataaatgctaacataaccttgttgttcgaactttttttttttaattatttttattttttatttttttagatggagtctcgctctgttgcccaggctggagtgcaatggtacgaccttggctcactgcaacctctgcctcccgggttcaagcgattctcctgactcagcctcccaagtggctgggattacaggcacccgaacaccacacctagataattttttttttttttttgtatttttactagagatggagtttcgccatgttggccaggctggtttcgaactcctgacctctggtgatccacccgcctcagcctcccaaagtgctgggattacaggcatgagccactgcgcccggcccaaacttttgaatacagataaagcaatacagaagctgtgggttatttgttttgataaagacaataacctatatttaatttagcaacatttttagcagaaatttaagaatcaataagcctaattttttttaactccagcaacaatttaatgagtcacctaatttattttcagcaaagcctaacaaagcctcagctggaggagtttccaagcgaattgttagccagttaatagagaaaaatgctaaaataggtcattgacataggtagacttctacttctacacaacattctctgaatttcccctattccccccaaactaccagttcagttcagtaattacatggagcaaccattcgaaacaatgggaaaacaatcaatttgagtgtctcttcaattatatggagaaaaagagaggagaggagtagcgctctacttttcagaaaatttgcattcctgttctatggttaatgttcattttttttcccccagctctcatctcacagtgttggacaaaaacttcaccctgtgaaaacacatattaccaaggactgtatttggacatttgcattgcagttccttggggaggatcattgttaaatatgcagattctcaaaataaaggatggaaaactttgtggatatggagccccaaatctgcgtttataaaaattctgttaaagctttgtgaaatcaggactgttttcctgcagatcagaggcttaaaagaaaacaacagctggcaaaggcctgagtagggccagccttaggcaaattgtgaagcagtccaaatttagagtttttatctctcagttcatttgagagtttacttagaacaacttgcttgtcctcctgtgccagtgctattggcctctcttctcactgcccaggggaccactcaacaccaccctccaatcagctgagcatcccaaatgcagtctccttactcctgagtgttaatgcctaactggccgctcctactcttccaggacattcccaaggctacatcctatgccatcaaaaccatttctatacctcaggggcctactccataaggctggacgtttcaccagctaacacattttaagttatcaacctgtttgctttttaaaaataatatttataatttttattccaaaataatgcttgcttaaaacaaaataattagaaaactaagaaagaaagaaggaaaaagtcatatctaatcccatttgtcatgcgtatcctcagcttaccctgacctctaagatacatatgtacaaattcatgtattgtgtgggtgtgcgaactcacacacaggcatgtgaagggcagtgtgttggtttagttcctacctctggaaccagactggctgactgtgatgctagttttgccacctttgccaggtcacttaaccactctacacctcaatctccacgtctgtaaaatggggatgctaataagacctatcacagcgtagttttgagcatgagtgtaggcatggttagccacagtatgtgctgtggttagcacatgcacactagaatcagctacctgaatttgaatcccagctcaataactagcagattttttttcctgcggaaaagtttcttaatatctctgtgcctcaatttccttatctgtaatataagaagctcaattgggtaatgacaaataaaaagtcagatgacaagcagttttacagcttctgtgttattggaattaaaagggcaacggaaaattacaaactaatgatatgagatgaatttgacatttctattcttgggctattaggacttctggactaagattaactttcatattattgttttaattataaaagaaaaagcagtatattttctagggaggaagaaggtaaactcttatcgtgttcttaagggatccatgacccaagcaacattaagaactgctagggcattagatgatcttcttgctccaacattcaataattttacattttatgctacctattttgaaaatctacttccttaattttttaacttgaatgacatcaaatgtactccaaagtagcatttctaatactaaattccatgagactctagtgtctgtctaggtactcataaatagagtgccagaatttggaaaaataatcccagagtatattttccttttatcaaaatcagataccatgatggcccattatttatatatgtgaataatactattaactttttgttttgttaatttcttactatttttttttctaatttaggactaagacaacattttagaagaaaaatgattttctatagtcctaaagagttctaaatcactacttcaaaaatcatgaaatagaaaatttcgaatgaagcaccgaatatcttttaacttcagtttgaaaagaataaacttttctctatgaaggctagtcagttcactgaaacaaccattggactgagtttttgttttaggcatgatggtacttctatctacatgttaattctccagcatttatctgaatttatgctctaagtatgcatgtttgttttggtattgatctctgtccattgacctgagctctgatggaaatgatagcaaacatgagatgtcttttagttccctaagtaccagatatttttagtttaggattttttttaacataacttatgtttgtgatggttttggcactgtgacgaggggagcccttttgccagtcctgaaaaatctccattgttttaaaaatatccctccatgccattgatgaaatccaaaagaacttcaaggatgaaagggacgatgcagcttcaaaaccctgactggctccctggaaggctgagtcactgagcagtgccctgcgtgtagtattcatgggaacagcacacagcacagcatcattcttctgagctggcagggagctgaaattaactgaaatatccacatcttggaggctcttcagaaaaggatttgctttctgttcaataacctcatggttcaagcagtgcagtcatgggcattagtgcgatgtgcgggtagacattctccttagatgtcttagatgaaacccttggagtccaggggatgctgagcagtggtcagctggtagtctgaaaccttatagaattaaaagctttaactggacctagtaggagctaatattttcaaatacccacacaagttcaaaaatatgacaatttttgcaattgaaatcgtaaatgtgttggctattatttctttctttggctgtaacctgcatgtaaaagagattttctgtgaattgactctaacaaatgcttttaaacacctgtctgattaatcaacacattaaaatagtgtcttcctaaaaataaaccagctctatttttatttcacttgccctttaccctctcaccaataattattcaatgttggctaataattaattgcaatgtaaaagggcatttcactatgcttagcaaagagctgggtatatgtatagaatgcctgacgtgtgcctatgaatagttagggaagattgccctctgagtttgaatgtgttatttttggtggtgttatttcctgtgtagctctatggaaataacaaacccaacagactggcagtacctttcacccttagatgcctgtggagcgtgcccttgggataacgattacagacatgccctgtagcacttgttcctttgtaccacaggaaagacatggggctacagagaggagttgctgctagaggctgatacatgatgtcactccaccaggttccccagtggacctactcagagcacggtaggatgctgacaggcctgctctggaggactgcagtgcccagcacagcagcagacagtctcagtgagtagcctgagatttagcaattcccacaccaggtcacctaagactctttctgggacaggctcagccaagaataataactaccttgttatcaggaaagggcagcaagccttttctgtgaaatagcctagtattctctacatttctttctgggagtgaatttgcaagatttttacagaaataaaggagaacatctgatgcccaaactaggtggctcttaaaacttaagggagcaatttggtgcaaaacaatgtttagaattcttcaatagattaaacataaaaggaagatgaatttaactggaagatgtctcacctgtttttcgaaaactgtatgagtaacgaatatattttggtaattctcccatgtagtgtaaatattcacaataacttaaagtctgtaaatgtaatttagattttcaggattaaatcccagttgagctaaaactgattaactgaaaaacagaggtgccccttaggtttcttctggtggtttactcagggacccactgccacagccttttgtagagccaagagaaatgtgtagcctaggttcttccccaaacccagcaactcaatgacaaatctagcagaaatgtcaccataatattctgactaaagcttcagaagacactattttgagacagagtgagtatattgtatctaaattgtcaggtctttgtacgctcatatttatttagtaatttcactttcctttttatatcccatttcagatagtggtcatttactatagtaataatgatgacaaactattatttattgagtgctgacttatatatttgatttcatgtacattattttaatcctcccactaaaatgtaagttctgctattaccactgatgaggaaactgagtcagagatacaaagggacatgaaagacatgtaactatagtaaagtgtgtggtgcaaacaatccaacctaagtcattctgacaggtgattgctgctagaacgctttgcctccagcactgttaaaacaactggattcctttaagccctgactatgatcttttaattctgaaatactatgaaaatgtaatttgctaataatttactgtggattaagtatatgagtaagaaagcttattaaatcaacagttctagtttcagtctctactatcttctcaatcatttgtgtcttgttttttatagaagttttcagtaagcaatgacaactgtatgttgacagaaaaccattcttaaaatttgcagcagacaggactcctatacatacttctttttttgtttattgaaaatcttattatctggattctctctcattatactttcatttctacaatattttcaccttggcacagagacataaatattaaaaccagaagatcacattctagtaaaagaaataatggtgtttccatcactgagaataagtgctttttcatatatattgcaaattccaaaaatgtctcgggaaatgagttaaggaaggaattgcttattccatcacaaagaaaatctcaaacaaaataaatttacataagaaagtacatgaagactgggtgtggtggctcactcctgtaatcctagcactccggaaggctggggcaggaggatcacttgagcccaggagtttgaggtgacagtgaactatgatgatgccactgcactccagcctgggcaacagagcaagattttgtctgtaaaaaaataaaaataaaaataaaggaaagtacatgaagatgcagcaaagctctggtatcagtaatattctgaaatagaaacagccattccttcctgtagaaagtctgtcttgagtttgaggagtctctggaggatgtatgatgggcaaagctgaagttgtcacgatctgcctaatcaagtgtctcttcaacagtgtccatggggattacacaatgtctaatgaagttttaggatgatttgttagactaagccttccatcagacagagttctttcattaattatgattccaccctagagactaactaagcaatatgtcccaatcttaataaaagtcctcctgagcacgtatgaatttataaagtagaaagtaaaagctgtttccactttttgaagataatttgcaaactggaagtcagactagatggcacaggtcacctatatctgggagcctaaagatgattataatttcagaggataagaaaggaagcttacttaattgagatgtgtagagagagaagggtatgaagccaggagaacgagatgtgacccttgatcccagagaagaagatcttcaagagtcacttctatgacctggcaatggttcaaagatactttgtatgaaatgaggacacatttttggaaactaatgagcttcaatgaaaaagagatgaacatatttttcgacttcagctaaaaaaaaaagattaacttccttaataaaaataaaattaaaactgcaattagacattgctttcacttatttaaatggtaaatattaaaattttataatgcaatctattaaaaagtatactgagaaaaagcaaaaatagtcatgtgagggtaagtttggtgtaatttttttcagaacaatctactaaaatccttttaaaaaatatgtatttccttcctttgacttgggaattccacctccaaatattaattctagagatatatttactttacatgaacaaataagtaaaagaatagtcatcactacactgtaggtagtgacaaaggatgggaaacaatccaacagactccaacaggagtctggtgaaattatgtctcatccagatcatggacgatactgcaattgctaaaagcactatggcagatttgcatgcagagttaggaatcaatctccttgctatatcattagggaagataagcaggaagcagaatatgatatattatgtcttagcatttgagtaaacacataaaagatctccattaggaaatacaagagtagcagttgcctccaggaaagggaattggataattgagaactaaagaggggtttactggtcatgagtatcttttgatactgaagatcgtgtgcttgtatcatcgagtcaacccaattaatcaattgatcttttagaaaagactggaaagaaaaggtatctaaaacggtcaggttgcaaagtcaagtaaaattgtgtcaataaaatggctcggagaagtgattctcaaatatctgggtatcagaatctctttatagtcttaaaaattattgaagactcacagatttcttgtttatgtggaatatttgccatcttaaaactgagacaattataaatatttatttactaattcattttcaaaaaatataataaatttattttcggtaaaaataactattttccaaaaaactgtgagaagagtgacaatgttttttatttgtgccacctaatggaagacatctaggttctcatgtctgcttccgtattcaatctgttatgaaataatatgcatcacattgtatagcttctggagaactctgctgagaaaatgtacagtgaaaattacaaatgacatgttggtgttattatgaaaatatgtatggtctcacagacccctaagagaatcctggggaccaccctctatgagccccttagaataaaaatagaactttgcaactgaattgccattagagaaaaaagatcactttctttagctgaagttcactttctagtattctctaactccatcagtaatgtctaactgtcctaaaacatgagttcataaagctcaaagaaggcaacggtgcctgataaaaacaatcttctaggaacgacagtttaccaagtttagttctcctgcgaaataatactagcaaaatgttctttgtgtaatgtagtttctcacactggctaaacaagattatctttcagaaaataaaattctagctctaacagattcatattttaatttaagaaataccaaactatttcccatctcctctaaaactatcatagtcatattattcaacctctgtagaatgggaaatgcagcatctaagaaagcatcttttgtaaggggctaacaaaagttgtaattaatgtagtaaataacagtagtttatcctttcagcacatttttattgaattcactttatgttcatttattgtgctctgggttgatgatagagtggtcagaaaaacaagcctgcaacctgccttcatggagctgacgatctggctaatagacattaatgaaaaaaatctcataagctgctatggatgaaataaaactacagtaagctctgagagtccctaacagggccaactggcaagatttggagaatcagagacacataatcagaaaaagggagatttgaactgagaaacaggagaagtagggggttaataggcagtgacggtagggtttggaggtattattcagtgtagaggaaacagtatgcataaaaactccaaggcaggagtgagtatggtggtttccaagtgctgaattaggtcaaaatcagccaaataatagagagtgatgtcacgaatgatacaagatgtgctgtcaatatacacatgcatcagatcatgcagattcctgaatgccatggtaaggatttccatatttataatgagagcaacagggagctgttgaaaggtattacagacacttgtttgtgtttttgttggcatgtttaccggatgcaagatgaggtggccttgcatctagcataatggttcgttttctcgtaattaccagttgaaagtgaacctcaccacctgcttgtttgaggttcaaacaatagtccttgacctcaatcagcaaagtggaatataacatttcaggtcctcaaagtgagttttaaagtgaaattttcttactatctgctatcaaaaacttcaggaaaagtgaattttcaggattattacctaagatatctaaggaatgtcagcatccctccaatcctctggttctaaaagttttatgtaagagtgagttaataaccagaactgtccatgctaggaaagtaatagtatggcatttgaatcacctgcccggagtccagcttcaacattctagccttggcttctaataaaatttgttataagaaagaatgctatgatagatacttctggatttgttgcccacataccattagggcaaggtctgttatctggaattttccataaagtctcatgtggtaaaaaacattgctggaattttgtacccaagacaacatgtttttccctaaggaacatttcttcttttgcattaatgagagcaaattatttaataaattgccacattggcccaaccttgatagagttaaaacaagttaaacagaattaactatgatggctcttatgctttctttcctttgcttcattccaacaatatattttgctcataccaaatcaacttaaattctatttcataagctctctctaattcttttacaaagtgatatgtggaaacatatataaatgtaacaaatgcacatgttcagttttaagaagtacactcgatatatcctcaaaagctgaaaaaataagttcaatgggacaatttcattcattacagactccttttcttttaacgttgctaaaagcttaaaagacatgaaagcataaatatttatttgtatcactgtaagaatgactgaccactacataaaattggaaaagaatgcatgcctaagaagggactacttaccttattgatatagttttcattacaaaaatcaggctggtggcatcaaacatgtgggccatggcctcactccaaactgctgaagctcatttgggatcacaaacgatttgctaaagcctcaccactgctgccaagacagggagattgtactgaaatgtacatttcagagccaaatttagtgctttcttggctacgaaaggtgaagccaggacagcagaaaggaaacctaacaatgggaagacaggaccctggagtaacttcaggaaaaactaatccaagtaagaaggcatgggatgtgcagttgccgcttgttttgggatacatgtaattcattttttaagttattaactacacacataaatacacactcacacatatacctgcataaacatagaacacgattgtggtgggcagaattctaagatgatctccaatagctcaggcccttacactatctcctcccagatggtcaacatctgtaattttcttttaaccagtggaatatggcaaagttaaaggattgttcaaatgtaattagcatccttaatcagttgactttaagttaatcaaaggttattcagggttggtctggtctaagcaagtgattagctctccaaaaaatggcctagaagtcagaagtcagagtttctttctcctgctgaccttgaagaaacaagcttcaaggaattttacagtggttaagaaattgattctgccaacagccacctgatatggaaaaaggagccagaacctcaaatgagaccccaatcctggccaacacctttcttaaagccttttgagaccctgaacagaaaacccagctaagtcaagtgcagtctcctgacccatggaaactgtaaagtaacaaatgtgtattgttttaagatgctaattttgttgtgatttgttatgctacaatagaaaataatataatgatgtttggtgctgtgtgaaaggtaccatgctgaaagcatacacttcggttgcttaattagtacaacttcagtatttgaatataacctaagaaaaatcaatgggtattgacaaacacacaaatacacaaatgtatacatccatacacactgaaatttgccatcaagggagaaaaagccaacttgttttcattacctacaccctcaaatttacttcatcttttgtcaaactcatcttagttaaaggcaaattttttcatttttggactagttggacaattctaggtccagctagaaacctcggggtcatcactgactacttactgcccctcatcccttctaacaaattggtcaccaaatcgtactacttccttttgattctttttcatcccactctttaactcaatctctactgccactcatgagctcttctttctaccaaacaatgcttctatctgatttatctgttcatagattccccacctcaactccaccaagcccacgacttccctttcagtcttagaggtgctccctaggtcaatgggaaggaagtgaaggaagtcaagtagaactaaacttggcgacgatgggagaagaaaggctagagatcagataacagacatgcctaggaaatgatagatgagtttactgaccttgttatggattctgagcattatcctgtaaacaatgcaaaaccactgatggattcacaacagaagagttacacacacacacacacacacacacacacacacacacacaagagcacacaggcacacacacagcatagtctttccttgcaggaaattattcctaatttggaaatgaaggttctttcacaaatcagcaagttttttgcaataaaaagctacttaccaactctgcaaacttggatatagtcaaatcattttttccaactttttattgtggtaaaaatacacataaaatttactatcttaacaatttgataatcataatttttggtaaacagaatttggaatctgagataataatcatgactgtatagaccctgcatagtaatggttcaattgaacttagttctagttctttctcctcccttttgctaacagtgaaacatcaaacaatattcatcttgcccattaatattgaagtaaaacttgctgaggcagtttggtctcagggagtgtgcacatttaaataccaaaaagttaacatctacctagaagctagagaacaaagttagaaaacaaagaaacaatagggaatatttttgcctttgggtaattcagtagtactgatcagtaggaaaaaaaactcctactgactggtaagaaatgccatagaatatgggtacgctcaatgaaaatggaaggtttttttcatatgccacctctattttcaccctcttagatacaacgaaacaattagagactgcatgtcttcatctctgaatgtgcttgtgcgcaaaatggctatgtctaaccagatactctgcatttacattgtgaaaggtacctttctggggctgaaacgctatacttttccccttccttcatttcttgtccctcctcatgtatacaaaacagtgtttggagaaaagaaatatatactacatagagtcaagtcattaagtctaattccaattctctagttcgtggtttcaaaggaaaaattctgaaaatttaagcagagatcaagagaacattcttctaattttctgtacccagatgacacagatttttaagggatgacacagtcagggggatgactgggcagatcttgaagcaatctggtagtcacatggaatcagccttttttaaggccacactcacattttggggctgtaattgtttgaacagcgtagaaaagtgtcagagctgctaactgcacagctcaccagatgcaggagtgggatttgccactccaactatgcagaagcttggattgagccaagaatctggaaggagacaatatgagaggctttccttctccaaggcttaaaagggcatgagattctattaggctgaaccatgtgaaattagcaatattttacaacttttacctatgaagttggttcgacacagtacattgcagaaatgaagagggagaatgtgctttaaaatactggtgtaataaatcatacatgtctctaaaccaaaacaataaaagtacataagcagaaaaatactctatacgatgatagaatcaacaggccatggcgttttacattcgctttcaactctgctgggtatgtttttgaaaactagtgacttatgccaatacttccattctaaccaatattcttaaaaatcaaaaagagttgttgaaattttgaaaaaccaagtaatctagtaatacaaaacagctttctattgttaataattgcatatataagaagcaagatttaagctaggcatggtggctcacacctgtaatctcagcactgtgagagactgaggtgggaggactgcttgagccaggggttcaagatcagtctgggtaacatggtgataccttgtctctacagaaaaatttttttttaaaaaaatggccgagtatgatggctccctacgcaggaggctgaggcagtaggatcctttgagccctggaattcaaagtagcagtgagccataatcatgccactgcaccccagcctgagtgacagagtgagacctcatctctgaagaaaaaagtaagatttagagttggtgagtccagtgagatgttacttttcacataatgtcccttcactctacttctcaacatctccatggtatttgcacaaacgtgaatattctcattgcattattggaaattttatcacatcaattccttttgacaccatgaataaaactgaaatatgaatactggagaattctaatgtgtgccagaagagaacttcaacttctataaaaaagtgttcttattgaggaaacaattttcacttaacaagactgtagataatagagttataactcaagagtgatgatattcattaaagaaaatagacctgtgtttctttactctctctactggttatgatttcttatccattttaaaaaaaaataaagtattgggagaatacaaagtaatattatatgtaaaaaagaaccagcaatactgtaccctttcctcacacaaagaaaatatttgcttcggaactgggttcttgccttgactatgtcaattatcacagtttttctcccttacattcaatcatcccaaggaatttccaacctgacttggtgactccctcctccctttcatatagatgggactaatggagcattaatctgactgtgaaatgattcaatttcaatttttctaacctgaggctataattatttttcttcttagaccagtaagcaatgagtcattaaagagaaattctgtggggcagaggtcccatctgaggtccaatctgataagtgcacagggtacaaaagtttgcagatatcctccttttccaggcaatgcagaaaaatcctggtatctggtaagcttctctttccatatattaattattaaggatcccacttataatatctacagattctctgctcttttagtgatatataaatcatggaataagactatccaagataaactgtcctttgttcagagttcacatttcaaatgaacacaagaaggaatctgtggctgggcatggtggctcatgcctgtaatcccagcactttgggaggccgaggcgggcggatcacgaggtcaagagattgataccatcctggccaacatggtgaaatcccatctctactagaaataacaaaaattagctggacgtgatggcactcgcctgtagtcccagctactcgggaggctgaggcaggagaatctcttgaacccaggagacagaggttgcagtgagccgagattgcgccactgcactccagcctcgtgaccaagtgagacctccgtctcaaaaaaaaaaaaaaaaaaaaaaaaaaaaaagaaggaatctgtatcctgcttgaaaaaggacagagtgagaattcctccttaggtcccatcactgactcctcttttcctccttgcactttaaatggtgcacctctggcttccatccttgagcttttccccactggcatcccttatttaggtgttctttctgatgctcatcatattttcctagtaacttccaaccaatccacactattctctcaattcttctgagttcctaaaatctgatatattgaaagaacctgaactttggagtcataaaaattctagcattagccataaaaaaagaacaagatcatgtcttatgcagggacatgaatggagctggaggccattatccttagcaaattaatacagaaacagaaaaacagataccacatgttctcacttagaggtgggagctaaatgatgagaacacatgggcacatagaggggaatggcacacactggggcctattggaggctggagggtgggaggagggagaggatcaagaaaaataactaatagatgctaggcttaatacctgggtgatgaaataatcgctacaacaagcccccatgacacatgtttgcctatgtaacaaacctgcatatcctgcacatgtacactgagcttaaaaggacaacaacaacatatatattctataacttttctaagttccattttccaggtctgcatctagagaaaagggtatattttccacggtctgttgaaaagattaagtgaactgtgatctgtgcaaagcttctaggagtaccaagcctcacaaattaataaatgatagtgctgaggaaatatgataatgatgatgatagtgatggtgatgatgatgatgacaataatctactgaacatttctatttgtgtgttcactagcaaactcttcagctttcctcccctgacctggtaagtgctaccatcactcacccagttggctgagtacataccttaagatttccatctctttattctttatccacctgcctttttctaattgattgctaagaatggacaaacctagcctaataatatcaacctatttattccactgctctaagttatgactctatctgctatactggatttttatcataatgtctcaactggactccccccaccttctgtcttgctttatttttattccccttctatgctactacaagaggaatctttctagaggacattgattatgtttctcttcaacttaaaactcttctatatgaggaacaattgggatagtgtatgtcaatgcactatgaaaaagtctttttaaataatgatctataaatggctatctcagtaatattatcttaggaagatgtagaagtttttatctcatagaaagggaaaattactgttgcatacttatcctaatactaagatgaagggaaaggaaaaggataggacaacaacaacaaaaatacatagtaattgtcctacacattaatggtattatgaaaacaaatatttagagccaaaaatgcatacatagaaccacaaaatatgaaaatatatataaaatcctggtttgagagcaagtatctttgcttataccatatttacaactctacatgaaaacacaataccttgattctaagaaaatgaaaaattaaagaattattcttgtcaggtgtgggtcttaagaatagtcatcctagagaaacaagcaaaagaaagactatgaagtgtttattgttgttgctgttttgttttgcctgcatgttcgtttggttgtttgtaagaggtatatcaaatgcaaaggcttgttaagtgtgattaacagattattatggtgtctatgcagatagaattagccagaggcaaaagcacatggcagagatttttaaaaacatacaattgataaaaaggataaaaaagcttaaacaataaacatacatgttcataagtgcagcaatccaccatggcacatgtatatctatgtaacaaacctacacattcagcacatgtatgccagaacctaaaaaaaaaaaaaaaaaaaaagaagaagaacaaaaaaaaagcttagataagtttgcagggcatggtgggtcactcctgtaatcccagcactttgggaggcggagcttgagcccaggagttcaagagcagcctgggcaacacgtgaaacctcatctccggaaacttcatctccacaaaaaaatacaaaaattagctgggcattggtggcacacaactctggtcctagctacttgggaggctgaggtgggaggatcagctaagcccgggacaaggaggttgcagtgagccaagatcgcgccactgcactccagcctgagtgacaaagcaagattctgccaaaaaaaagagaaagaaaagtttagacaagtttccaaaaggttttaaagataaagcaaaaaaaggataattttgcaataacacacagcaccactccccaaactcacccctcaacccccgacacacaaacatccacacatcagtgtttgaagaatttccagtgatagatgggtacagaaataattaagattagaaaaccaaagctggaaaggctggtgtagtagcttcctagttagagagagagggcagaacaggggaaggagggaaatgactgaaaaagaaagttcatttgtctttatgatgttaccaagtaggaagtagtttgaagtgttagttttcatctttttcagatgagttgagaaaaccaatttaactaaattaatgcaattaattagtggtgacctgaaatgcaatatatctacctatgctttcacaatcaaaaagcatttgttatgcttcacatattgacacaagtgatctatccacaacactgcaaatttcctctgcagatgagcgttttcaaatgtttgccttacccaatatttcaaactttcccccactcaaacaagctaaaaattacaaagaacaaaggaaaacaaaactgcaagattttaaatttaccttaggtgtccaaatacttatggatttttatttatttacttacttactattttttcaaatacaggtgggatgttgctatattgcccaggctagtcttgaactcctgggctcaagcaattcgcccacctcggcctcccaaagtgctgagattacaggtatgagcaaccatgcctggccatggattcattaattgtactttttggaaatacatgtaatttaaaaattattttatctaatagcattaagtcagtcagtcgacaggatctatcatttccacttttaaaaaaaacctctcttaaattcatctctttactgccatgtccatcctttactgccacagcatcagtttcagactatcaccatttatttctcatctggtttactgcaataaacacctaaatcacacctttaatttcttcccactccatggtctacatatctaccgaagtaagtttttttttttttttttttttttttttttgagacagagtctcgctctgtcgcccaggctggaatgcagtgacgcgatctcggctcactgcaagctccgcctcctgggttcacgccattctcctgcctcagcctcccaaatagctgggattacaggtgcctgccaccacgcccggctaattttgtgtgtgtttttagtagagacggggtttcaccatgttagccaggatggtctcgatctcctgacctcgtgatccgctctcctcggcctcccaaagtgctgggattacaggcgtgagccaccgcgcccggccctaccaaagtaagttttaaaaaattcaaaactatccacataatttccctgcttaaaaccaatcagtgcctctgtaacatcttatagggaagttaaggaatctttagcaaagccttatttcctcttcttgcttttccttaccagccccatcctccacagccggaactccgtatatattgaactactctcttaggctactgtcttggaaaatactaaccattagatactacagtttttaactatctacttaaacaatttctactgtttaataatcagatggcagttatattctgttaaactactagtgcacatttgaggacattatcgttgtatttccgtttggtcttctatcatttgaaatttgtaatttgtttgcatttatttttcataggcagatttgtataatagaagatccaaaatactcattaattaactacatcaaatatttaaagcaaatgcttagacacaaacggcatccaaagcaataaaaaggctgccagactgcttgagggccaacactgctatatgttattgtttttgggtttttttgttgttttttgagacgaaagtctcgctctgtcacccaggctggagtgcagtggcgcaatctctgcccactgcaacctccgctccccgggtttaagcgattctcctgcctcagtctcctgagtagctgggattacaggtgcacaccaccacgtccagctaatttttgtatttttagtagagacagggtttcaccatgttggtcaggctggtctcaaactcctaaccttgtgatccaccagctttggcctcccaaagtgctggcattgcaagcgtgagccactgctcctggcctgttattgcttttctacatactcccactatgtcctcattatctactttatgggttcaaacatttctgattttttttttctttgagacaggtctcactcttttgcccaggctggattgcgcagcacagcaggagcatagctcactgtaaccttgaacccctgggctcaagcgatcctcctaccccagcctcctgagtaggtgggaccaatcagaggtgcacgccaccacacccagctaattattgtattttttgtagagacagggttttggtctgttgtccaggctggtctggagatcctgagctcaagtaataatcccgcctcggcctcctaaagtacggcgattacaggtgtgagccactgtgcctggcctgaaatttttcatgagttacaaaaagatgtagtgacaaaaattcaaaggggtatcttgttcattattgtcaagtcaataatctaatttggtcgaatcagttaaaacaatctctggggaaatattacattgaacatgcttgacaaagttacttcagtggcccatcttgttatctcttaaacctagctaaggagatagaaatgtttaaaagaaagcatttttgatatgtgacatcacaaagcacactacctcttcaccatgttttgtataattagtaagacatataatcattatgtttgagctcattggaaatgaaatcacattctaccagggagtaaatggcaatgcacttgagtctggggtcctcatgtcatgactgccactaaaaacaaacagacataaattgttttccctaaatacatttttttctgaaatattgctatagtgagattattgagtgtgtatgtgacctgttattactggttttttattttttgtgaaatatttcatgtttataaaatattccatgtcaacagaagtaatgactatctaacagcttccacatcttactacccccaaaataaaaataatacataaagttaaaaaggagcatttatgaaattataagtgccattttgccaggatgatgatacatactcttcttcttatgaatgttaaggttagtagaccattttgaattggcaattattttctcagtcaagaaatttatttatttttacttttgggtcttaatgtcatgcagaactaccagatgccaataacaggagtagctgtgggcattttatatatgtttaaaccaagctaacagaatgaattgagccagagtatttataatttattaataaatgttaaataatgcataaacactaaaataatcataagacaaaacacaaaataacattgaaattagtatctaatgtccttattatcatttttttatttgccgtctccttaaatataactctcctgcaacatcatcatcctggcaatccatggtgccacttcttcaatgacttcctgtcctttaggtttatttccagaggtgatatttgcatttgtaaactgaagtgtcttttacataaaataaattgtatagttattttttaactctttaataaaataaagcacatggtaaaggttgtctgaatttggagttgttttctacttacttttaacagtatattcctaacttcataaaattggtaaccctggagttcaattatttattaataattctttcagttcaagcaatgtacaaatactgtgtttgaatgtgagaaaaattgacagagtcattattttcataggagtttatagtttggtgaaagaaattggccttatcaataattatacaattaaacatgtaattgaaaatataataaacaatataaaggagcactatatggtattatgacaggtttgggagatctgaaaatacttcaccaaaagaagtgatgcttgaatcaagatctgaagtatgagtaggtgttataaaacactaatgggtgtggaggaaaaggcatttcaggcagaggaaacaagacataaagaagcacataattcaacacaaagtttggcctatcccattgaagccatgaacatccttctgtttctcacaaactgtgggtctgttgatttatttggatatttcagctatttatggcagtttctgagttaatataagtatgggtttcttagaaccatattctacatgaggggcatcattatactctattacttctcaaacatctgataagaacagggtatttatccatgttggatgatctttcttcagtgtctgtagtagcagctgccgtgatgagtaaccacatgatttctggacagtagagacccctgcctactgatcattagacaagaaactggtcctcaataaaactgaaaacccaggtggtgggaatgattgagtggtagtaaaataaaaatgtgtgtatagaagagtccaaacttttactttatgttttaatgatttaaaaatgcttccaagtgagctggaagcacacctgcatactaggtaatattgttatcatgaatttggacaatctcgatagactaaaaatgtattactctaattgctttcagagagaagggctgtgagtaaattattctaaaacatcaacctcatttttggtaagtaacttctaacatttaactggcttatatttaaatgtgtcaatccatgtatttaatggggctacattttgcaactagattatcttggtgcattcaactggaagtggatatgttataaatatcgagacaatggggtgttcatgtcagaaaatcagaaagctggataccaacactgaattctcctttccttctttttttttttttttttaagaaaaaataccagaggatcactctgttgctcatgatggagttcagtggcgcgatcttggctcactgcaatctctgcctcccagggtcaagcaattctcgtgtctcagcctcttgagtagctgggattacaggcacgtgtcaccatgcctggataaattttgtattttttggtagagacagggtttcgccatgttggccaggctaatcttgaattcctggcctcaagtgatctgcccgtcttggcctcccaaagtgttgggattacaggcgtgagccaagatgcccagcctctcttattcctttggttccattctatcacaaataaggaagacccaatttgggctggtgtcccagaattctgagccacacttgagaattaggttgggcttgcttgagggctacagttacaggaacagagcaggtcaaaaaagcaatatttgagcaagaaactaaaataagaccttagtttttaatcttaaggaccagagaacacatacagcatccaaatcaaattcgggtattcaggtgagaacaagaggctgaacgtgggatacaggagagtgagtctagaagaattttccaagttgaagaatgcagcttcttttaatggtgcacacttagtgttcagtcttaaagagaatgccctgttaagaatgctaactggggctccagtgctgatagattttcaatgaatggaacttagacaacaggccatcaatgtgtagttttataagaatcagtcacagttataagaaacatttatatctatttcaaactttatgaagtatagaaaaaatgttgaaactgcacacaccatatcacatagcatcttttttataaaacaccacagagaaatatttcttttaattctcagagttaatagcaatatattttaccaagcaactcattttttaacttaccgatatatgaatcttaaagcaacagtgttcccttccttggattagttgataggaagatcagaaccagtctgtgactcgtttctagcaattactcaggaattaatgaaatgaatttttgctttcatagttcatactattttcatgccattttctcttctctttgatgtcctcatgtttatcttttactaaatttttttatgaaacgcaatcctttgctttttttgggggggtaagaaacaagtgaaatacaagtgaaatatattaaacgaaataagttgaaaatattgttttacaaaaggagaaaatacatgatttttgcttattataaaaacaacacatgctcattttaaaggaaattgagtaagagaagagaacataaaacaaaatcaaagacctctcaaaatatcctctcttcacacacctgtaacagtttggtggtttttcctgcttagacagaatatatatgtattctctctctctgtctttgtctctctctctctacatatatatgtagtactgtctctgtctctgtctctctctcactctacatatatatgtatatagatataaatacacacacacatatatatatacacacacataccacacatacacctacatacataactataggcacacatgtacatagacataatctcatatatgtaaatataagcatgcatgaaaacacactggtaaatgataccatattctgtcatctattctctaaattgctttttccacataacaacttgtagagtttaaaataacatttcaataatttcaatacatacagatctcaatacagatatatcatcatttattttacaatttctgtcctgaaagatatttgggtggtttccagatgtatactattatatgtaatattgcaatatagtatttctttgctcacttattcaattatattcttaggctaagtttctaaacatagaattaatgggacaaaagtatgcacattaaaatattgatatatattatttgatcacccaccaatgttttcctgatttatacttcctgatttcctgatatattgttcactgaaaatgtacataagaaagtggctatgtctgtataccatctcaaattcttttaaatttttcatctttttccaaaatgatagatgaaaaattgtttcagtttttatttctttgtctgtcaggtagaaaaacttttcaaatgtatatttgtcatacatttttcttcctttttgaattttctgttcatggcctttatctgtttttctcttgagtttttaatcttttttatccagtgctctttattatagtatgaatgaagtaatgatcattttttatttccataaaccattaaacaatttatcctatattaaataatttatccttttctcactgatttggactgctacctttactaaaccctaaattttcaatatatgcatgggccttattcttgaccatttatccagttggttgaataattggtttatttctaaattattatcatgctgtttgaattaatagcctatatgatatgttctgctatcttataaggaaaaacagtctttttattttttcaaaatgttctttactatccttatatttaaattaaattttaagtcaagtaatcccctaaaatcccactggggattgtcatttttaaataagcctctgaccttatctgtctgaagtgttgcatttttctaaaatcccatttcaaactgcttactttcagccaccccaacgataatcttactccattagtatactatgttctcataatttttcccttagtgaagcagtcaataacttagctttagaacacagtgccttaaattttgtggataaaagactcattgagaattggataaacattctctaagaaatgtgtgcctacctccaaatgtaatgaatcttgtagagccacataacccaaggttaagaatttactctgtagaggcacttctctaaatttacaaagggggctttatcccatcagagttattttcactcttacatgttgtttttttttcataagttagatcaaaactgttatttctcttcataatattataatttcactctgtcttcataatcttaactcaaattataggctgcttctcctcataccaacctatactcacagtatctcttgtttcattacattacaataaaaaagatcactagacctttttggctcaagtccaagttctatctttgaacatgaatatgtgtctatttttctgagattcaatattcccttccatcatctataaaatgggtaaaataatcactaactctgtgtgtttcaaagagattattaagaaaatcaaatatatcctgtctgagagagcacaaactaaaaagacaaggtttcattattatttccacatttaaaagctcaccacttattaaaaatctatataaaaccattcactgtgcaaggtcctaacatacctaatgggggaaacacataaaacaaataattaaactgcaattgataactgctagagtacaaataatatacgaaagctatgggaaagcccagaaaagaaaaatattcccactttgggagatcgaggcagatggatgacgaggtcaagcgtttcagaccagcctggccaacacagtgaaaccccgtctctactaaaaatacgaaaaattagccggacatggtggcaggcgcctgtagtcccagctactcgggaggctgaggcaggagaatcgcttgaacccggtaggcggagcttgcagtgagccgagatcgcgccattccactccagctcggacgataaataaaaataaaaaataaaaataaaaaaataaaaaaataaagaaaagaaaaatattccttctttgtgtaggaatatccgcaagagggtaacatgaactgagtttgaaaagatattcatgagttttctgaacaggtaaggaaggggtgttgcagagcatagggaaagcaatctagaaggaagaagcagcctcagcaagaaagagaggtgtgaaaaggcacagagaactcagaccacggccagaatttaagtgtgattatttcatggggtttacaaaaggggacaaaagttagactttctgcaagaaagaccgactgggccaacattctgaagagtcaaactaagaaatttagactttatcttgaaggcaaagagaaattaccttaagatttagaagatggtggtgaaactggtagcctggggtgaaaaaaaaaaaggaacaacaggaatgaggagaggttggagctagagatcacttagaggctattgcgatagtttagtgaatagaggataagtgctggaactagggaagtggcaaggaaaaaacacaagagttatttctgaggacgattcaaaagatcttggtggtctttgagatccaaagttaggggagaggaagagtctaagaatgccacagaccagagacaactggatggatgtgatgccccacgttgagacggagcaagaattataaatgctcatttagatgacaaagcaaattttatagagttctcaatctccaaagtggtatggtgaggtttggggcaatggtggtatgtgtgaatatagggtccaaccaatttagctgataagttttaaacaataaggtaaagtggcttattcttcgggaaaaatcagttttcttatttttaaacgtagataaaatgttcctcaggataaaaatagccacatcttttgaaatataatacagtgctatttggtgtaatcccttagcaacgttgctgttatgagccagtactagcagcattcaagttatagactcacatattgcatatttttaaacctgtagatggataataagctgtgagagggacataagtttgtccatgatagacttcagacatttaaataattagcaaaatcataaacagaactaagtctttttagattattattctatttgatctttaagaactcttcccaagacatgcctccaaacccacattaaagtttagagatagaaatcagtgagcaagccatcagtgtgtgtgtgtgtgtgtttgtgtgtgtgtgtgtgtgtaaatgtatccaaattgaaagtgaaagaatgtttgttttctgaagtcatctctcttgtgccaatatttgaatattccacttattcacaaatgttttttaaatgtaatttccaaacttttggttcaaggctataacctggaagttggggctactgatggttaaaagatggccacaatgtgtaaaatgtaaagtaattgtcagcagatatggaggatatagtttgtagttatagtttgggcagtaaactagttgtgttaagtaatttaacccctcatgacacatgtttcttcaaatgtaaaagatggacagtggtggactaggttagtttaagcctcagtcccttctcttctcgacattccataatcttagagaaatatgtcttgttgatgtggtcaattacctattttcatgctactgctccacatgtgggcaactgaacccagatgatccaattagaataagacaaggacttaggaacattccctgcttggggatttgttcctatcctttcccttctacctcctctgcccaccacctcccatttccatgaaacacagaaggtacatcattttagaatcaaaatgtaaaaaggtgatggattcattatgtttttctgattaatcaaaggcttagaacacactagctgataaagtattaaatgaagttaccaagacaatattctattggaggcaaatcaagaataaaaggttcaaactaattttgaaaaaattaaaaagtctaatactgtgttactgtgttgacaatatgtaggaaatgtaaaaaatatacattttccttgcattttttgctatttaaatatccttagtgtccttacatattaaaatttaaagatgtcaaccttatgtcagttttccaatatgcttttttttaaagatactgtttcctaaattcaaattcactgatgtagacaatctgaacggccaatttttcaattaattattttggtaatgtgaaatctaaattttacatcatgaacctagattaccgttacatcctttaatgaagaaaaaattacactaataacctgaaaaatcaataaaacaataaagaaatagcttttataacctagcatagaaaaatgaaaacctaatttcttttattatttaaatattacaatatgttttctttatttaatatatgatgttaacatatttaaaaaactaatgttgccaggcacggtggcttacgtctgtatcccagcactttgggaggccgaggcgggtggataacttgaggccaggagtttgagaccagcttggccaacatggtgaagctccatctctactaaaaatacaaaaaattagtcaggcgtggcggctcgtgcccgtagtcccagctacttgggaggccaaggcaggagaatcccttgaacctgggaggtggagtttgcagtgagccaagattgtgccactgcacactccagcctgggtgacagagcgagactctgtctaaaaaaaaaaaaaaaaaaaaagctaatgtcaagtaaatataatatgcgcagaatttatattttgtgtgattataggttttagctcttttccttctacctaaattgagtcaggcatggtggttcatgacagtaatcccagcactttgggagtctgaggcaggaggatcacttgagcacatgtgttcaaggctacagtgagctatgattgtgccactgtactccaacctgggtgacagagcgagacccagtctctaaaaaaacaataaatataaatagataaaaataaatgaatcaaacaaagtatctaaatcaaatgtccccttctggatatttgtatcactataatccagaatattttataatatcaaggaatcatccatgctgcttgtattttcaaccttagtgtattatattattgaaaataatattttgttgtgtaaagtcaaagaaacaataaaattatttatcagttcagttaaatagttgtcacattttgaagactattggttgaaatgattaatctgatatgtacatttttaaagagtgttttaaacatttttcatatttcattttgttctcttggtaacttagagactcatttctctggtaattttattgtttgaaatttcttgcatgttgagattaagacatgaatctaccttgtttgacagacacactttatataaaaaatttatttaacatatccaaatttcccatggacttaaaagaattgaccacaaaatatctaagggttgtctccttactgcttatatacattttttcattaaacaagattcctctttcccattgcttcacaaactgttacaaattctcaaaatttcagccaagataatatctggaaatgctacagtgcatgctagaaatagctttataaaagatatacctttcttgataatccatagggaatcattcatccatccacccatgaggctttttcagagacattaacttgatagactatttaaaccccccatttggatgatggtaagatggtggtgcgcacgtacacacacacacacacacacacacacacacacacacacacaccttttcttgtttgcttttagaaaattattgaaaaagacgttagatgttctcactagctttaatttatctgaacactctttcataagtatttatatgcattttacaaagtcaacaaatacactgatttgcctctgttgtgatcattaacaccagtttatactgcccagagtttctaaagttaaaatctctaattacttctagaagcttgtgatatatgtcattttgttaaaaatggatttaaaccatatctcatttttagttcattcaggctttatgtcctgtagtatcagtcgatataaacttcacgttggtttcatgtatttcttgatgctgtcaacaggcccaggttctgcacacatttatttaaggtgggctcaccacctttgatgaggcaggagacttgggtttcagtcttagctctagcactcacagtctatgtgatactgaacaaattgctcgcatcttctggggctcagcattcttgtctatcaaatagagataataccatctcatctcagtgttgttgtaggattcaaataagttaataaatgtaaaatttctttgataatttaaaagcattgttgctgttctctttaaaataaaaaagtattgttgctgttctctttaaagaatgaaactaatatccatgtcctccttaaagatgtatttatttgcaaaagcaactctattaaggaaaaacatgacatgcaatgtgtgagcatgtggggaatatgcaagtattgtaaagaattttaagtctaaggatccttaaatagaatgacaatgatatatcaggtgagccacagtggcagctacatataaatattatacatcttagtttgcctgtgaaccattcaactaaaaatttcaaatagaacaattaatcaatgtagaaagcatagcaaaaaataaattcaaatcaatgatgcaatacctctattccaattagcttatttttctttcttccactctctcaggcatattctattttattaaaaaatgaagtcaattaagaaactctacaaaatcaatcagcccacagatcaagctagaactcttgttcttatttaatgtttattaagggctcatcatcacacggtatttttctattaataggtcaaatatacaaagtatcaggcttgccttcattctatcattggggtcctacatagtgtcgtgctcaaccaaaggggagagagaaggacatccacctcttcaaacaaagggtcttagcagtcttggctgaaaaatgaaacttttatattaatttatggaagtctgcagtctttgatctgaattgaggttattaattacaattcttattcttcccatccaacaggtacaagaacatctccaacaaggtacctaagggtgtgagccaggcaaagggctaagagcatatatgcaagctgaaatgatgtgtacacatcagggttatgatagtttggctggattcccttgtacatagtgtatacaacagagagacatgctcacacacacacacacacacaaaactcaaacacacatttgaacaccattatgattttctgatcagtccaacctactgtcaatcagagttggacaaacaatcccagccctagattttcctgtttccacacccagacctgatttacaatttataactgcccattgttcagacttgtggcttggaggtgcagtacatcgatgcctgtccacatctaaggttagatgacgacccctctactttactattagatgtgccaaggatcagcagctcctgaaatctttttcctgtgcctgtgtgggggaggggattcacggcgtggaaggcctgggacagggaagaaaggagctgtccctgggttatcaggaaagggaccaaacgtgggccccacatccacctccacgcctgagttaagaatctggagctgactcctcagaatggctgtaattggtcctttactcatttccttggagaagcagcggtcaacttctactaaaactcccggttgataggcggcttccctgccctgtcttccggagcacttacgttaaggggaaatcactataatcaaatctctacgtcttgcctgctgctaaaacaaggcgctttcttcctgggattttgcagggacgactgatacacacacggtctccctacacacaagctcgcacacaccgacacagtgtaactcccacagcgtcctcgctccttctccctccctcacccccttgtctctctcaaggattgctgaacattttgctccaaactctccaagtcacccacgtgttctccccttttgctattcaatttacttctccacctgacgaagagaaatgcgagttgttcttaggcttttagctgcaatcctgggaccaggctttctcactcccccctcctccccagtcagagcagccccaccgaccctcttcccaatagggtgagtggacagatgctgggtgctttcgctggtcaaatcccgcaaaaccttcaccttctcttcttctccacccagagcaaactgattttgcctgtttagtctcactagccagggtggtatggaagtgggtggggagagggctggtgcgtggcacagataactgggaagcgcgcgcaccacacacacacacacacacacacacacacacacacacacacacggccccagttaacatttatgcagtacttttggggggtctcttacacacacctgaatagcatactctcaataaaggataggcacacccctgtttgtcctcccccaatttccagactagcattttaccctgggtctagaattggtggtgataagccgacttagatggagtatttgagaaaaggggaggtgaccctttgcctgaatgggggagggggcgctctccactcaccgcctgagtccctggaacgaggagggccaggacatcctggatttcttcaggccgggccggtggccggtctccaccgcgtaggaggtgcggtccatggcgcgacagtacaggtagcgctcggtgtccgagtagccgcgatgccggacgcggccggtggccccgctcgaggcgtagcggccgcgggcagccccgggcggcggcgggggcggcggcagggggggcggcggcggcggctgtagcggacactggggctggggctggggcgagggtggcggcggcgggggcaggtggtgatggggatgcaggaggcggaactggggctgccggagcgggtactggtggtgctgctcgtgcctccagagatgcttgggggctttgagcgtggccccgccggcgctgtcgctgccctctccgctgcccgcccgggccggcgcgctgctgccctctgcctccatcctggctcgcggctccgcgacctgctgcccagcccgggttcaccgcgctggcccgagcgccttcctgatgctgctgctgctgctgccgccgccgccgcttctgcagcccagcagaggctggtgcttagcttctcacttgaaggcgccagagcctcagggctaccgagagggggccctgccagcgggaggggtcacagaacgcggcagggctccttccaccgaggctatggcagagacacgctcccgggctccccaagtcaccaagactagggtgcgcggtgcccggtttcgccagaggttggtccttcttcctccctttcttcttcccttcctttgggcgccggcggcgagagcagggattgtcagcaactcgggctgcagaagcagcagcaacggcggcggcggcagtggtagccgcctccagggcaccggaaccctgatcccggagctgctgaaaagttggacagctccaggctggcacgcccgagctgtgactttcaccaaaaccactccagccagtcaggagtcagacctgtcctcttgatccttcccctcgccgtgcccgcgcctccctcctccacactgctccccactgccccggagccttcctcttcacctccgcttgcctcagtgctcttagagaaatggagtttggcgattcctggctggttctcagagcttgttgacgatgagccccatgctggtgcttccaaagataaggaatgtgaccaggcaaagttgcctggaatattgtctatgcgcgtcgctgaaaaattggatctgggtgaagatccaatagtaagattaattcagtctctttccctgacataggataaaacattgtgtggctctttcccacagcagggagaatgcccaatgtttcctcttgaagatcttcctccaacttggcctcgggagtggtcctcgctggaaatcaaggcgagtcgtccttagttgcagagccatggctgagcccgctggccagagttaaggttaaggcaccttttcaattacaaacctctgattatcttcggtagtctctatcttcagtgcctgcctgcaatttgcctttctgccacttccagcagaacacagctctattactaaagtgttttaaaaacatgttgtatcaatattcacagaaattagagtcctatgaggcactagaatccaaattcaacttttgtcttcctttaattagcattttcctgcagtgtcaaatgttttttaaagaagccaagaggatttcagggcaatatatagacacttttttccctgtaccttttttatttgaccatattacttaaagatgaaatgcaatttgcttactgttaaaataattctagaatttttctttgtggaagttaccacgtaccatccattatttgaacgataatatatttaggactcacaacaacttgttggctgtgtaattattctattcttcccacacactcagtcttaacatattttcatatgtacatttcaagcatatcatgtaatggatgctagagtaccagaatcaggaaccatgtctcaaactctctagactgctgaaaattcaacactctccacacagtctagatgccactgggaaaataatgccaatgaaaataagtgctcactttgtttatcagcaagaacagtccacgaaatgtgcaagtggcaggagaaggccttcatcatctcttcatgctatttatttatttatggttggaaatatacctttcctccatcagtttaatatgagccctctgctcatatgtggactatacacaaaatctgagaaaggttgtgtcttaagagaaacaaggcaatctcctaagcaccactctccactgtgtaggattaaaccatactttacaaaggcactctttttgccccttttgcagacacaagtgtgactggtggcagtggtcaaagtatttaccatgcctaggagggcactaagccagtattttcccaaacacaaaaggagagaaatggaagtgttctgcagtatagactgcctttttcttttaattcattgcattattaacatccaaaaccattttaaagaagtacacaaatttcttctttcccctgaaatgcttgccacctttcgcctcaatataactgtggcaaaatacctctatccgaaactcttattctaatttctcatacactaacagtacaagtgacttataatttttttccagattaaattggaataattcaaatccaacctgattttcaccaccaatttgctccttcctttttactcatgaaaactttatcttttatatatttcccactgatttttaaaaattctttgttttgtttttactatgtaattgcaagtcaggaacattttaaaatgtaagaaaatcatttaatatgtttccaacttgtagagtttttaatttaacttataattccaaaatgttattgatagtaatagtttcttgtgtgatctttgaggttacagcttgagttccaatctaccacttcctacccatgttactttagctaaattatttaccatccctgtctcccatatgcaaagtagtactaatattacctacttcacagaattttgcaattatttaatgaaataatacttagcacaatgccttatatgcaatgaatgtttaataaaggtagcaatttttattattcctgccaggctgggaagtatcctaaatatcatgttaatcagcagttcccagtcttggctgtacctagggaatatcacctgggggagcttgaaaaaaaatgtctgatgttgaacctagagcagtgattccaaactttgatgttatcagaatcaccaggagagctaatccagcacacaaagacccaggctccatgaagcaggatagggcttgaggctttatacttttaccaaatttgtgagaagatgctgcttcagtgtaaagtttgatcatcactaccctgcctagacaaataaaatcagtatttctaggggaggatcaaggcatcggcattttaaaaaactcttcatgtgatttcatacatcagcaactactgatccagacttactctctcattaaatggttgcaaaaacactgtagatactattagttgactcgcccttgtgtctcaaatacttctagggaagtccagcttataagcaaagttctcatgaaaatatgcactttatgtattactctagttgcctctatgctaaaagaaaatcttatactgctgaatattgagcactcccagccttccatttaaaaactcttctcattaatctaggtatttcctacttttaattaaaacaacaaaaatgtaaaatattccatctacccattggttttccctgcttatatgttaaataaattatccattctttttcccactagttgaccatagattttggagttttatgggcacagtctgagagagatttttgtgaagcattgggttaatgtgggacatcctggaaagctatcactacttaccattagcacatctatataaaaagtaaaaatcaggtaaatgatcagtatctttttcctgaacaaacttaaataagcagttagttggtgtcattaccatgcattatgtcattaccacccccacccttttctgcaaatgcatttcaaatctgtccaaaagatacaatcaatcactcaatgtgctgctgggcaattaacaagggagaacattcttgtcaataatgatggagagttctggcagaagtgatgtcaattaacagctagcagagagcaagcaccatttctatccagaacacagagtgagatggcaagtggcagtaactaagggtccatttctatcttggcaatgggaggaggatttttttttttactttttttattatactttaagttatggggtccatgtgctcaatgtgcaggtttgttacataggtatacatgtaccatgttggtttgctgcacccattaacttgtcatttacattaggtatttctcctaatgctatccctcctccagcatcccaccccccgacaggccccagtgtgtaatgttcccctccctgtgtccacgtgttctcgttgctcaagtcaatgggaggaagatttaaaggagactttcactttgcatacattctatgtatacttgagcacatgagtgctacttcatttgtaaagatggtcatcttgatgcccaacagtcagcttaaaatcggaaattttcatcatcatatgtgttacaaaaggctaaactcctgtctaattacatatccaaaggcattgaaagtctcagatttcacttaggtctttaatgttgagtagaaacaggttcttaggatatttccttgagatatatgaaaggcttttaaatttgtaaaaacctatacatatacaagataatattgtcagtattgccagtacaagtactagtattaaagtctctatcatattgtttccaacgcagtatattaggctgcttttcagtaatttttgtctaatatgaaataaacagaaatatgcaattaatatgaaactaagaaatgctgtacttgaatatccttgtctttgactagcacactaatgcaaatttagcagcacactaatttccaactagttggaggctcagtatcacaaaatcaattttgtaactttctaatgataccattccacttgtcagctcaaggtaaaaatattgcttatctactgtgtgctaattctcaggacgactgtgatactgcattgacaaacatgcacaaaaaattactatcctcaaggagttttgtgtcttgcagaggaaataaataaataagcaactataatttgggaagatggggggaagagatatactgatgcggatatgtagtgtctgctggaagaacattcaacccttacagctcagtgagtcctcaccaaagggagagtggcatctaatctgaggccaagacctcaagtacacattgaaattagctattttcagtatgtgtgaatacatatgtgtgaccatgaatgtgtgtacgtcttggggagatgaaggagtaaaggcattttgggcagagactggcgcagacaataacttagagatgagagatattgtggggcattggacattcagaaaatggcaaataagtctataaacctgcaaggacagctgagcaataagcagaagcctgataaagaattacttcttattcagtgtcccctaaaggcaatgtagtgactttgtatacattatcaaaaggacccccttctgagtggagcaggttttaaagttgatgagtaggatgcaaagagagggagaaataacagatatgacagaaggaaggaaaataacaatatgttgtccctgagaagatggggttgaggggcgttgaactgcagggcacagatggaagcatttgcccaaactagaaaaaagccaacatttccactgttacaggaaaggaaggggtaaggattgattcagatggaattaattttattgcatttattgaacaattaacatttgatattctgattctggcaaacattttccatacattattttatttaattcttgcaacagtatgcttttttcatcacattttaacattataatgatcaggatgagtctttcagtggggactaaagaactgtgctagtcctctgccaatgttgagaatagcccgttggactcttaactctacatagaaaacacctgttcacctgattgtctcaacattaattcagccatttaaccaatatttattgagcacttaatatgtgccaaccctaagttctggagataaaaaagtcaataaagaaaagttctggccctcctcttctaattaaaaaagacagaataaacacctaagcacatatatatatatgtatttatatatacatatgcatgcttaagtggtaaatatatatatatatgcttaagtggtaaatatatatatatagatgcttaagtgtttattccatttcttttaattagagaaatataaataataatatcagatacaggagctcagtgttatgaagcaaactgaagcaaattaagaagttggagtgtgatgtttgggagtgctattttgcattggctggcaagttaggcttatccaaaagagtaatggtagagtggcctgaaggaagcaagggagtaagccagcactccaggctgtgggaaaatcaagtgcaaagacatggcagccagcttgttatggctgaggaatagtaaatcaaccagtggcctgggatgaagtcaggtgaaagctgtttggaaatgacagatcaaggaagtccatgctggtcatggtaaggactttggatttctgacttgcattcatatagctacagattgatgaactttgcacttaactaaattaagactatttggctgggtgcagtggctcatgcctgtaatcccagcactttgtaggccaaggtgggcggatcacttgatgtcaggagttcaagaccagcctggccaacatggtgaaaccctgtctctactaaaaatacaaaaactagccaggtgtggtaatgcacaactgtaaccccagcctctctggagcctgaggcaggaaaattgcttgaacccgggaggtgaatgttgcagtgagccatgatcacaccactgcactctaacccaggcaatagagcaagactccatatcaaaaaaaaatatatatatatatatacacacacacacacacacacacacatatatatatacactatttacttaaaatgtcttcaaaagttcatactataattattaatacctcattgaagagctaagttattttgtatataggaagaaaattaaaacatgggtaggagacaaagatttactataagtgaaaaaatatttcttcctgggagaaaaactgcacttccatatcttattgaaaagcaacaagatattcataagaatgatattggaagctgcatattgctttagcattgaaatgtctataaaatcatggccagtcacacagcagcaatacagttaaaatgagtagatattaccaaatccctcagaagatgtcatagaactttcaaagtgacagatttgtgagacctgaagaatgattactcagttgctaaatgtccatctgtcacaagctcttagctaactttttagagatgtttaactttttgtggttgataattatattttttataaaaatgaatcaatatgccttgaaatgtcactcttgatctcaaaaatgtaaaagagatcatgaaagagcttgtcactttgaaattaggcccaactaccaaaggctaaaactgtataaagatctttagattcttaatgtagaaaagatttaatcttatagtttgagatgatgaaaagtaatgtggtaggtaggcattggtaaggcaaaatgtatgcatttttaaatcacttaagaaaatgtaaatttaaactaatagttctcattttaaaaagctcccattaaattgactcaactattgtaattaacggatttcttaaaatagaagaattgtagcagcaactattttacatatgaggaaactgaagcttatggggacaattacttaactaaggtcagatacttgctgtttcaaagcctggatttgagcctcgtcaagctaagtccaaaacttgtgatcttgcctggatgacaaatgggagaaattaaacataggccttttgaaagtaaaatgccaattgatgagttatttaagaataccagttgaagactggtttaatatttcagttaatatcatcctagagctctaattatgtattaaaccacccatccactgaaattattagaatagtattatagtattcatgcaaggaaggatttttttaaaagatacaaaagcagttacagcgaaagactgataaactatactaacatttggaacttctattcaagagtgatcaagaaagtgagaggataagtcataaattggaagaaaacatagcaacccatgtaactctcaaaggactatttcaaaataagtactcctatgaatcaatgagagaaaaatggaaaaatagtcaaaatacatgaaaaggcacgtcacagaaaaggaaaacagaatggtaattaaatagatgaaaaaattgaccaatctcattagttatcagggagatgcaaataaagaccacagtgagaggacattttatgtccactaggtcagcaaaaagtaaaaagcctgatgacaccatgtatttgaaaagatgtagatcaatgaaaactcatatactgctggtggtaaaacaatttaccattatctggtaaaggtaaacattcacatacactacaattcataattctactcctgggtacacagcacagaaaatgtcttacatgcaaacacacacacacacacacacacacacacacacacacacacacacacacacacacggagacatgcaccagactgttcatagcaggattatacactataacacaagctagaaacaaactaagtgtttagcaggaaggactattagcacaaatgttacatcaggaagccatgaacaactacagaaagcaacctggatgaatcttaaaatgccctgttgagcaaacaaagcaagtagcagaagacaacaaacagaatgtcattcttataacactcaaaaacaagaaacaaataagaaaacaagcaaacaaaacaacccctaggaagacaaaataatatattttggtgtagtgcttcttaaactaatgtgcctgtaaatcaacagcaattcttgttaaaatacttattttggttcagtaggtctggggcaatgctgaaattcagtatttctaataagctcccaggcaatgttcatgcatagatctgtggaccatacttacatagcaagattttagaggatacatacatatatgattttttaaaagtattaaaaatggaaaggttatgcaattcatgaaatttcagatggttgttacccagtgagtggtgaaggaaaatatggtaactgagagaaggaaggagcccacaggtagatacaacatattgataatattgcagttcatatattatatgctctataacctacatatgttataatgctgaatattgtataagaaaaaccataagggcaattgtaaccccacagggtagggaactcacatcatcaccagcagaagagatggaaactaagtgggataggaagaggcagtaagccatgtggagttgaatatctcatttcagaagagagagctgcaggccagtcgtcaacactgtatttgtaatctccccagattaaataactgggcagacttttaaaactgttgtagcacaaaatttggggaacctaaatagaactctgagctaaaaataactacaaacatctttaaaacaaaattcatcctcctctcaaagtttagttttaaagttttatagttaaataaagttaataccaaattaagataaaaatttttgtgaagtggtgtgtgtagctctcaaatccaaggtaaacctgttccattctttggctgcgagttgcccaatcctggcacacatatattcctaaatatctatcccccacatcctttggatatgcagaaacttttcttggagtgagaatgcaattttatttctcaaatatctgactttaaaatataatattccttatcatctaacattgtagctatcaacgaacatcacagcaggaattagtaataactaacaagaactcaggacagttgcctaaggattaggaagcggggtttgcaggcaagagaggagaattactagtttaaaatagaagatggggagtgacagagaaaaattctctatcttctcaatattatctcaggttcttcaaactgttctgatgtataaaatattgcaataaatctctggatgaggcactcgtctaatgtttagctgctctaaagggtgaaagggataagacagagcaggcaggatacctattagcttgttgtaaaggtaattgcgatttttgtgattgaaagtaatagaaaaaaaactgcaattacttttgcaccaacctaataaattgacaactactacttattgggtttactatgaaccaggcattattttagctggttttcaaaaattagtttattactatcccgattgtacagataaagaaactgaagcacacagaagatggtaactcatccaaggacacacagacagcaagggcaaagccaggattacaatgaagactgccagtttcaaagctcatacttcaggccagtgttccctgcctgcctctctgcagtgtcccaatacctagttctctgcaagcgtgtcttatgtctgtggacattgtcaatttcctcatgattgttctatttaagaagatgggtataagcaccagacagagcaaatcagaatcctcaaaaattgcatgactttttggccaagttttacagctttgctgagccttagtttcctcatctgtaaaataaactagtgacaaaatatacatgataggactttgcagaaattacataaagtaatccatttcatgcactcaagaatttgctgctgctgttattggtattagtattactaaatcctattataaatctaaacccaagtctgtctttacttaagattttgtgcaaaatactatgctttaccatgtgcattttacatatgtatagatatgtatgtatatatgtaaataaaataaacaaggcattttctttttgtttctttctttctccccgactcctctgaatcaggctattatggaaacacattgaaaggaactccaggactccaaactagaaccaggaccccaaactagaaaccttaaataaacagaagaaggggagtttctctcccactttgctggaataaagccattttaggattagccatccaagtttaaattcattagcctccaaggggtttgtgaatatttttagataattatccaagacctccaaaatgcaatttctaatgtagctatagctgtcatgaattgaaagatgaaaaagtctagctcattagatcaaatggtgtttcctcaagtgataacaaatgtgatacttttcagcgtaccacaattctcccttaagatctgaagtaaataagacttcaaagaggctcccagcattaagggaagactagtttcttaatctgtcctcaaggaatacatgttctctccaaaagagagaggataggtacctggggaacactcataaactaactcagattggagcccaattattcacttttttgtgaatgcaaaatttttaatgaataatacatttttttaaatattgggaaaagatgctgtttatttttattaaattgttaaatttccaagtaacttggtaagtaaaagaaaagaaaataagaacttcaggaaaggaaaaaatatacagaattcacaagtcacggcagactctccaacaccttagtttttaatgtgtttgcttgcttgctctgtcttcttacagagttggcacagtgatacaagattttatttattttaatcaaagtagttttgacatagtatttggaggaaggagaagaaggatatgaaccattattttcctcagcatgacactatcatttaaaataaatggaagatccatggtctaatattaccaaggctgagtagttttccccctggctcagtgcatggaaaacagcatattttcttcatgcataaataatagaaatctcatttttgaacacagtgaattgttcagaatgctttgtggagcgtggcaaatgtagatctagatttatgtgcaagtggtccctgtgcagattcaaagatgtggactaattggccaattataaaccacagattggactaattgacccagttcttctttgatgttggtcaagtaacttagaaatgatgaatctaaaccaaatcagtagtctcatcacagttaaatattattcattcttaaaagtatgtcatttatcatggttattaagagaatgggcattacagccagaacgccctgagtttccgtttcagctccaagactttctagatgtgtaaccacagatgggttacattaacctctctgtcagttttttcatcgatgaaaataacagaatcaactttgcaatgttactgtaaagattatatgagataatagatgtaaaatgctcagcacaatatctgttacataaataatgcatgtatacctaagtatacacgcatatatacattattatattccatatatgatgttatacatataatttaggaaattaggggagtaaaaaaccaagaactcccacagtaccatgacaggggtagtgcttttgaaaattatgaactgtgttgaactagtaatagggctttgcctttaagccggcaatgaatattttagtgagataaagagcttctgtattttaaaactgaaactagttctgccttcttctctcctttgtttctacttttatttctattccatatgtgtttcctggcaatggagaagggagaaaacagatgtttactggagggcctactatgtcagatgctgctgcagtgggcacttcacttatgcgatggcatttgatagccatggcctttttatgaagaaggtattgttattcctaatttacagatgaggaaaatgtgtcctcatctcataattagaaaacactggaactcaatttttagccactatttaggtacctccaaagcgttttacatttctttagttaaagaatttgccagatacagtgtgggtcaggttcctatctatttttaatcgagaacctatttctctaggaaactatgctagagaaagtagttagcttcctaagccagaaaaagtagttagccttctaagctagccttttcattcacaatagaaatagcacatactgcaatgaaacagggtcaggcaaactgtggctattagacaaattcagctcgctatctgtttttgtaaataaagttttattggaacatagccaaacccatgtaattacatgagtaaatgtcaatgattgctctcatacttcagtggcagagttgagtatgacagagactgtatatctcacaaagtctaaaatatttactaaacgaatctttataaaaacagtttgctgaccactaatgaataagaaaatattagaataaaaaagctcaatatcactgatcattagagaaatgcaaatcaaaatcacaatgagataccatcttattccagtcagaatggaggagaaaagggaccatttatacactgttgatgggagtgtaaattagttcaaccattgtaggaagcagtgtgatggtttctcaaagagctaaaaacagaactaccattcaacctagcaaacccacaactgggtatatacccaaaggaatataaattgttctaccataaaaacacatgcacgtgaatgttccttgcagcactgttcacaatagcaaagagatggaattaacctaaatgcctgtcaatgacagatttggtaaagaaaatgtggtacatatactccacagaatactacacagccataaaaagaatgagataatgtcactggcgggaacacggatggagttggaggacattatccttagcaaactaacgcaggaacagaaaaccgaatactggtcccttttctcctaaatcttgccagcagctgttatttttttgactttttaatcacagccattctgactggagtaagatggtatctcattgtggttttgatttgcatttctctaatgatcagtgacattgagcttttttattctaatattttcttattcattagtggtcggcaaactgtttttataaagatccatttagtaaatgttctcatttataagtgggagctaaattaagagaactcgtggacacaaagaaagaaacaatagacactagggtctatctacttgatggtggaagatgggaggagggggaggaaaagaaaaaataattatcgggtactaggcgtagtacctgggtgatgaaataaaataacctgttacaacaaacctccatcacactagcttacctatataacaaacctgcacatgtacccctgaacctaaaataaaagttaaaaaagagaaaatactatgtggcaagttctatcacgaacaaatcatcatttataaataacattctctctgcgtttaaatactccttgtcatctttgagcgaaaaatgagtattaatgtagcaaaagatgatttcagcagcctccatcagccctagagtggaccaaggagatgagagctggtctgaattcaaggacctagttctgactgaggaagtttactccaaagcaagagctattctctttacagctcccaaacatgcccaccacaaattgctgtttgttctcagccttcttttgcttgtcctcttagctgaaacttcccccaagtcctcattcttttgtcactatttgacctccctcttccctttcagaaggtgaaagcattccctctcaaaccaaacatccctttaaaacataaaggaatattacagttatttgcactgaactgaacctgacctatacataacgttttaactcttcaatttgcctgaatttctttgcctattttcttctgttgatgaaattaaagacttggtaatttcagcaattttaggcaatattcatgtttaaaaagaaacatttccagttcctaatttgaggcattatgcctcaaatgaactatgaaggcaatctacacaagtactcagatgtcattaatgaaaaaggcaaacaatttgttcacatgtctaaatgaagatattaaataaactcaaacttttttttaaaaaacaagatggaattacttttggaaaagttgcttgcttttgattattggttacggcttccgaaaacaagtggaagcagcatccactgtacccaaatttgcatcaacctgagactgaaataattcctctgacaattattataatttctactgaaaacttttccttataccttttgtctcccattcttgatgacttagtgatgcaagctagaacctagccataataacctcctcaagatgttcgcatatgtttgttctggaagctattcaaaataaggtccatgattgtatattttattcactatggactataattcccatagctatagtgccttaactaagaattggggttcatagtctgatggaactatgaaaatactctaatatattccctagagttggtctctcagctaaatgtggaagatttagataattgagaattctacatctactttcaaaaggtaatgattaaagaaatccagaaatcttgactaagaattaattaaatccatgatggggaaaactaattattagaatacacttggaaataacacaaagtggtagcttaattttttatgaatttctttcctatttacagatattcccatacccatcatttgatcttatattttcaacttggtttacatttgtacattatttttatttgcactggctttttaaagtaagttaagtgacttgcaaatccagttacattaacaaaaatatcaaatatgataaatacattaatatcatttaaaactatttcttccctttgatttcttatacccaaacatttctaggtcttatcaattcttccttcactatatctctaccaaccatcactttcttttcatccctgcttccaaaattataatacaaaccttcaccatttcactcctagattattgtgacagccttctaatttagtattattcaaaatgtggcctgaagaccacttatttagaatctaacccttaacagggagattatgcgtcctctccagacttgctgaaccagaatctctggagtaaggttcaggaatcggcaattttaacaagctccttaggtggattttttttttcttttgagacaaaggggtcttgctctgttacccaggctggagtgccctggcgcaatcatggctcactgcagcttcaatgttgtggcctcaatcgatcctcccacttcagcatcccgagcagcgggattacaggcacacaccaccacttttgtatttttttgtagacatggagttttaccatgttgctcagccttgtctcaaacacctggactcaagcaatccacccacctcggcctcccaaagtgctgggattacgggtgtgacccactgcacctggcccttaggtggcacattaaagtcaagaaccactgttctgctttcttcctttctcgttctccctattttcaagaaattgtgcatatttctatctggttagtcattccaacatgctatccttgtcccctgtagaaaaccttcaatggttccccattattctcaggataaaatcccaatgtctaaacttgaaaataaaggacccacataaaatggtcagaaactacttctgaaatttcctaaagatgacaaacgaattcctagtttcatgcattttgaatgccccatatataccccccaccatcgtacttctctgcaacgtggaaaaacctctacttattcacttccaactcgttcaactccaaacacaaggcaatgtcaaatttttccatgctgccttcctcgatctttcctttttgggagctcatctactttattgttgctattattcatatggcagtttatcctagactgcctgtgccgcctcttgaattgtcatttaatttttaatgtgagtatgcctgtctcatttttgcacctgattgtgaagttcctgagtgtaagaacattttttgtattcaactattctcctagcatacctatagacaatgaataaataattttgaaatgattaaatcaatacaagattgacaaagtctctactgatttaacccattatttagttgatatggttcattgtttctgaattgcacatcgtctactttaacaaaaacagattttcttattttatgagcttacacctctctcatgttcacataccaaagagctataactacatccatgactacaaaattgatcccaaaccagacaaaatgcaagaaacagaagcatcagctactctggtctaaatgttgtatgaaaatcttgttggctgattcaagtgggagaaaagcttgaagttataagcatcattttgactgttttatacccagttgcacaatcaaaaagtgcctcatttatcagtccctgctctcaacacaacaaacagatgcttgtaatttgaattgtatgactctggtatcaccaccagacactagatccttgaaagcactttaacccttgatagttaaaataggatatttatctccctgcccccaaagaactccatgtcttaaatgtaaagtcagaatttacaatgcagtagaatccttggggtagggttaggatccacaaaacagactcccaggaactagacagtgaactaactgaaggattatcataggagtaaaactgtctttgtaaaagttataacagtgaaaaaattatgacagagaaagagatatgacctaacagattccatcttgcttttaacctccaagctgtccttattcattcctgggcataggccaaactaactttgggaagaatttagtttatagtttaactttgaaacaaagatgataatagccctttcccaaaacaaactcttttcttgcctggggaccagactggctgttgtaggactaacaaatttgccacaagattagaaattgcgatttaggaatcatgcatctagaggtcacaagattctaaaaatccccagttgctcctagggataacatcactattgtaaaacctaagattggtgcttgagatattttttggaccctgaactcgaaggatcagctggcaccacccagattgataaactggctcatctggtcttgtgtccctcacccaggaaccaactcagctcaagtggacagcttcaactccctatgatttcatctcccaccgaaccaatcagcactccctggcatcctatctaccaaattatccttaaaaaaccccagtctctgaattttcagagagactgatttgagtaataataagactctggtctcctgttcagcaggctctgcgtgaattaaactttttctattgcaattcgtttgttttgataaattggctctgtctgggcaggaggcaaaatgaacccactgggcagttacaggagcatcggttgacttaaagattggcttatccacctaccagaatctaatgtctgccatattaaacactttaaagcaattagagctgtcttactgagaacactttggacaataactgataaactatgtaactgaatgatcttttgatgaggtctaatttatactataattcattttttagatgtttaaagtaatgtattatggtaatgtataatgcacttagtttctatgaccaaaacataggaataatttctctgtttaaatggataatttattttttgtataaattataatgattttaaagccctataagactcacagttttgttattattatttaaattttcatagaatattctttttccaaacaataaagtacaaagggaggaggctttaaactaatagaaatttatgttcaaatcccaactctgcagctggcagtgtgagtctgaatgataattcctacatcaaaggactgtggtaaggatataataacacgtgaatgttgccgtctagttatttgtttgttatctgctccttccattagaaaccaatcccaatgacagaagagcctgatatatagtaggtgctcagaaatcatttgttgaatgaatatgatcagcttatttttctgataagaaaagatttaagctaatttttctatattttaatgtaactcaccttaaatacttgaggaaaatatttcccgggaaggaaaatgtcaagaggaagcagaaagcattcttgtctttcttctttcagatgcaggaaagtaagactgcacttggtgatgagatatgcatattatcaacaaattaattgtattgacaggtttatcaaagagtagtctggcaatgtcaaaaacaactgggcatataactctgaagacttacgacaattagatcagttaattttgtgtttttttaaatggcccatgatgtggctggtggaaagtctgtatttgttgggttgtacattcttaggccccctcatggtttttagtcactaatacaaatatgaaaagtaacaaggattacatcatgcatttattaaatacataattattgagcaccaactaattgccaggaaatgttccactcattggggatactgtggtgaacaaaacaatcaaggctgctaccctctgtatttaatgtaccatgatgaacaataacacataataaatctaaaaacaaacacttcagaaaggaaatagtgaggcatgttattctgaaaaataaaataagagatatgctagtaggtgactgaaggctgctttagattgggtgccagagaagacctccctgacaagtgttcttcaagctgagaactgaatgacatggaggaaccagaaatacaaacattggggaaaacatcatggaaggagcaataggctagtgtggcagccttgagaagtggctggcccagtttgaatgaccagatggtaagccattacagggaaaagaaaactaagccagcaattttccaagggcatgaggaatatttcattttttcttatttttatatggaaggtattggacaagataattgccaatgattattatatactaaaaaaattcagaaatctgtggtcaagatggttccttaatcccaacttaactatgaaacattgactctttcaagtcctttagtagaaaattcccaaagcttggggagttgcacttctggctgaatggggttgtaggtgtggcagttgttacaatgttctgtttagaaaagctaacagtaacacctttcatatatgtgagagctagacaaacatgtctaaattacacattcataagacttccattggagagagaaaaaggaagatatacaaaatttaatacatataaattaaagcttattttctttcactgtggtccaaaactttaattagaagagctttggtggaaataagtcaggtaattaatttttatgggattaaagatactaaatagtcatggtatagtaaatatagtatatttgtatttgtctacctcaggcataatatgtatatttctacttagaaattctgagttagaattgacatattaacttccacttaatgcaaatcaactgtgaaaatagcttatatatgctttaaatatttaatattttaaaatagtataaaatgtaatgaaataaacatgaaatatcaatgctagaatcaagaacaacagccttgaaggatgatcagagtaaaatcagggtttttttggcatgaaattgtagtttttaattgtagttttaatataatttgtgcactgctgtatccaatactgaaaaccatataataataaaaaccatcaaatcatatctctatttcaccttcttaaatatggtttaagaatagtctgggccaccttgagtagaatatgtacatttctctacagaaattctaagttgaaattgacatattgactcccacttgtgcaaacagctgttaaatgatatatttcatataacttatttatttaatacatatgaataactactacatgtcctaggtgctagactatggcacaaatattacaaaatccctgtcatccttaaagtagacaatagacaacaaattaatatacatattttatcaggtgataataagttctgtggagaaaaacaaagatggggggtggttaaggagcctgggaaaggtaaggagcctgggagagggaggtatgcaattttacaagatgtggtcaggaaagtcctctctgttgaggtgatttttgagcagagacctgagggaagctaggtaaatgcattacaggcagacaggattgtcaggacaaagtctgtggggcagggcaagacaactaggaggcctgtgtggctggagcaagttgagggagagatcagaaaagacaaagccaggaagatgtatgtgtgtgtgtgtgtgtgtgtgtgtgtgcatgtgcgtgtgtgtgtgtgtgtgtgtgtttgggggaagaggttttaactttgattcagaatgagatggaagcctttgacaggttttgagaagtgtgacatggtctgagttttattttaagaagatcatactctggctgccatgttgaaaacagacggtagaatggcaagtgtggagatacatatagcagattggaagctatttcaacaattaagaaagataactggcttggcccggcgtggaagaagtaggtaggagaaggggaagtatagttaaggcttggttataatttactgataggggtgtgtgtgtgtgtgtgtgtgtgtgtgtgtgtgtgtgtgtgtgtgtatgtgtgtaaaaggaaagaaaggaaaagaaattgaagatgtttggtcttagcaacccaaattatagtgcttctattgagtgaagtggggtttctggggaaggagcaggtttgaaggttgtaaatccagagtttgttttaagacagattaagttggagagaatctattaaagcttcaagtggagtacaaaaacatagtgtacttgtgtttgtctaccttgagtataatttgtacatttctctatagagattctgagttagagtggacatattaactctcttttgtggctgaagctggagaaatagatttgtgaattgtcagtcaatggatgaccagctagggcagaatggaacagtctgaggattgaattggacaaattagaaggaatcagaaaaggacactgaagaaaggtgagtccataggaagaagaatagaaatggtcccagaaaccaaggaaagagatggtgcaatcacaattaagagtactctaaagtttatattaataactgacattagttatttaagaggactcaacaacttgttgtggctacatattggagaacactgggaataagctttgtggcagctgtcagcttcagcagaccttggaaaggaaaatggtttgccttagttttacagtttgttttgagaaagaaaaccattcatttgtatcctttctaagttgcaatataaataactgtcattgttcttgtattcttcacaataatgtccattaaacatatatgtatcacatattttacctcactagggactaaggcattgcattatgtcaggattgtattacttttccctctcatattcgtgtcttactcttaataggaagtatgagtaaatcaggtatttttctaaaggtaattttcatttatttagaacacatttctttttggtgacataaattatcaggaacatcatcactccggaaaaaatacagtgggggttctcttgtacataatcctttgaaaataacattgaactaaacatgaaacatacatttatttctctgaaataatttctcttgaatatttctacaaaagtaatttttccccacatctgttattgtctttaatctcctagtccccagaactatctataaccaagttagttccattatttaatctctactcatcacaccacacaaaccccaaaatacgggtagtcagtcacaaaatataatctatgagaatgctttttttcctgaacttttatataatatttgaaggagaaaaggacaatggtggccctcccctgcaagctgtgcttcgcagcctgcctaatacaccaagacctaaggtaagtggaaaataatctatgcaacaagctcacatgtcatcaggaaatactaattagcattttctataacaacaaaacaaaggtgtgtgtatatacaaccgtattacaagaatgagctactctgcccttgacatattttaaccagtagctttattaatgtgagaaaagttttgaatttgctgccaagttcatgcaaaacaaaaaaaagtcccagacatacagtgaacaataagacatataataactctggtcaaaacatgtgccaactgcacttattaaaaggtaaactgtagggaaataagagtgttcccagggtaaaatcgatgcatttaataactagagtctgacaagccaatgcaatgtacatataatttggttttaaaacctacttaaaacaccatttaatcacattgttgtttcaccattaattgttaacactgatatgtttgaaatattttttaagagatggttctagatattggcaacatttagtaaatacttttaagagtcacagcatacattgggaatatagtattttttgcaaatctataaaactacatagattccttttttttttctttttgagacagagtctcactctaccatccaggctggagtgcaatggtgcaatctcacctcactgcaacctccacctcctgggttcaagcaattttcctgcctcagcctcccaagtagctgggaccacaggggtgcaccaccatgcccggctaatttttttttttttttttttttttttttttagtagagagggggtttcatcattttggccaggctggtcttgaactattggtctcaagtgatccatctgcctcgggctcccaaagtgctgggattacaggtgtgagccaccatgcccggccatccttcttgaagaagtctttcattacacggctggaggtcaaaggaggaagagaaaaactaatgtatagattgaattctactttgacatctacgactggctagcaaatttatgtagagcatgatactaatgaaaacaaagtcacaggcttgattctgatctgtgtcattaacctcattctgtttcatgtttccaagctgaactctaaccatcagcttgtgactcatggcttagctggtctcaatggggaacaaaccagagagtctatggatcaacacaaagctataactgcttcatgaaaagaactttgcagggcactgatcaccctctctgacaaatgaaggcaacttattacttaagagctacaagaggtagtgaaaggccagtaaactgtgatacagaagacctggactccaatcccaattttaggatccctaaatttataacctataatatatcaattaaactctctgacttttaatgtccttattcattatttcatattaatactcttctaacatagccctgaatatttagggcttcaaataatatgtgacttggttgctcttgtgttgtaagcttttagtacatacttgacacttgcttaataaaatatttgctgaacaaattgttaaaatgaatttgaaagactgaagcacattatttcaatgcaacttatttaatctaaaagaccatttgtaaacatttaatataacctaatattcttgtcaatatctttatagattttgttatataaaaatagattgtttattaaaataatatagaataaaatgttacgattgcatctctttttacaaactgctataaacatttaatgtaattaaaattagcttatatagaaaatccaaacacataatcagtttaaattcaatcagttgctaaaactagtgacctatagttttatactatacacaatcaattacacaaaaaagagaaaatttgtgggataaatttggagaaaaatagtattatatttaataatgataaaaatatataaccatcatttgaaataaaattattttctgttatggtttgaaagataaataacattaaaaaaataagctttatactcaagtcagttactggcacacttggactctgctttaaaaaagtgtatgtgtatatgtgtgtgtattttttttttaaagaggcacctgtttgtgcaatagttaaatgtcattcaaacaattatttaatgttgactacctgattatctggaaacctttcaaatgataccaaagcctgaaatagattttctttttgggatgtggcagacagatatcagggtaaccctcatgattctttcctcctggtattcacaactgtttatattttcctcatcttgaatatgggcaggaactttaagttgcttctaacaaataagatgtggcaaaagtgatgccctgtcactcttatgcttatgctatataaaatccagtcatactagcaaactcactctcttcctctcttgctggatttgaagaagcaggctgcttgttgtaaagggtctatggcgagggcaaggtagtagcgaactgaggatggcttctaagagctaatgtaacctctgatacgtaacctctgatataagtaacagccaccaagaagttgcgaccgtcagtcttgcggctgcaaggaaattaattctctcattatcatgagtgacctcaggagttgatccatcaccagtggtgcctccagatgaaaactgaaccctagtgaccttagattgcagccttgcagaggaccagctaggccatgcctagactcctgacccttggaaactgtgagatagtaagtgtgtgttgttttaacccagtaaatttttgaatagttgaaatattcaaggaagcaaaattattctgacaagaatattgcagactcaaaaatatatacatgtatacatagagatatgtaagtacaaacaaactggctttttgtggggagaacagatgaatttagttaaaacaaaaccttttttaaaaaaacaggttgattcaaattaaaaagtattgttctcgaattgataacagttggatagactcagcaaaatactccccaagcaggttggtaacgtcaagtctccttagtttatatccatgaaatagctaattgccaatgccagtctaagagttttagcctggatttaagatgtgtgcttaaagtaaggctatagaaatattctcagctcaagaatattattcagttttcaccttcctttctccaactacagtcattcttaggcaccaattaaaatgtgtaccatacaatctgcatggactttctaggaggtttattctttcattagatatgaaagaattccaggccctcattatcaaaaagtgggattaactgtatctgtactttatgcataaatggtcatccctatgtaggtaactactacccattctcaaattgaggtcagattcacatcctctaaaagccatatctgacattgttccatctaatctgatttagacactttttatcagtgcttgaagagcactccatgcaaaccactgaacctggtaatcatgcaccatctgttccttttcttccttcttgtgggaaagaccctccctatttttcttcggccctcaggtcagtgcctgccacaaagtagacactgaataaacatttgggaacttttatttttcaaattggttttacatgtatatgcgcatatattttaacctctcaaatgtccaaggaataatgtggcaaagattaatttggtctgttgagagaaagacagagcagatgctttgttataataacatagccctattattaaatgaggcatattatatatctatttcttctatgtacatggtaaattttaattaatattctctgataacaaaagatataagtatgaaatcttgaattgagattatgtaaaataaaatttattgtttaaatattttaaaatacactaaaaccataagtaaaatttagacaaaaccctaatgttgtgctagcaataacaatatatgctggggcattgatgaggctcatgaagaggcatatcttttttgtcttgtttctgatccagatgtaaccctgtcagctttaatgtcctatcccagttcacaactcacataactctgtatggctgcagataagaataccgaaattattaagctaattataaataacttataattcttatctctgccatttccaagcccattctccaaagtaaaataactgtatttctattacaaacactatttttgttctaatatattattctacaatcctgtggaaatgctgatgtgttgaatgtacaattctcctttaatgtaaattggctttgtggtattttatatttgcagctaaaaatatattggaaaaccttcttcagctgaaacagggagtattttttcgtctacctggctttgaactagcagtatgtaacatacagagttagttggaagatagtccttattatgaaatagtggttaggggaacagaccctggagccacattatccaggcttgaatcctggtcgtgtgacttttggtaagccacttaacttctctgaacttcagtttcttcatctggaaaggataataactttgtagggacacggatgaaactggaaaccatcattctgagcaaagtatagcaaggacagaaaaccaaacactgcatgttctcactcataggtgggaactgaacaatgagaacacttggacacaggaaggggaacatcacacactggggcctgtcatgtggtggggggaggggggagggggagggaaagcattaggagatatacctaatgtaaatgacgagttaatgggtgcagtaaaccaacatggcaatgtatacctatgtaacaaacctgcacgttgtgcacatgtaccctagaacttaaagtatattaaaaaaagtgtctacctcatagtgttggtgtgaacattaagtacggtaatgggtgtataatgctaagaatagtacctgccacataaaacatccttactaaatgttaactacttaattacctgtctcatacataagctctatgatgtcaatatttcaaagtgggcaggatattaagtgtaataattaaaaattattattattagggttgctaaaatataacatgtctaatgttcaaaataatttaggcaaaaaattaatgttttttgcaaactttttttaaaacacgaaaacagcataatggccattcatataatatgaacattattaagtagtgttaattctcattaaatataataaggcctaacatttgaaatcaaaagttgaggttattgagaatttcaacaaaagaaatgggatagatatgagtactacagtgccagatacgcaatattgatttatagaaaaaaaacatggactattaaatatatcactgatttttgttgtaaccatatcattgatttttgttgtttgaaatgtgatgttgatgatagtctcttgggtagattaattgctggttgctggttaaatactgtactcagacagtattgattaatagcttgagattaacctggaaacatgattcaaaggacatccagaattctaattttgcattttaaccaacaacctgggtgaagataaggaagtctggtttatcaattttgtgggtaacagggcaacatgttacagaataaaaattattttggaaaggcagagcaagatgaccaaatagaagcctccaccaatcatcctccttgtaggaatacaaaatttaacaatgatccacacaaaaaggtaccatctaagaaccaaaaatcaggtgagcaatctctgtacctggtttaagctatatatcagtgaaaaaggcactgaagagggtaggaaagaaagtcttgaatggccgatgccacccctcccccatgcgtcagcagtggccacgtggcacagagagtgaatctttgtgctcgggggagggagagtgcagcgactgggggactttgctttggaactcagtgctgccctgtcacagtggaaagcaacactgggcagaactcagctagcgccagtggagggagaatatagaccagccctagccagagtgaaattgcccattccagcagtcagaatctgaaatccagcaagcctcactgccataagttaaagtgttctggggtactaaataaacttgaacgacagtctaagccacaaagactgaaattcctgggcaagtactgatgctgggatgggtttagaattagtgtttatgggggacatgtgacctagtgagacactagcaggggcagccaaaggagtgcttgtgccaccccacccccaaccctaggcagagcagcttgcagctgcaggtgagactccttccctccacctaaggagaggagagggaagagtagaggcctttgtcttgcaatttggataccagcttatccatggtaggatagggcaaaaggcagagtcatgagcccaccattacaggccttacctcctggatgacatttttagaaataccctggaccaaaagggaacctgctgccttgaagggaaggaagcagtcctggcagcattcatcatctgctgactaaagagcccttggcccctgaataatcagcagcaatagccaggtggtactcactgtgggcctggggtgagactgagaaatgctggcttcaggtgtgacccagaacattcccagctgtagtagttatgggaaaagactgcttctgcttgagaaaaggagaaagaagggtaaagaggactttgtcttttagcttaggctccagctcagccacagtagggtagagtaccaagcaggcccttgggatctcccattccaggccctggctctcggacagcagttatgaacctgccctcagcaaaagggtagcccactgctctgaagggagaatctcaggcctggtttcacttaccacaagctgactgaagagctactggatcttgagtaaacactggcagtagccaggcagcacttgccataggtctagggtggtggtagcctcagggaaagtctcctctgcttttagaaaagggagggaagaacggggaggtctttgtcttatagctttggtgccaggtcagtcacgtaaaatagaacaccaggtagcttcttaagatttctcacttcaggtcctggctcccatatggcatctctggattctcctagggcaaaggggaacttgatgtcctgaagggacagatacaagccttgttggctatgctacctgctgattgtagagccttaggaccttgagcaaacatatgcagtagccaggtactggtcattgcaggccttgagagagatccaatgctgtgttggcttcaggtctgacccagcgccatcccagtggtggtggccacaagggtgctagtgtcacccctccccaagctccaggtagctcaagacagagagagagacagaccccatttgtttggtagaaagtaaaagaagaggacaagaatctctgcctagtaatccagagaattcttctggatcttattcaagaacaccaagcggggacacctccatgggtcagcaagagccatggcattactggtcttggggtgccccctaatgcagacatagctgcagtgaacaaaaacttagatcacaatatccaagtctctttgaaaacctggaaaaccatcccaagaaaggcaggtacaaacaagcccaggctgcaaagactacactaaatacttaactcttcaacgcccagacactgatgaacacgcacaagcatcaagaccaccaaggaaaacgtgatctcaccaaacaaattaaataaggctccagtgaccaatcctggaaagacagagatgtgtcctctcaaacagaaaattcaaaatagctgttttgagaaaactcagtgaaactcaagataatacagagaaagaagtcagaatgctatcagataaatttaacaaatagattgaaataaaaagaatcaggcagaaattctgtagttgaaaagtgtaatttacatgcatcagagtctcttaatggcagaattatcaaggagaaaacagaattagtgagcttaaagacaggttatttgaaagtacacagtcagaagagacaaaagaaagaaaaacaaacaaacaaaaatgaaacacaagctcaagatctagaaaatagcctctgaagggcaaatctaagagttattggccctaaagagaaggtggagagagacatagggataaaaagtgtattcaaagggataataacagagaacttcccaaagctagggaattatatcaatattcaagtacaagaaggttatagaacaccaagcagatttaacccaaagaagactacctcaaggcatttaataatcaaactcccaaaggtcaaagataaagaaaggactctaaaagcaacaggagaaaataaacaaataatatatagtggcgctccaaaatgtctgacagcagagagtggtatgacatacacaaagtgtggaaaaaaaaaaaaaaaagatctcacctcttattctagaatagtatatccagcaaaaatatccttcatgcatggagatataaagactttctgagacaagcaaaagttgatatgtcatcaacaacagacctgtcctataagaaatgctaaagggatttcttaagaaaaggacattaatgagcaataagaatcaattaaaaatacaaaactcactgatgatagtaaatatgcagagaaacgcaggatagtataacattataattgcgatgtttaaactactaatatcttgagtagaaagactaaaagacaaaccaatcaaaaataataactacagccaggcatagtggctcatgtctctaatcccagcactttgggaggctgaagcgggcagatcacgaggtcaggagattgagaccatcctggctaacatggtgaaaccccgtctctactaaaaatacaaaaaattagctgggtgtggtggtgggcgcctgtagtcccagctactcaggaggctgaggcaggagaatggcgtgaacccaggaggcagagcttgcagtgagccaagatcacgccactgcactccagcctgggcaacagagcgagactgcatctcaaaaaaaaaagaaacaatgaaagttaaaaagtagaaagtaggaggacaaagtaaaagtgtaaaattattacttttctctttccttgtctgtttgtttatgcaatcagttttaatttgtcgtcagcttaaaataatcagttatgatatgatatttctaaaccttgtagtaacctcaaatcaaaaaacatacaactgatacacaaaaaataaaattcaagaaattaaaaacatactagcagagaaaatcacctttactaaaatgaagacaggaaggaaggaaagaagaaagaagaaaacaaagcaaccagaaaacaacaaaatggcagagtaagttctttcttaccaatgctaatattgaatatcaatggactaaactccccagtaaatacacagagtagttgaatggataaaacaacaggacccaacaatctgttgcctacaagaaatgcacttcgctgataaagacacacatgtactgaaaataaagggatagataaatatattccacgtaaatggaaaccaaaaaagaacaggaatagttacagttatatcagacaaaataaatttcaggacaaaaactataaaaagagactacatggtcactatataaggataaaagggtcaattcagcaagaagatataagaattgtaaatatatatgcactcaacactagagcatccacatatataaagcaaatattattagagctagagagagaggtagaccccaatacaataatagctggagagttcaacactccactttcagcattggacacatcatttagacaggagttcaacaaagaaacatcggacttgatcagcatgatagaccaaatggaactaatagatatttacagaagatttcatcaatggctgcagaatacatatttttttcctcagcacatgaatcagtcttaaggatagaccacatgttaggccacaaaataagtcttaaaacattaaaaaaaattgaaataatagaaagtatcttctctgaccacaatagaacaaaactagaaatcaataagaggaattttggaaactaaacaaacacatagaaattaaacaatatgctcctgaatgagcagtgagtcaatgaggaaattaaggaaattgaaacatttcttgaaacaaatggttatggaaacagaaacataccaaaacctaacgggtacagttgcaagcagtaataagagggcagtttataccctatatcaaaaaaagaagaaaaacttcaaaaacaaaaaaccctaatgatgcacctgaaagaactagaaaagcaagatcaaaccaaaccaaaaacgagcagaagaaaaggaatgatcaagatcagtgcagaagtaaatgaaattgaaatgaagaaaacaatacaaaggatcagtgaaataaaaagttgattttttgaaaagataaacaaaattgacaaacctttagccagactctgacaggatttttctaacatagcatcttaataagaagacacaaataaataaaatcagagatgaagaagggtacattacaactgatactgctgaaattagaagtatcattagaggctactataagcaactacatggcagtaaattggaaaagctagaagaaatgaataaattcctagacacatacaacctaccaagattgaaccatgaagtccaaaatccaaatagaccaatagtaagtaatgagatcaaagtaataataaacagtctcccagcaaagaaaagcccaggatctgatggcctcactgctgcattttaccaaacatttaaagaagtaataccaattttcccaatttattctgaaaaatagaagaggagagaatacttccaaacacattctatgaggtatgggagcatggaaaaaggagagtttgtcttcagcttacatagaccaaaacacatgaactaaaggaagagtggaatttagcttgtttatgatgcttctgcatttgagtgtttgagctgcagtttctcttgactaatagtattctctccatgctcttctttactccatgacacacttttacctcaacttctaacatttcctctattttctttctctcttttgtttcttaagacatctttcaagacccagttcactttttctctcaaatgcaaagcttgggcctcctttaattttcctcctctctcctcccagacctaggaggttaaattaatatagtgtgaatgtgacgaataacatcctgcattcttgtactagaataaaaactggtaaccagacaaagcacactgcagcatagtttgaaaatacccatgtggatatatttgcatatactgaaagaacatatactaaattctcatactttaagaagacacatgtgaataagaacatcaacaaagtgtactgttcatctccattaacaagaaatcttggaacttggtatttttttccttcacagacagcttgacttggtttgattcaagtgctgctttctgaattcagtgcaggtgctaattagtacgaaggcacataaatctagagaggaaggtaaatgggaaacatatggaaacagaaatgtaaccaaaagttctttttgatgatatacatggttcaacaagttttaaaacaaaactgcaagctgatggatggtaatattctacatcacttatactgaaacaaagctgccaatgtgattgtctagttgttcactacttgaatatttataaagtttacagttcacatgtggcatttccataagctgccttgattaatgaatttaattgtaaatgttatgagctgatttcttaaactgtatttcattttgtttatatgcttggtgtaaaagtaaattttcagactgaataatacccagcagatttgaatcagggacaaagctctcaagctgcgtggtgtgagcagtgcatagtgaatgtggctgcacagcaagtattgtgtttggccaaagtaaatatggggctcagtgccagatttcctgagccagtctaggccccgagttcacccaaaaattcattcaggggacttcttaaacaatcaccaaggccagacattaaaatgaaagacatttgaaactctcctccaaggacagttctttgggcacacagaatctgatggagagggagtttcaacaagttttgagcttttaaacagtagaaaaggataaaggaagaaagtaataggggaggctgaggtgggcagatgacctgaggtcaggagtttgagaccagcctggccaacatcctgagacaccgtctctaccgaaaatacaaaaattagccaggtgtggtggtgcgcgcctataatcccagctagtcggggggctgagacaggagaatcacttgaacccaggcggtggaggtcgcagtgagccgagattgtgcctctgcactccagcctgggcaacacagtgagactccatctcaaaaaaaagaaaaagaaaaagaaaataatggaagtaacttactggtcaccttccccagccccctgggtatctattttgtcttgcaaaaagatgaaatagaacaaatatggtattgattctgggccactaatctcctgtcctactcctgggactacctgttattactctctctgtatatatctctctttatattttcttataactgttgacagccccaaagttccagaccttaaaatgctccatttctatatattagaaatttctatatattagaaatttctatatattctatatacatatatattctatatatccatttctatatattagatcatatatatatccctactcatttctgcaattatcatccccaaatcagagcaaagtccattaatttaatggacattaacattttttgctgtagtaaaaagggcttaaataaggattcttttctgagtcataaaaaattagatgtacttaaagattttcaatatatgtgtgtgtgtgttatgtgtgtgtgtgtctctctctatatataattttgacttaatctgcaaatgcagcagttttgcatgtacacaggtgaagatgaatttccttttataacttttactacatgtcatccatactagtttagcttagtataagcaagaaaagtataatattgtagacatttacacaattcacttcattctccctgtccttaggtaatttatgatatcagctttagcaatctctgaggaacccaatctacacccttttcaattttaaaaaatactcacttattcccacttttttaaaaaaaccaatttctctgcctctcaaaacataggtgttcacacctatttcattttgattcaactttaaaaagtagcctttggtacaaaacttttgagttatttaaggatgtggtatctacagtctttttttttttaattcaaaattggtttgctctttatcccaaagaatccaaaaagctaaacatcatgttctctttggatgttattttctataatatgttaagtgtctgaaaatgtgaaaaatttaagcaagcacacaggcacttggttaataaagtgggaatgtgttcatctgtgaaatacttcttatacatacttatttccatcatatttggagaggatttttctaacacagcatcttaatggattattagtagacctgactctaggcttagttactgcctaagacaagcccaccttacaaaagaggcttgggcacctcttcccagggaaaatgcttcctttcaaagttaatgaacaaggaagctctagctgtctctggaaaccataatgtaagtttgagcagtgcaatcacgtagtcttgaaaaaatgttagcttcatgcaaatataatcttcatgcctagagcatctctgaccaaagtatagtgagccctagtctcaaggtacctgttagtggattaaaaatcggccccatcgcctgtagtcccagctactcgggaggctgaggcaggagaatggcgtgaacccgggaggcggagcttgcagtgagccgagatcgtgccactgcacttccagtctgggcaacagagcgagactccgtctccaaaaaaaaaaaaaaaaaaaaaaaccggccccataacatatatgtccatctggaacctgtaaatgtgaacttatttggaaaaaggatctttgcagatgtaattcaattaaggatctcaaggtgaaatcatcctggattagggtggagtttaaatccaatgataagtgcccttagaagagaacagaagaagtgaagagaatcagagagagaaaaagaccatgtactgatggagatctctacttccatcaactcagattggagttatgatgccacaagttaaggaatgcctggaatcaacagaagcaaggagagaggcaaggaaaggactctttcctaaagtctccagaaccaacaagtcctgctaacaccttgattttaggcttctgacctccagagctgtgagagaataaatttctgttgttttaaaccacccagcttacagtcatttgttaaagaatccttaggaaactaatatagaatcaatcttaaatgagggctcagctcttccagtggtgtctgtgctaagaaaggggaagaaaaccaggcagagtaggggccccattgctcaaggagagaaacttattcccactgtctttttaaagagaagcaggaattttttatttagagtcattgaaagaaatgattgtttgaaacaataatacgcagaggtatgactattgccagaaatgattgtttcaaacaataatatgcagtggtatgagtaaacaaactttcatcttgtatattaaagtactggtaattttaggcttcaagctagaaaaaaatattcaggattacagtgattgtaataaaaatatgaaagatttctaatattctggggattcttgtctctcccttttgaaagctttcaaggaaaacaaatactgcattgaaaaaaatgttccatatttattttactatttatgaattaaacaatgttgggacaatatgaattttaatcaaagcaatacttttcaagaagagagaactgtacaaactatttatcttttccattttgtctatcaacatgtttggacaatgaaaactttacatatgtaattttaaagtttaaattatgcttatgaccatttcatgtaagtttctttcaaaatagtatttgttttaaggctttatttgttatataaaagagtaaaatagtgctacaaaaatttgtgtatgttgattaatttggtttacatgctgcctagtccattttctgttgcttataacagaatacctgaaactttcttacagttacggaggctaagaaatctaaggtcaaggggctgcatctggtgagcaccttcttgctggtggggaccctccacagagtccaaagttggcacaaggtttcacatggcaaggggactgagcatgccagctcaggtctctcttcctctccttccagtcccaatcccatgaaaacctattaatccagaaatcaattaatctattcttgagagcagaaccctcatgacccaatcacctcttaaaggtctcacttctctatactgacacttttcttcttcttcttttttttttttttttttcttttttgagacggagtctcactctgtcgcccaggctggagtgcagtggtgcaatctcagctcactgcaagctccgcctcccaggttcacaccattctcctgcctcagcctcctgagtagctaggactacaggcacctgccaccatacccggctaattttttgtgattttagcagagatggggtttcaccgtgttagccaggatggtcttgatctcctgacctcgtaatctgcccgccttggcctcccaaagtgctgggattacaggcctgagccactgtggggcgcggccatggattaaatcttaacatgagttttagagaagacaaatattcaagccatggcacatatgcctttctgatcctgccatacactctaaacagcattaaaaggtattttacttttagaaaccatccacattcaggtaggtcaagtgttaaaagcatagccatcacgacttttatgatagtataaatagaaaataggatttttataacttaagttgtctcctgtcaaaaatgcagttcaactcaacagataatgtattgagcactgactataccaacaaagaaataaacatgttatggtcacaattattaaggagctttctacctaaagtggcaggaggagtctctgagggataatagagagagctgacattcactgacagttttctactttgcaactcttgtttactaatttcatatgcaccattacatttaatcctaataaaaatcataaagtagctactattagtaagttcatttgcttagctactattattaagtcctcaggtgaggaaactgaggcagagtggggttaagtaacctgcctaaggtccaaagtaagtggtaatctgactttcaagtttgtactttgtacttcaagccatcacactgtaaagacctccccaccatcatcagtaaccaaagattgtgataaatgattttatttctatgcactaggaacacagaggaggaaatgatgatttatcccaacttggaggaatctggaaagtcggtagataccaaatcgattctacactggacttagaaagacagagagaaaattcatacatggagggaaacatttcagatgaagagattagtcaacaaaattgggaaatctataaagaatatttccctagaaaatttctgtgcaattttagaacataaggaaaatttctacattccaatttttgccacctatctgtcatccccagggagcagctaaccctttagaaatggtgaaatctcccttttctggggcagcaacaggcttctggagccataccaaaacactatgggactcagaagttttgaggtggctatctggtctcctgcaccattgctttgaaataggattcagaaaatttgtagctggaacaccttgtactgcacacttaatgcctcaaattcaagtgattttcctcaggttcaaagtcctgaccctgctcagattaattcagtggatttgattgctagcactaaggcagaggaaaacattacagtttgagaagatacttccataattattgatatgtctctaaactaatgtgtcatttactcttaacgctgaaagttttaaagtcgtgatttcctatctctgttcaattaagggtagaacactatggaaatgtcttcagagtaaacatgatgttgagaaagaaatcatagcatcaaacagcttttggaatcctacagtgaaacactatactcactttaaagtttgaaaaagctcaatggagtaatcttttagcattcaacagacattttaaacttgtactgagagcagggctcctactatgtgccaagactctaactaaatgattttatagaaattatctatgtcctcacacttatgtgaggtagctattcttacattcatttgataggtcaggaaacaggattcctaagaaaataacttgcttaaagtcccctaactcacacatgatagattaaggaattgaactctcttttcttccatattgtaattaacaaaaatgtttgaagctatatgattcttcccttaaaacgttttctagatagatgtaaaaggagatatatatatatatatatattaataagcattcatataaaagataataattttgcgcattttatggggctgccattatgcaaattagttaacttttggctggttgacccaagacaactgcaggactgcagaattcctctgagagactgaagtgctatcaagcttaggaaaacacttaaaaacctatttgattatagaaggtgagggttttctttttctttttattttttttgagacagagtctcaatctatcctccaggctggagtgcagtggtaccatctcagctcactgcaacttccgcctcccaggctcaaacgattctcctgccccagcctccaggcactggccaccatacctggctaatttttgtatttttagtagagacagggttttaccatgttggccaggctggtctcaaactcttgacttcaggtgatccgcccaccttggcctctcaaagcgctggaaagtttaaacagtaacaaaagaggggaaattactgcataacgaagtaaaaggcattgagttttgtcatttttgtgagggttatgatactggtagaagagatgcaagaggaagtatctggaggtgaggagttctgtgtccatggacagacttggtcagggagtgtctgatacatgtctaagggctgtggttctatcactctaattccagttgattcctgcttctgctataattgccctgcataatccccaaaactttcaataaaattttattactgacaacaacctgctgtgagtggtgtttggaggaataatggagaagagatggagccttgaagtttcagatagtggcagatatttgcatagatctataatatatagtgcagcatgggctgtcttctaaatagcaaagaatatgcattatagcagtgcagaggagggaccaatcactttcaggtaagggattagagaatataccacaaaagttgtagcatttcgtgtaggccttaaaagatatgcaacatttgaataagcaaagattggtacgagatctttagattcagagtgaaatggcatggaggttgggagtttccaggcacattctggaaacaggattcaggcaaacttaagtcaaccacatatttaaaagcaatggaagatataggtacaaaaaaatattgaagttggagagacgacaattttcaatgtcagaataaagagttaaaaatttattccaccgtaaatataatcactgaaaattttgataaagggaacaatataacctggtggttgtgggcagatggcttggggcctaacagtaagaagtatatgaattctggtttttgacatgttgagtttaaagggctgtgaggtcataagtatccaatccattgggcatagaagaataaaacttagaaaagactttggaatgaaagacactgatgcagaagtgtatagagagctgaatttaatgtttgaatatgtggcagtggatgggagttcccaaggagaagaaagtaagagagatgagaaaatgtcagagaacaggatttgggcatgacttaggggttgagaaatggagactcaagacagtaaaagtcagaaaacaaggagagctttttaggaaggttgaggtgatttaatgtgttatggaagataaaaactgaaaaaagtcagaggagtactacttcctcatttgataaaaaaggggtaaaaaataaagacattgtgaatgatttaggaatacacaacatacagagaaatgaaccgaagcattttaagtttaaaatgtgtgtaattcaattcttgcaaagttggcttttaatttattttccctttgtattaaagaagtttgcatccagaacacattttagtgaatacaaaaatgggtagataaaaacaaaaatagcaaaaaatctttaagtcactattgctaaaaccaactatatccttgttacttaaagagtagtctgaggaccagcagatttagcatcgtttaggagcttgttagaaatgcagcacttcatccatgtccctacaaaggacatgaactcatcattttttatggctgcatagtattccatggtgtatatgtgccacattttcttaatccagtctatcattggtggacatttgggttggttccaagtctttgctattgtgaatagtgccacaataaacatacctgtgcatgtgtctttatagcagcatgttttataatcctttgggtatatacccagtaacagaatggctgggtcaaatggtatttctagttctagatccctgaggaattgccacactgacttccatgatggttgaactagtttacagtcccaccaacggtgtaaaccatcattctcagcaaactatcgcaaggacaaaaaaccaaacaccgcatgttctcactcataggtgggaattgaacaatgagaacacatggacacgggaaggggaacattacacaccggggcctgttgtggggtagggggaagggggagggatagcattaggagatatacctaatgttaaatgacgagttaatgggtgcagcacaccaacgtggcacgtgtatacatatgtaactaacctgcatgttgtgcacatgtaccctaaaacttaaagtctaaaaaaaaagaaaagaaatgcagcacttcagtcccattctagactccctgatcagcatctgaattttaatgtgatcctcaggtgattcatttattaatgtttgagaagcactgctgcacaaaatactattttgtcatacatataagcttaatgatatacatgatatgatacatgagatgttcaataatctgtctatagattcctgccttcacattgtgagataataactgggttctgagactggattttagtgctcaggtctgccactccatagctgtgagaaaaatctcactctcccatctttcagtttcattgcaaaagcagtagtcacatccaatcctatattgttattttaaataaatcatgtttaagggatatggcccctgctccttagaatctgtaatgtaacattgacatcatgatagggagaaagacactcatggcatatattaaataaaagcaaaatgcacaatgcatgtatcttttaatgacaaaataaagataagaatggcttagaaaaaacatttttagagttccaaggttgaggagaaactgctattatttgttcctccatcatgtagttcaaagttttctggagagaatagtctcttacttaatgcaaaagaggaagctcagcaaacctctaatgatggcagtaaatagcatatttggaatgcttactacctggcagatgaattgtcatgcatatctcctttaatcctcacaacaacctgaagagacaagcagcactagttatcatccccatttacagataggaaaatggaggcttagatacattagtcactggctcaaggtaatagagtttacaagaggtggaactgaaatccaaaccaggtctgtcaaacatggaaagtagaattcttaagtatcctcaatgaggaattagagatagacataaaataatatatacgctaacatatatggacataaaataatataaactaacatatattaaatccttgtaaacacactatcatataggcactgttattatccctgctttataggtgagtgtattagtcagcttaggttgtcataacaaaataccatagaatgggtagttaaacaacatttattttctcacagttctagaggctgcaagtctgagatctgtgtgtcagcatggtcaggttctggtgaagactcttttccagtttgcagatagctaccttctcactgtgtcctcacaaggactttccctggtgcaggcaagtagagaaagaaaaagagaaaactcttccccttcttataaggccactaatcctattgaattaagaccctacatttatgacttcatttaactttacctcctaaaggccctctctcctcacacagttgcctcaacatttgaatttggggggaacacaaatctgtccatagcagtaagaatcactatccaagaatgattacataactttctcaaggtcacacagtggtgaatgatggagtttcaatttgaatcatggcaggctggctcaagagaccatacttagctgcgatcttatgcttcctctaaggatcaatgaaaagagggcatattaggtatgacatagctgtctccattaacggtttctctctactcaatactttattgtgatttcttgtttaacaacgtgcttttattccaatctaatttcctcccaaattatctgttttctattagtggaactgtaacagcatgacttttccttttccaaaaccagtacaactaacaaatgtaacatgggagaaaataggctaaattgtattgactacgtgctattagcttctagggacagatttattaaatagcacccttcaattgcattcaggttttcagaaaacctattattctataccatccttcactttgtatcattgctaagggtctcttcactcagttaagtcactagaagtgccaattaaaggtgaaattaaggaagctcagttcacacacttgcagggacactggtgtttacctgctaatggatagacaatgggctgaaaagagggattaaagcagtttttattttcttaagtcagatccagctctttctggactgcatatcaaccaatacagcctggaattttaaaaatgaagaatatgcaatccagccaagatgacctatatgtctaaaaccatatgctgaactgcttactccaaggatatttctacattataggccaaaaaggcttcagacagaagcatggatatgctaataatcaggtctgccactctaatcatctcctctggttccttgacacacatcctccacttcaaggaggctgatcactcctcactgccctgggcacacgttcatacatacttcttgattatgtttattttgtctttcctgctagcaaggcctacccattcaatctgtccaaatttcatctttcagcctcgttcaattattaaatatcatatcctcttgaatttttctgtcagcccttcagattcaattttaactttaatcacatacagctctacattaaaatgtcagtaaggagacttctactggtcacatgtatctaattcttctttcctcctcaatgcatgagatgattacctatttcccctttacaaatgggcaggaccatgagactagttatggccaatggattgtatatgaagataaagtatgtcatttcctagctggaatatttaattgccagagtgaaacccttcttaacttctcttctgctggactttgaaaatagacaatattccaagtggtagcctccgtcagccaaggtctgtaataaagatgaggtagggcggagtatcctgttaaagcacaagaatgcagtgtgcacaagaaataagcctttttggtgtaagccaccaaaattgatgagtgtagctatgtgtgtgtgtagtaaggagtgttaatatagttgaacctaacttattctaactaaagtatcttctgctttgagattatatattttatgcttctaagggtcttcatttattctacactcaacaaatatttatcagagcacctactgtgggtcagtgaatggcctaggcactgaggacacaatggcaagcaaaacatataaagcccttgagctaatggtgattatatctagtgaggaagataaatgcactccaaataattacatgaataaatacaaattttaaaccaaagtcagtgccttgaagaaaaaatacatctgacctcgtgaggaggactgtgctgaggtgtcagagaaggcctttctgaggaagagatttctgagcggtgttacaaagacaaacgaagggcaaattaggtaaagtctggcaggggtgaggagaagagtatttcaggtagaggatgcagcaggtctgcatgttttcaggcagtggggagcataactaatgtgaaggaaggaaggaaagcagacgggggtacctaactgtagaggaccttgtaggccaacctaaggattgtgaactttatcctaagagaaaatggaatggaagcgacggaagaatttaaagatggtagaaagagggtatcatcacaccttcactgtgacatggggaagttccctctcaagtttagcttctaatataaaaactcatgacaccaattctttggtatgatcagagaaggatttttattactcatacaagtggacagtcccatatcaaggaatggggaccagctctctggaaggaagtccataacagagagagaaagagcatagggtgcacaggccttttatgagagaagtccctctggtggcacctggaagagacaactagagaacccccgcacttggagggtgaggaggctgtgctttatcatggagcttcaggaagtgacagatccaggcatgaaatgaggtttagaggttactagcatcaactcaagcaccacaggagtttcggtttctttcctatggtctccatagaagaagggggaggcacataccatgattagatttgaatttcaaaggattttttctggctacagtgtagagattagattggataccagttaggagggtgctcctaatttgggcaccagataggagacttgtgcagtaatccatgtgagagatgatggcagattacactacagtactggtggtggaggtagagagaggaggacacaaacgaaaggtatttaaatgggtttggttttcaatatgatggggtggggtgataagcagggagctgttagagatttatctcagagttttgattttgaaagtagatgtttgatggtatcattcactgaaatagagaacactgggagatagagggagttaatttttggtagtatttaatcaaaagtgcctttgagacatatggatagagatttcaaaaaggctgaatgatacacaggtccggagctcagagggaaggcctaagttgaagataaaatgtgtgagtcctgtatacatgacagggaattaaaactaggtgtagagatattaacttgagaaaaaataggtggatctatgacttgagggacttgaacatttagaggacatgacacattgcacactggctgcattcattctcctctccatctctctattaaatccaacatctgggtccctctcacccatagtttctgccatctggttcttttatcctgtgtatgggttatattttttgtttctttccatgctttgtgatctttggttggaaagtggatattgcagataatatactgtagcaactcttcttactccccctaccaccacccagggcttgctattattctttggttgtttagtgaggggctggattattttaataagtatatttccttcacagtcaggtgagttaatttccctcagttaagtcactgagtttgctatcagggaggtacatctttgggtatgtccacagacagcccagccggcatgagagtgatgttcgtgtgattgtccttcactctttccttaaccacattcagctgttcaactccactaattggtgaacaattgctgtgttattttcaacagtgctttacaaccttatattgttcaacacactaatacaatcgaattgtgtctcctttgaagaaatagttcgaagtcagggctcctcccagctgtgttatttctctggttctctcctgcaaactagtctgcaatttagcctgtatcttgactctcctcccaattgcctttcaccatagcttccactgttcttgagcgcactctaaggcttgaacttttccatactttgttgcaaatgaagccatgccctttgggaagagattaagaatatttattttatgatggattattgcccccgccaccaccaggcaaaatctctaagccatgtttctcaagatggaggtggagaaaatggagaggttcttcctgcatgactgcatgaaactcccactctaggagcttagcttagttgggaggtggcagcactctaatatcttctatatttatctctcctggtgtggaacccccacctcaggaggccaggcaaggatgatgaggcctctgtattcttagcatgcagtgcctaaggtatcccctccattcaatgatgggggatttggcaggggaggaagcccctacctctctactgtattcaccagagcttagccttagcaatgggtaactatggccaggatgagaaacactgaagttctgttccttccaggaagaaaccttccagctggaggggagagagctctgtgttcttgattgcaccagcctggaatggaagctccatctccctgaacttggaagggggtgagagggagcagtcttggtttaaataccacaggcttgcctttcttattgaattttcataaatgttcttgaatagatgtttcttcatttgctatttgtccttaggatcatttccagaggatttaagtgcttggagtttttatttgtttgatcatagttttcactagttttactggggagtgggttaaaggaagccctcaagatgttatgccaaaagtcttctctctctgtatttctgccttcagtaggctcttcccatgtgactctgggcattggccaagagagtgctagcaaatgtgatataagcaaaagcttaagaaaagcttgctctgtgaggtttgccctctgtcagcatggaagccctttaatcagcatttgaaaaagtctgagctagtgtcctggacacagtgagagaatatggtaagaaagtggagagaaaggctgcagctattccaggagacccaggcttcacagatcaagccgagagagaatagtgtcagaggagccaggagaagaacacacttcaaattgtgagaaatcaaggaagagaagaattgcaatattcattacatttagaactatccaggttattgttcttcttactaaaaatgattttattggtaaaatgggaacaagagacagactagaataggatcggctgtgatagggaagtgaggaatatagctagagagaataggcaaaactgggcaagtgtggctttgcaagggagacaagagatgaggcagtcattagaatagtggttcctaactggggtggggggtgggcatctttccaggagatatttggcaatgtctagagacaactttgattgccacaacttgtggggcgagggacacaatattttcatgggtaaagaatgctgctaaatatcccaaaacgcacagaacagccccaaagtaaagaattatctagccccaaacgtcaagagaaaccctaacatagggaaataagtggttgaaggtgaggtttttgttttgtttgtttttaatgcagaagacacttgaatgtattttgagtctcatggaaagtatctagttgagagaaaggttaaaggtacagaagagaaaggtgtaattttccaaaggtaacaattattattattattatccttttttttttacagatgaggagactgagagggtaagtgattagtcccaggtgaagaaggcagtggagctcagattccaatgttggcctatttgactgcaggccaagttgctaaaggagttctttgtccttctgctgtactcccaacacaatggcatcaataccaaaaacacacccaagctaatatcatagatatctcttactcaccttctaaactctctactcttccatcagacccacattttctttattgaaccaccttattagcttattgttaagtctgagtgtatcatttagggaagagaccttcacttatagtttaggtttcaatcctcagtaccatttgtagccatttggcttctgcataatttcctctttgagactcatctgtctaaagatttcacctctgcttagccgcgcctttccttgaaatactctgcagttccagcaactgacagctcgtgcgggcagcactgaaaaatggaccaacccaattgaaagctgaactctctcctgaatctggttctggactctgacccttttttaggtgttccaattgttccctgcccctaaggaatgagattgcagaattccaaacactaccatttttcaatatctaagtcctttaattgtgcagtaacaataaccgtgcagttagaggagtgccctagaagcacttatactataccccagggactattatggcagacgaagggaagcaagaagatgaatggcaaatgaggaaatgcagggaggaaaggtcacttggagccaaacaatgcactaaaatgctgacatatctatgcaaagaacttttacaacctatacccatgaggcacaaacagatccttaaagtgtccagggaatgtcaaccttcctttcaggaaatttgtctcaactcagaggagactaaggaagtgttaacttaatgccgtggagtcaagtgtggaagattaagaagagtcatgtgtctgctttgttgctttaacagattctgtacctgagctatttttaaaatttctttgaatacatttcatgaactcctttttctatttattccagcttttgatacttttccatctgataaaattttgcattaggattgtatctgggcatactttaggattgtatctgggcatgctttttttttgtttttgttcgtttgtttgtttgttgttttgagacggagtctcgctctgtcgcccagtctgtagtgcagtggcgccatctcggctaactgcaagctccgcctccggggttgacgccattctcctgcctcacctcccgagtagctgggattacacgcccccaccaccacgcccggctaattttttgtatttttagtagagacagggtttcaccgtgttagccacaatggtctcgatctcctgacctcatgatctgcccaccttggcctcccaaagtgctgggattacaggcgtgagccaccgcacccagcagtatctgggcatgcttttaaacaacccagtgcaattcaccctttacttaatgatgaaggtatccttcagcactaacccctcatggacttgaggtatttctccttcctccctgccatcttcctttcccctttctactatctccttttctcttcttcctctatacctactttccctcttcctgctcttcctccttccctccatcttaatcttctttactctgcagtcttcgcagaatttaaactctgatgtgtttaaacccaaatctcacaaagaatatagactatataaagtataaataaccaccctggactatacagttatttttaatttaagatatacactgttacatgttaaaatttcaaagtgcagcattttctaggatattattaagtatattaatctattgagaagcaataaaatttcactattattactttgccaagtttttctgttgcttcttttgaaagtgcataaaagtagtttagttaatttttccgtgcttcagtgtattcaatactgcattattggagcagaataaatggttgaaatggcaatttgccacaaactcttctaccactttgagaggagtatatcagaagagagtatcatttactgttgactaaaacattaaaagatggaagaataatatttgaattaagtgcttttcatgaaaaaccagtaaaaatctaccagaaaaatattgaaaacactttggatccagcccagccttttattttagagcttgaattacagtttggagtttgtgctgttttccaaaagggctgaggttaagagaggtaggattcaatgaagatctaggatcttttaatctgaaaatattttatttctatacagtgactgagacaaagatattaacaatttatattaaactaaaacatggcaacatcatcttcctgtctctcttcccactgtactattgctttactcaattgttgctttattctcctttctaacatttgcgtgtcataggacctgttagagaccttgataagacataaaaataaccatcttgctggtgagaaccatgtctcaaagcctaatgccaacaaagtgatggtgaggaaaggtgacattggaaaatgccatgataaataattttgagtctctggacagactgattattgaatttctttcttaaaaatagctgaccctcctaatcaccctcacttaaaggaatgactcaaggctggtttggtgaggctatttgctcctgttgattttagggcaattgtgtagctctaacagcccctgagcagtctgcagagagcagccatttcaccacctaatcactatagaattcaaatctgaggctgacagcctaaaaacagccacccctcattttcaagtgaaaatgatgaacagctcaacagatcataatgtgtggtctcctgaacaaactgacctatgtctgagctgccttccatactgtagatggtcccatactgggcttgggggcagtattctggtttaaaatactcactctggccaatttatctatctctgtcacatctgccacccaagtgctgagactcagacaagctgtccttaccatttgcctcaagtcacagataatgatactggcaaagtggtgggcaagcaacctaccacagacaatgacagacataatgaattacttggaattaaaactcagaccccaaaacttcccatgttcagcaattattacagggaggtcgggaattagtttgtcttcaggaagctaaaagagtttaatacccactgtaccttaggttgacaagaaataagagatcagccaaagcattgtatgacaatatttgtctttcacaagtcggagtgctggaccaagagactttctaaagtatcctgggttcccaacatgctatgcattgaagaaggacacccatttttctaactttattgaaagattattcaactatagaagccatttgctctagctgtggagtccttagcatttgccaggttttaacagtgaggggcttattttgcagaatatgttttcagacccaggccttcacttgccctaagttatctattgtgaaaagcaacccatgtaaagcactctctaactgataaactgctacacgcatattaggagttatttaaattaatgagctatcatgatacccatcctgaagggccagtaactcatttttaccttgtataaccgagttgtgtattacattctagtatttattctggtccatcgagaagtctccctcttcaaactattatgttctgcacacatataacataatagctttccttgtttgctctttctcttacatccctgtttttatataactgagtttggctctagttttcaaacagaaaagttttgattctcaaacaaaatgtcaggctcctaataaggcttaggaaattctatttgttgccaatgagaccaagctggaaaccaagaattcctaaaggagtgttgcatgccagcaaacttcaaaattggttgttatgtgattacatttggctatttccaaatcatcttaaagtttcctttcctaaagggaatataactgcagttcttccagcacttttgtgtagagagcactttgccgtcttttgagtaacttcctgatatcccttggaaggcaaggctcagcaggttctttccttctctcttaacttgccatatccttcctgattcacggaaacaggagaattcctgggtatgcagctcaggactaaaaatctagtgtgggcggcccgggggaggtagctctcaggagctaggtaacagcctacagattgtaagtcttacattttgtgaggacaaaccagtccaagtagtccagttagtcagacttcccagatgctcccttgtctagatgtttagttcatcctgagcatcaagagaaaactgaaacttgtaggatatgcacacctgctgctgaaagccgataagatcttcaaagtgaaatgtagatactgatagagaggaatttatatttttcaaaggcatatttaagaggaagcttgtttaggcaactgatttacaaggatatgctaggttggctcttaagggccaggcacggtggcccatgcctgtaatcccagcactttgggaggccgaggcaggtggatcacaaggtcagaagttcaagaacagcctgaccaacatagtgacaccctgtctctactaaaaatacaaaaattagctgagcatggtggtgcacgcctataatcccagctactcaggaggctgaggcaggagaatcacttgaacccaagaggtggaggttgcagtgagctgagatggtgccactgcactccagcctgggtgacagagcaagactctgtctcaaaaaaagagtagctccaaaggcaatcaaggtagtaatttgtaatgcttgatatactgatatactctcaaagagatgtaaaaaatggacctcaaatattagcttactagcgagtgtagttaatagtgccactaatgtattgtgagtggagctcctttatataaaagtcatccaaagctaaaaataattcccactcttgagttattctaccaggttttccctatggatacttgttatattcttgggatcatattgtggcctgggttatgcctgaatttacataacaataagctaaattataatggaattctttggtgattgagtaatgccatatataagttctgtatatggagaaaccaaagcataggtatattaaattattttcttcatactgcagaaatatagtagaaaattgtatgattttctctgaggacttacagagggagaggatggtagttgtgcagagtgcaattctaattttatgctgagaatgataatggcttgctgttcttatatacagaactactgaagacagaatgagaaaaatgggatgaataaaacaatttcaggttaactattgtgaagttgaaagctcataattaacaaataaatgctgaacccctacaaatagcaagaagtctctattagaacctatggttgatgaagatatcactcacaatgcttttaacctttgagatgcttacaacttacttgggaaggcaaacccttcatgtacagaaagttaacacaggaaagagctgccaattagtgagataacttagtataaaggaggttgaattgagaatcattatgtagattctaattctgacttagccacgaactaccttaatgaccttaagcaagttacaatctccttgggccccaactggtcacctacttatagttaacatttattgaatgctcactatgtgtgccagatgtcttacacatattctctcatttcatcctcaaactgaagcaaagtaagtttaagtaactcatccaggattatactgctagtatgtggcagaggactcaaccttgtattctgaaagttaaggcagtgtcagaatgatgtatatgtgtgcatgtgtgtgtgtgcgcatgcacatttgtgtgagagagaatgtaagaatatatgataggctgggcgcggtggctcatgcctgtaatcccagcactttgggaggccaaggcgggtggatcacgaggtcaggaaatcgagaccatcctggctatcacggtgaaaccccgtcgctactaaaaatacaaaaataattagccgggcatggtggcggaagcctgtattcccagctactcaggaggctgagacaggagaatggcgtgaacctgggaggcggagcttgcagtaagccgagatcgtgccaccgcactccagcctgggcgacaaagcaagactccgtctcacaaaaaaaaaaaaaaaaaaaaagaatatacgataggttttcctggttgtattagaaacacacgtgataaagaatctaccaaactatctggtttaactatgagacatgataagtagacaattcacatcaaattgtagtggagagcccattccttgactgcctctatgaccaagtgggcctgattctctggttcaaatctttacgatatggattaattaatgtcaagtacagatatgttactatcaacattaagaaaaaacttccccataaaaagtcacctgctatattttatatttgagattacatgcattatctactctctaaatccagcaaatctgtttctgtatagacctgatttagggagatttttatgttatctttccggttttccttatataactgtagacctagcagaggacacctccatttttgtttcatttatttgctttatattattttaagaagaaacatgaaacaaagcaaatccactttatgattataacacaaaagttatgtgtttaatttacatgtgattaataagcatttaaacctattttcattgtatgagccacttcaaacatcagagttaaagcttctttaaggaagattttcaaaatagtataggcagagtacagaactggtctgatggtatctatcctaaatgttatttttattaagagatctttacatttttggtacttcatgattcatttaaaagattatagttttctgatttttgttctgcgtatctcacagtgtctttggaaaaaagccatatacctctgatctaagaccaccagcttactatgcacaaaggctaataactcagtattttcagcccagtagctaggtagttagctctatcttttgagggaaggccagataaaagtaaaagagggaactcatacttgttatcattataggtggtcatataaactcatattaatagaatttatatttgataaatgatttaatttattttataattagatcttcagtaatattcataagtattataaaatagatgctacattttcctggagggatgtggatatcttatttatctttgtgtctctcaaacacagatactcaatttttgtcaaatgaataaatggatgaatagacagatatacagataaaagaatatataattataataatgtgaacactacttgaatcaagaaaacaaagcccaggatatcacttaagatattcttggctgccctttcccttgactgagtctaggctatgaggtggataagaatatttcttctctaaaaagacttttgtagttaaagtttattttgttgttatcttttggctttctgagaaattggttttattactgtttttaatttcttcttttttcctcgttttatttctggataatttaaagcttaaataggttaaaaaagtaccagttatgattaaagaaacaagttattccagggcaactctgaatagagcaatatcttgtctagctcaaaacatttatgccaatggcataaattgagtgttacagaagaagagcaatttcaaaaaaaattgtcaatattattagcaatatttgagtccatactacatgctaggcatgattcaaagttcttcataaatattaatttatttaatcctcacaacaaacctgcgtaagaaagataatgttgtaacatttatattaatattttcatgtaatatcagcttttgtgatagatattgatagtaaatagaagaaaaaagaactaaggaatatttctttgggattataaagagtaaagattatttttctgtgtatttaggtaaatttatactattctcttatatctaatgtcaataaaaatacctaatgcaaagggattgaatttttttccccaaacacattgcaatttagagattgcactccagtgttttagaaactaaagtatggtggtcagtaactttttacttttccaaatatggacagttaaaaatccaaaacacaagtactatctactgtcaccatcatttcctcttaaaaaagatcattttaaaactaaaaagtttggaaggatataaactcacaataaagatcatttcatttaattgaacaaatttagctttgtgaaagattcatgatgtctaatttctgatttcagagcttgccaatgaaaattttaccatggactggcttcagtctttgcaatgacatttaggaaccaccaaacgttaacatgacagccacatttattactaagtttttctgaaagcagatgtaacagatgtaacctagatttagtaggcctctactttttccctccctctacatagaagccatattcagcaacttaatgtattttgtccaaaaatagatccaactctacaacccagtgggatgtttcctctaaagattataaaaatatagagaaacaattttacctcacattccacacagcaaagctccataaatatccccgttaaacatctctgttattccctcaaaatccatctcataatgtcagcctcctcacttctcctttctctgtccctgatatgattaggctttgtgcccctacccaaatctcatcttaaattataatccccataaccccttcatgtcaagggaaagaccaggtagaagtaactggatcatgggggcagtttcccccatccggctcttgtgatagtgagtgaattctaaagagatctgatagttttctaaggggctcttcccccttcactcttcactctttttcctctcacctgccaccatgtaagacatgcctcttccccttcctccatgattgtaagtttcctgaggcctcccaaggtctgtggaactgtgtcaattaaccctcttttctttataaattacccagtctcaggtatgtctttatagcagtgtgaaaactgactaatgcagcccctttatatccacagtccgtaaaattctcaccccatccaaccctgctccctctttctcgtcacttcaagctctaagctttcatgtcccacttaataaaaccctaacctggcattagctaaacctgtgtccactcctcccatagcatattatattttccaaagattaatatacagatcttcttatgttactttacgttgtgactggtagaatctatgagttggatttacgttcttttcctttgaatattgaaggatacttgttgttgatccaacccatgaagtgtggttgaagtgatgctctgtggtttccaagccaaagcataaaaaggacacagattctaacaggttcttactctctctggggatgcttgcccttggatatcagctattatgctatgaggaagttcaaactaaccctcaaggagagaactcatggagatgaactgaagtctctagcccacagccagcatcaaccaccagacatgaacaacttttcagatgatttcagccctcaacctttagagtcttccagctaaggccttagacattacataacaagagaccagctatctctaccctaccttgttcaatttcttgactcacagaaaccatgagagaataaaatattattgttttaagccacaaagctttggggtgactttatatgcagaaatagaaaactaatacatccccttaaaaaggaactccatgaccgtatattactcttatcttctacttggaggaagggagccattaatgtttcatcatcttttttctttaactgcttttcaaaatactcactaaataagttcgggtctcatgcaattaaacataaggcagtatatgttctagccacttatgtagaaatgtttacagactataagaaatggtttcatgtttatgtgagaaaagtgaaaatgggaattgggttctagttatttggaagagagatgcagcaattataaaagatattttgcgatttaatgcatcaaaatatttactggttaaatatttacattgtctagaattttttttttgtctagaatttcgaagccataaaaatgaaacaattagactattattttaggtttcatatgtttcataggaaaaaaataatgattttactggagccaactaaatttctcattaacactcacttgataaaattgaaaataaaactgaacattaatccgatcagaaaagcactcctaatgcctcagttatattcttcagtaagcttgtaaatctccatttcctaacatcatgtcacagttctcaatctactcttgacaagacattacaaaggctgggcaggcccagcgcttatcaaattatttatactgctcacagtgctataaattacaaggaatattatgaacaattaatattatataattcatttgtataaatatgactaaaaagtagcaatactctcccatttgctttacccatccaatttaaactgtacatatttgagagaaagggagaaactagtaaaaagacttagtaaagaggagttactctacagtcatattaaatgttagaccccacttaacgctcaattccttggaagctttaatgtttcctagtttttttgttttgttttgtttttgagacagagttttgctcttgttgcccaggctggagtgcgatggcacgatctcagctcactgcaacctctgcctcccaggttcaaacaactctcctgcctcagcctcccaagtagctgggactacaggcatgcgccaccatgcccggctaatttttgtattttaggagagacgggtttcaccatgttggccaggctggtcttgaactcctgacctcaggtgatccaccggcctcggtctcccaaaatgctgggattacaggcatgagccaccacacctggcctgtttcttagttttaaaagggatgaatagcaagaaatgatatggtgacaattattcttggcatgggtttgagaagaaatgatattataagaattcttcttggcatgggtttgagaagaaccaggtatttattaaaagaagagattctcccaataattatcttagcatagaagccaatcttctatttcaggattactaaacaaacatcttggcagttatttgagcaggattcagcatgaaagagtgtgtttacatggaagatttagacctaaaattgtagggaaaaaagccgggaagattaacaagtcagaaatggccgttattattagagatggcaggtctaaagatactttagccctaactgtggcaccagcatattgaataagaattcattcttattctcaaagacctagctgcaaatggcactgccctgaaggtttcccttcttacctttcaggatatccctaccatgtcaggtaagagagcactttcagaaagattcacaagaatgccatgtatgtgccccagacctttttctccttggtttctacagtgaaattaagtggacttacattaaataagttcacgtattgagtgaggcacaggacagtgctgacgatgtaataagtgcacaaacatatttgtttaatctaaatctttgatcagaaattatgtaacataccctatataattttttaattataaatctgagattccaacagaaatatttacagattaattttcctagactagtataaggttcataattgctaaagtttaaaacaaagcaaatattcaggaataagaaaatgtattagagtgattacaattattacaattaaactagtttttacttgcccattctaaagtaatcaatgcaagtatttaataagtaaaagaagaggttatataagcttttatatatatactttatataagaaattggtaaccatggttgtgcctctggagagggactgggagtttcatcttaatacttattcttctcatgtgcatgcacattttcagaaaaactaaaacactatgtataatactagttgatactggtaaatgtttaacccatccaagtagtgatcatttcaactttagcaggtatttccctcaggcaatatctgcttggcaattcagctggtatctgcagtctgggtaccaaatcagttattctgttcagtgggtgcctgccaactcacaggaacatgctgccccatccaaatccattcctctgcccaaaatagggagggaatccctgggaatatcacacaaattggcctgaatctactcaggattccagctttcgggacactgcagggattactcagctcctcctactccaagcctgaggattccaaccagtatagcgaggagcattttcttttttaatatttttgtcccaatcattttaaccatggcaagagccagctataaggattgcctcttgtagcaggagggtgctggggtatttctcacaacatctccctaaggcagggtgcttttatcccggttacacagagccacatccttgctttacaaccctccctccctcctgcccttcggtcttctttcaatcagatctcccttctccatagggaaatgtatcaccaagtaagatcgacatgttctttggtggggatgctgcttcttattaaagggaataattaaacggccctgtattttactcctctctaaattccttttgtgtttcaaacaggaggttgtgtttcacttcctcactgacacagttataggatactctttctggaagaaagaataaaagctcacctataagacctctgtacttctggtccccacagacaaagatggaaaggcaattgatcggattctgaatcaggtatcagtgcaaaagcaagagttcaaaaatccaggtgagtggcccaggtcttagatggcagaaaaccccgaataataaagcaggtggtcacatcaacaggacactgacttctaatgggagaaggtggagttttgtgtgggcccagaaaccacacaactaataacaaccttcagcctgcaggacagcccctgaacacagccccttcccccttgcagttcctcacaggaactcagactctctggctgcccctaccttgtctatcagtccaatgctagcaacttgatggggtttgcactgtaactgcaaccatagcagagtgctcattttagattcatgtcttgcaaaatatttcgataacattctagcacccacatactcattgtggaaaaaaaaagcaagaaatagtatgggctttacacagaaccaaaagcagcaggcccctgtgtgcttgtgaaccaaacgcaaccaaatgtttctatttgtgagccaagatgactggggaatttcaaatatttctgtatttcataattacaaaagaggcatgctttcagaattaaatgaacacagtttttaaaaaatttataaagcttgtgataaaaatgcttcattttatatgcttattcagagtctgcttttaattatttcttacaaatgttttcagtagatatcttatagtttggctttgttccctggaatctgagaggtgaaactggctaacaaaaataaattagactgactagtccaattccattgcctaaattgaaacaaattttgagatttagagaaaagccaaaaagagtttgaaaaaaattgcattataaaagtcaatttctaatgttctaaattcttattctgaaaaacaaggcaataacatttacataacataaatatatatgtggccagatatttaggcattaaaaacaagactggcactgacttatggaattctttgtgttttgatgtgacaaggacaaaaggcttcttttgctaaaaataacaacatccctacttaagaaaccatctgaatgacattcttgaaactatgtctttactgaaaatcagggctgtggccatggtatccaatcagctagtccacaataggtacatttctttttttaattattattattttttttggttggggaaagtaactttcttagttgttgtgctttgcttttgaatactgagtgttgtcatatgaaggagccatttcatatgagatattttccagtatagaattagacagacatttttacataattctacttccatataaagttgcactttttttttttgctatcaactcagtaacttaatatgtgtgtgtcagtgcacgtatgtgtatgtttagtcaccagcaaaagagttagcttttctggacctaagttcttttatctgaaaatgttatatatgatattcaaagctcttcccttctaatatgagtacatgaatgggagtggctgttggtagtatagagaaaaggaatataacatgtatatttttacacatatttttcataataattataattatgtaaaggttaaggaaagtcatattttaattgcatatttatttctaataaattagaaagcagataaaaggacatgaggtagcagacttcaaatgctataacgtattttctctatctttttttctagtgagattttgctcaagagagtgtgatgctaaattttgttctgaaaatgagtgaattttcattcatattttgagacttagaatttgtcattctaagtttattgtctaagtaactaaatggtgaatgagtacaacataaaaaagaaattgttctatcaattccatacaacattcacagtggaaagcctggagagtttcctgatttatagagataacagagtaaataggcaacttggggaatgcttttttgaagtacatttaaatagacaaattagagcctttggcatttctagcaaacatttatggaggtaaaggataaattattggtaataggctctgatctatcttcttttctcccgatttttgattttgtacattcaaatcattataagtttttagcatacaaatggcaagaaacatgaatataatatacagtttaactgtgatattttataatcatcttgacaaatttcatcattaaactttgatattattagattttacatataggattttatttacatatttctttcatacatttttacactcttgggcaaataatatttcccttggatgtaataatgccattctcttttggcaagagtgtttcttccaaaaggatatattaccaagcatgggaaagaggaacagaatgctttcatggcaagataagttaaatcagcagtgatcccaaatgactctcttactcatttgcatatctatttatgtgttgtcagctacatacacagtattaagaaattcaaaatgtacaaacaccataaaagacagagttttcatcttcaaagaacttatagtgaattgataagcagaattataaacaaaaaccatattatcatcttaatagatacagaaaaagcattggacaaaatccaacatcccttcatgataaaaaccctcagcaaactaggcatcaaaggaatatatcccaaaataataagagtcatctatgaaaaaccccaagccaacatcatgctgaacaggcaaacgctggaaacattccccttaagaatgggaacaagacaaggatgcccattcctaccattcctattcaacatagtaacggaagtcctagtcagagcgatcaggcaaaagaaagaaatgaaggcacccaaataggaaaagaggaagtaaaattatttctctttgctgacgatgtgatcctttacctagacaaacctaatgtctccaccaaaaggctcctagacctgataatgacttcagtaaagtttcaggatacaaaatgaatgtacgaaaatcagtagcatttctatataccagtgacattcaaactgagacctacatcaagaacacaatctcacttaacaatagacacacacacacgcaggtgcacacacacacacacacaaatacctaggactatcaagaaggtgaaagatctctacaaggagaactacaaaacactactgaaataaatgacacatgatagacaacataaacaaatggaaaaacatttcatgctcatagctttgaatgactaatatcactaaaatgtccatactgcccaaagcaatgtacagattcaacagtatttctatgaagttatcaatgttatttttcacagaattagaaaaacctattctaaaatgtaaaatggagccaaaaatagagcagaatagccaaagcaatcctaaagaaaaagaacaaagccagaggcatcacctgacttcaaattatactgcaaaactacagtaaccaaaacagaatgatactggtacaaaaatagacacatagaccaatgaaacagaatagagaaccccaaaataaagctgcacgcctacagccatctgatctttgacaatgtcaacaaaaataagcaggggggaagggactccttattcaataaacagtgctgagaaaactggctaaccacatgcagaagaatgaaactggacccctacctcttaactcaggatggattaaagacttaaatgggagacctcaaactataaaaatcctagaataaaacctagaaaatactcttctggacactggcctaggcaaagattttatgactaagtccccaaaagcaattgcatacaaaaacaaaaattgaaaattaggatctaattaaactgaagagcttctgaacagcaaaagaaactatcaaccaagtaaacagacaacctacagaatgggagaaaatatttgcaaactatgcattcaacaaaagcctaatatccagaatccataagaaacttatacaaatcaataagaaaaaaaccaaataaccccattaaaatgtgggaaaaggtcatgaacagacacttttcaaaagaagacatacaagcaaccaataaacatgaaaatatactcaatatcactaatcatcagagaaatgcaaatcaaaaccacaaggagataccatctcacaccagtcagaatggctactatattgaaaagtaaaaaaataacggatgttggcgagacggtagagaaaagggaatggttgtacactgtttgcagaaatgaaaattagttcagaccctgtggaaaacagtttggagatttccaaaagaactaaaattagacctaccattttgacccagcaatcccattactgggtataataccaaaggaaaataaaccatcctaccaaagagatgcctgcacttgtatgtatgtttatcacagcactatttacaatagcaaagacatggaagcaacctaggtgcccatcaacggtggattggataaagaaaatatggtacatatacactgtggaatactacacagccacaagaaaaaacaaaatcacatcctttgaagcaacatggatgcagccataagccattgaatgaatgaatgaatgaatgcagaaacagcaaaccaaatgttgcatgttttcacttataagtggaagctaaaatttgcatacacacatacataacgatgggaacagtgacacaaggaactcaaaaagaggggagggagagaggaggcaagggctgaaaaacttccaattgggtactatgttcattatcttagtgacaagatcaatagaaactcgaacctcagcatcatgcaatatatccatgtaacaaacctgcacatgtaccacctgaatctaaaataaaaaatttaaaaaattaaaaaaatatttatatgtgaattgaaaagagaagataaattatagttagggaatatttaaattgcagtgctctaagtacctacctcagcatctggcactataggctctcaatgcattccttcaacaaatatttatttagcacttactacattccaggctctggtctatgtgctggagacacatcagtgagcataacagaaaaattgtaacttctgtagtgagttgaactgtggtccacaaaagataagttcacccggaataagaatgtaaacttacttgtaaaaaggatctttgcagatgtaattaaggtaaagattttgagataagatcaccatgtattagggtgagctacaagtccaatgatttatgatttcctcaagaaattatgtttaagatcagaaaaagagaagacacagagacccagattaaaaaaaaaaaaaaggccacgagaggacacaggcagagattgaacctcatgaagccccatgccaaggagtgccaagggttggaagcagccactggcggctatgaaaggcatgcaagcaatcatcccccagagcctccagagggaaccagccctacagcaccttgattttgaactgtattctgagatgcagaattctctctgcaactcagagagaataaatttctgctgtttcgagccacccatttgtggtcatttatatggcagcctcaggaaaggaacacatctgcctttacaaagcttaaattctagtgtggagagataaacaataaataaataaataagcaaaatatgtagtgtgttagatggtgataattgctatggatataaatactacagaaaaggggcataaagaaaaataaatagtataggtgtgatatgggtgtgtatgtgtattgttagtggaaagtgctgtagggaaaggggagaatcagagatgggtttatggtgaagatgataaaagccaaagctgcagggctctctgcttgcataagtacctgccgaggctctggggcggtgccctggcaagtgtgtttatttagccagatgctttggcaaaatttgcaaaagtaaaattaaaattatcccaatatcaagaagtgagttagaaagatgttttgaatgtttaaacaagtgaaaaattactgactcctgatttcaatatacgtgaaggatgcttttttatccttaatttttttagattaaaggactaaaaatataaatgaataagaaaatttcaaatacaattattggagtatgaagaaaatgcagtaaagccaagtggttaaatcaatagaaattattcagatatcagacagtacattgtaacaatttttttccagatcatctcaaaagtggtaattcaataagagaaagagataaatttcaaatagatatgatgaattggcccttgggttgcttgacaagtaaattaatgaaaaggagttaatcaaactaacacacattgaaacaatttttaatttttttctgatttgatataaaatgttgacattgacagagaggatctaaatctcatgacaaatgcagtgacacttcgatgacaaactggtaaaagaatacaagtatgtaagattagtcaacatacacacccacaaacacacacaccacatcgaatgccctgaaatcttacgctcctacatgaaaaaaaaatttaaatatttctcaaaatttgataacaatgttaagaatgtatatgacattacaaaacttttctaactattaataattttttaaaaatcaacaatcctgaagaaaagtttaaagtatcttcccaatctctacatagaaaatattacaatttcagtgtcatttaaagagacaatcaaagaatatttagccaagcataggggaaaatgtattataaaattgggttgggcagttaataaaatgttatgatttataatattttgtggtagttgggatatatgttaacttaaaatttgaattcatagtgatatcttttctccttttaactattcactttgtattgggcttgtattatattagtaattgttatttttgctcttaaagggaattccatatctgaaccagcttcgggcccaggttccagctgctctgtccccacagaaatgcaccagctctgtaagagaaactaaaagactggagaggagaacgtgaacacagtcaggctgtggagatccaaagaagtcacagtgttatagaaagggacacaatcccaatgacagagcaaaagcatctagggatgatggagagggtcttgacttacaggttgctgaggctcaacgtttcctctctaccttgcttttgttgatagcatattgtcagtggaagatctctctatattccactctggacctgaaggttatgctctcattctgtgtcctcaacaaaaatctcagaggggtggaagtcagatttgatttcccttttctttcagtaacattttgattaattcccccaaagcttcattccacagacttggagattttgacctgaactgttctccaggtctgaaagcatgactgaataaccactgtcacctaacatctgtatgtgctcgcccatgcacaaaacactcacactccctggtctgctctcctggcagtctattgaagggaatttttactagaacacagtggcatcaagacacaccaaaatcaggaaaacagcagaacataaaaacgggctggcttctgaagcactaagttaaccttagtaatcaagaagacaagcctcccccaagtacagcaagatctattgtgaaaatacgtgcctaaaattttcctatttagcttttcacattactctttccattagtaaagtctattccatagttatacagagtttttgtctaacttaatgtgggattttattagaaaatataacaccctcttctcactgttcaggtgagaaacacagccctattcagagtgggatggcttgtttcctgccttgagttttcagctcaaaaatgcctctaagatcccaaccctcctagactgatgaagggatggaactcctaagaccagctcttgttcttttacttctacagtcatttcttaacttcatctaatagtaattcttttgacaggatctgcaagttctatgatttttgcaagcagatttttataagcagagttatctagcaatatgtggaagggaaacacattgcaggctactcacagagtctgtgttatacccatatttggaacagatgcagatataaaatgcacttggttccatgagagaagcttcaaaagaggaaaggccaatgtaatgggcctagaacatgacaactgaagtgtccattgacatcatgtcaaacaacaatctgcctgctatgttctgacccattctcttcttaagattttgacctttactttggtctcattatgagaatgaaaagttcaatttttttaaataaaattaaccaatatatttataggatttaaaaaaatcagaagcaaccagcgtttggcttcagctggactaatctaatggcaagtatcccttccgcaccatatgatttttgttgatctgcttcttcactgctaggcagttgtgaagtttggctctcttctttaacaatacccagcttcttcactcagtgttctaaaccaggatctcaatccttctcctgagtgtccacatctactcctaggctctcttctctactcagtctttacataggcaatgtcttctatacccaaacataagtgaggtaagtctatctactctgcctctaaatatctctcaaaatctgatcatttctcttctccccactccctctactctagaccatgatgccttcatttcccacctgaattactgcagtagcttcctgattggtctctccacagaaactcttgttgcactctcctatccaatctctatcagtagccacagtcatctttttttaaaaaggcaaatttgatttaaccccattcttaattggtttagcattaccatattcttagtcttgctgacgtctgtatcctgtgtacctcgtcagcctcatctggctccatggtattgcttaatttacagttagattatgtttttcttctctcaattctttgattataccatgctctattttgcttcaaggcctttgcacatactaagaaaaattaaagttttaaaaaaagaacttctacaattttcaaccaccacgactacccaatgacctgcatctgtgcccatatactctacgttctcttattttactatggataaactgtccttgatccaaaaccaagactagtcccttctgttgtacactggatcaatccctttttatctgctcaaagacattatcccagcaatttcctgcaacatcaatttttccctctccactgaattgtccccctcagcatacaaccatgctgttaattcctcaacttaaaaaaaacaatcttggctcacattgtccttcacctatatctcatcactcccctttcctctgcagagaaactctagcagcatggttggcttcctcaagtcctctaatcctttattcaaagttacattctcagtgagatcttccatggttaccctaaaactctaacctcttgatccatgagagcagggatatttgtcaacattatatgctatgtgactccaatgcatatctccattaaggaaggcactatgcctctttttgctcactgctgtatcttgagtacctggcattatccctgtttcagagagggcgcacaatcactctggtgaatgaaggaaccaatgcacgagcattataaccacttcacctctccttggccccctccctgccacaagaagcagatagttatggtattttaatactttacaagcttaaatatcctggtaatttgtgcagtcagtaacttcttactaaagttactaagtctaaatcaaggcttggcaaagtttttctgtaaagcaccagatattaaacattgttgactctgcaggccgaatggtctccatctccactactctactctgcagtagtagtgcaagctccaagaaaccttcatttataaaacaagtggcaggcagcatttggcccacaggctgtagtgtgacaacccttagtctaacttgtttttatggatgttaactcatcttctaaacaggagcacatgaaaatgataacagcattgttcccatccaggtagcaaggtcagccctttccattgcctcacaggcccttggagccctcacaagtgaggatctcatctgttacccccacctctcaactcaatctctggttcgctactagtttacaacataaagttagtttacaaaggcaattatcgccaacagtaaagattaaagaacagtaaaataacatctctctacttgaggatatcacatgaattttatatccaatatacttcaaatcctattatgcttcattgtctcatgacccctccaaggaaagtatattagagcttttcttcgtctagagccttaatagaaagacaaactccaggagggaggggaaaatgtagattcttataatcctttcagaggcatttacaaaaacctatatttttacattttgtagatgacatatttctctctcaggtgtataggcctatgtcattcaaaacaatcttccatttgcttgtgcatacaaaatgctgcaacataataatttaaatgcaaataagaagccacccatagacaactttattttgtggttgtgatctgaggctaatcgaagtagtcattttccagatgaaaaatgtcttttaaataagagaaatggtacagatgtttcaactgatgccaattttatttttgcaaatgtcatctgagtttggttttctcatcaattaacagactctaatatagcattgtacaaagtcaattttctaaaaatcattttcaaactgttaaagcaataatctgtggcagtttaataacagagcttagtgttatgtgacaatacatattattttgaatggacaagggttttagttaatggtgccaatttacaacaatgaaatctaacttactgtccactgtcaaggcagattttcactgtatttaagatattcctagcagagaacttttatagttgttaaaagtacattatttctttcaggccaacaaatcagaaaccatttagccccaaatatataatttcctaattggtaaattaaactacaggtgtggggaatttttatggcgagctgacctggagttttctcagaatctcaaatgccccaggaatcatagtcaccttcattttcttttcataccacgtaagggttactttggcataatcggagtcagcttatgtcactctcagataattattgatgtcagcagggccttcttcagaaagagggaagtaacttcagtcagaaattgcaaaacattcaaatattttagaaagaaaattaaagattagatgccaagatggccaactagatagcttctgcacagcaaagaaactaacagagtaaacagaagacctgcaaaatggaagaatatatttgcaaactatgcatatgacaatggcctaattttcactatctacagggaacttaaacaaatcaataagcaaaaaacacataaccccattaaaaagtgggcaaagggcttcatgaacagaagacatacaagtggccaagaaatatatgaaaaatgcttacgtcactaatcatcagagaaatgcaaatcaaaaccacaataagataccatctcacaccagtcaggatggctattataaaaaagtcaaaaaatgacagatactggcgaggctgaaaagggaatgcttatacaccattggtgggaatgtaaattagtccagttattttggaaagcagtctggagatttctcaaagaacttaaaacagaattaccatttgacccagcaatcccattaccaggtatatacttccacaaaaataaataattctactaaaaagacacatgcactcatatgctcatcactgcactattcacaatagcaaagatgtggaatcaacccaggtgcccatcaatagtagattgcataaagaaaatgtggtacatatatactatagaatactatgcaaccccaaaacagaataaaatcatgtcttttgcagcaacatgaatggagctgggagccatatgcttttttttttttttttttttttttttgagagtgagtttcactcttattgcccaggctggagtgcaatgacccgatctcagctcaccacaacctccacctcctgggttcaagcaattctcctactttagcctcccgagtagctgggattacaggcatgcgccaccacgcctggctaattttgtagttttagtagagacggggtttctccatgttggtcaggctggtttagaactcctgacctcaggtgatccacctgtctcgacctcccaaagtgctgggattacaggtgtgagccactgcgcccggcccactgggtgccatattcttaagcaaattaacacaggaatggaaaaccaaatattgcacattctcacttataagtgagagctaagcattcagcacacgtggacatatgtataaatatgggaacaatagacaccatggactactagagggtagagggagggtgggatgcattaaaaaattacctatcttgtactatgctcactatcagggtaatgggatataccatacctaagcatcatgcaataatcccatgtaacaaatctgtacaaatacccatatatctaaaataaaagttgaaataaaaaaatatataaagctagaaccatataacagccctccatcattagcagttttagaaatttggatagaatacaaaataatagtgaaacctagatttgatattctggcatatctaggttaagataaaataccttaacctagatatttgatcttggttctttctgatactgaggaaattgtttaacttctccaggcttctgttttcttataagtaaaataagataataatggtacctaccgtagcatcatcctgagtatgaaacacaatataacatatccagtgtttagcataaggtctggcacgtgataatgtattattctccattcttcaaatttattattgacaatttgagatggaagataaaagacaaagaagaaagagtactgtgttcatcaaggaagaaaaggcaccccccccccgaaaaaaagagaagcatcttgatataatatgtagtttctttaatatttctattattgatgccagaacctatttgtaaactattttaattgcattttctgttaagccaaccaatttcttctaagctacaggaaatattactgcatgtgcaactaatattctaaagcattcagaaattcaaatatctacccacttctcttcacaagtccaccattcacattagaacaaggcattaatttatttgaaatgattcacatctcacaaagaatggcttttgtagatcctttctattttacaaaggaagactatctgaagaatagatattttattaggaggaaagatgggagaagaaaacaaatttggaagaatggaattataattgaggtaaaaagctgtgaatataattgaatagaatatattaaggttgaaagaagatgcctggagggaaaggagtactctcaagggtttctgagaatgttgtgttcacctgctaatgtctcacctgccaggtcttgaccctgatgataaggtttggggaatgacttgtctctgaaatacttcttgacatggtttggctgtgtccccacccatatctcatcttttgaattgtagttctcataatccccatgtgtcacaggagagacctggtagaaggtaattgaaccatggggacagttacctccatactgttctcgtgatagtgagttctcatgagagctgatggttttatagaggcttttccccactttgctctgcagttctccttgctgccaccacgtgaagaagggtttgcttccccttctgccatgattgtaagtttcctgaggcctccccagccatgctgaactgtgagtcaattaaacctctttcttttgtaaattaccccgtctagggcagttctttatagcagtgtgagaacggacaaatacacttctcaagtacttcacacatgtatgcacactcctgtgactgcatgcacactacaacaaagacagtaacttctggagaacaaggacacctgtaacaaaagttaaatgcaacttttttcatctttttcctcacgattgtcttcaaaatgtttgtatcaggaacaacgctgataaatttagcactaggtgtgagggagagttagacaaagatatgttccagtattaaaagagaagctttctcagtggactaacagcagagttaattttccttcagggacaacttttgattaaagacttaaacgttagacctaaaaccataaaaaccctagaagaaaacctaggcaataccattcaggacacaggcatgggcaaggacttcatgtctaaaacaccaaaagcaatggcaacaaaagccaaaattgacaaatgggatctaattaaactaaagagcttctgtacagcaaaagaaactatcatcagagtgaacaggcaacctacaaaatgggagaaaattttcgcaacctactcatctgacaaagggctaatatccagaatctacaatgaacttaaacaaatttacaagaaaaaaacaaacaaccccatcaaaaagtggtgaaggacatgaacagacacttctcaaaagaagacatttgtgcagccaaaaaacacatgaaaaaatgctcaccatcactggccatcagagaaatgcaaatcaaaaccacaatgagataccatctcacaccagttagaatggtgatcattaaaaagtcaggaagcaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgtggccataaaaaatgatgaggtcatgtcctttgtagggacatggatgaaattggaaatcatcattctcagtaaactatcgcaagaacaaaaaaccaaacaccgcatattctcacttataggtgggaattgaacaatgagatcacatggacacaggaaggggaacatcacactctggggactgttgtggggtggggggaggggggagggatagctttgggagatatacctaatgctagatgacgagttagtgggtgcagcgcaccagcatggcacatgtatacatacgtaactaacctgcacaatgtacacatgtaccctaaaacttaaagtataataataaaaaataaataaataaataaaaaagagagagagacaaagagagggaaacagagaggaagagacagagagagaaattaaaacaaaatagcacttatataggaagaatattctccagagggaagagacatgcagtttataatgtcatgcacttaattaattgtagtgcaaaccactctcattaggagtccattgtaagcctaccagcttcaacagtcaaaagggaataattgcaatgaagcccagtccttgtctccttattgagagctttaaaaactttgccacggacatctcaagagactcttctcttcactaccctccttttgttatctttttatgtaaaaaaataatgcattaaaataaaattcaatcttcccctttggtttttccttactaactttactactaattttacacctaaacttctagcaaagtcagggcactttctgtactttagtttctagagtgatcaagggctgtgatttgcaaacaatagaaatgatggattgacataagcaggaaaaggaatccatcaaaagaatataggatagaactcagaataaacagggagcttgaagaagcagacttgagcagaatccagtgaagataataagcagctgggaggctggatcagtctgcctgggaccctattcctcacctgctgggcacacactgctcttcgccacactgtcagcagctacaacagatgccactggcccttccactcgatagtggcatatgtgatggtctgagccatcccctcaagattcaaagtcctggctaggaacatcagattgactacattgaggttatagaccctccctctgtctgccagaggggcatgcagagggaatgcatattcctactcccctagtggaaggctaggtcctttctctcacctattctgaaactcccccaaaacagaagaggattggatactgagtagcccagtatctacccagttgtctaccctaagaccttacctctcttgacttctcatccccccagctatcccaaggactgtgtttcctaaatttccaagcaatataggtgacaataatataagtctaaaaaaataaaataagggacaaaggatccggcttgtcagccaaatgagttgatcaaacctaggtcgctcacaaagaaggtaaaaactgaaaccaaaatacttttctgtcccagtgctaaacaatttggagtcaaagtttaaatgcctgttttaatgctgagcacatggagaccaagcaaaaataacttaggtacttgctccaggaaatgtttgcttttggaaaataaggctgtaaatggcctgaaccagcttattcaataagactaacagttcacttatcaaggttcactttgagaacctcactgctcttagagaccccactaatccagaactgctaggctctaaattctgcctaatgccagccatttttccaccttgcaagatcaggctcccagacctggctataaaactctacaaatatcttccctttacttcccctttccaaaatactactaattttaaaggtgatgtcctcccttatttcactgagatgaatacttagtttcacttggttctgctggtgatcttttttggggagtcggtcaccaacagaggaatggttatacaaagtgatctggagaattctgaaaggcccaagtatccctacctcccaccatagttgccaaaacttcctattggattgcctgtgaaaaacaaaagttcatgaatttttaaaatctacatataaaatattcccagtacctcaaactgtgtctgtcatatactaagacacaatagatgaatttgtatgaatgaaattgtaaataaataataaattttaatgtaattttattgattggataaacacttattttcattaatagaaatcaatgtgagaaaaataaaaaaccacaattttgtaaatcaaaaaattcaaattattttcacattgttttccagttctcagccacatgcaggcatatattttgcagtgttttaactttaacctggatatacttgtatattttgcttttctcctcaaaacattctaaatacttccatgttaccatatacttatcataataatcattttaatgactatatcataatccataagtatacattttcactgtcattcattcagttttgccaactgcaaaggatgctttgacatatagagttttatagaaacactctcatctcagtttttttcagtggatattgaacagaacataccagaatttataagccaaaataagaagatatgagtcttggtctttatttgttgcagataatcctctgaaaatcaattaaccttgacatttcttcttaagacaaatgaaggctcctctgcttgggtctcctccactgagtttaattaaaaccctttgctaaggcactgtgtacatatgatatactctacagttgccaaattctagtcacagatactgtttcaaacagtgtaaattaaacaaacaaacaaaaaaatgacccagacaaggtcaccaaagagaagagaataaaaaaattgtgtgcacatatgtattacatcaaggatcttggttccaggtctcaatcatacaactctatcaaatagccttaaataaaaattagcatgatcataggttgctatgacttaaagtctgcaaataatatgttacatccaagctaagggcaaaaccgtatgcacgtgcctttctgttgtttcactaaggtcacaacagtaaccccgtttacagacgaatgttttctacaaatagaatttttccacattgaattcaattttattctttattttattgctaaaattggcagcatgacgaactggaataatgcttgaatgccagaaatagtatttaagaatatataagaaagcaatagtgtttaattcaattattatttctaagaactaaaattctcaaaagcaaactcaaatgctaattcaaaatacctaagatgttattattgctggcaaaatattagagttagatataaaaattatttaaaataaactaatactttgaaaatgataattcatattttttaaaaaatcagatccttctccatactccagagactgtaataaatctgggaaacagctgagtaatctggaagatgcagaagtactgaaacaccagaagctcctattctccaatagatgctgaaatgtactaggaacccaaggacaccattgcagacctacttactgggactaggacaaacgttatggtctttccaaaagacctactagctatgctcaacttcttgttccctggtttaacacccatcagtcagaggacaggtggaccaattattgaaaatattttggaatgctgtttcataatcatatctcagacaaccacctgatacagagcttcttcctctccctgtgttctttcaacttcttatccccatgttgcactgtgatttctctcccctgtctatcctcccattctcattctttccatattattcaatcagtttctctggatcccttttcccatggcaaacagacttcacttcatcctcagccttgccaccaaaaagtcatcccagatcctaacctctctcaaatttgactcttcgctaaagatgtcacttccctgtggtggattcagggtaaggtactctggttctcaatgccctctctgggtcccaagatgaaatgggtgctctcctggttactcacttttacttactcctccaccttcttgtaaaaacttctcgtttgacatctatgccaatcaactctacttccttgtctctgacttctgccagtccctttggtcagtttctcattcactgaaaactgcccacctttttgtcatcttgacagcttgaatcctgctgcagtcctgggtgactttgatgttgatgtggaggcatcacctcatgccccgatctctcagttcctcagctacatcttttccaaggcagtcaccctcttccctgacacccttctatgtcttgaacataccttaaattacctctagcacttacatcttaaagttcattctgtcctccaaatatgatctatcttttgtttgctcagttattctaattcacctgtttgacatcatagagatttctagagaccttgaatactttctatatcagtatcttcttatattcactcatttccataaccagctaagttgccacaattcatcatttctatcactttctttcaaataccttcaaatcccttgccctatttttcttatattgcacctgctttccaattttggaataatccaactgtttgccttttcagtgtttatatcatagctgcttagcatactggaaaatattacaaaacctcacatattggttacatgaaaagttaatggtaagttttatcaactgtaccttcaattggcattctggtctagccatgttttagcagtttttatttagctaagtgcagacactctactttaatctcatccctggactttgacctgctgttctctcttcctggaaccatcttattttggtctcaggttaggtgttagttcctcacaagccaaagtgagtttgctccccagtgagatttcatatttctccatttgtctgcagtcatatttgtacattatatgaaacaaacaagattatagtggtctattttcttgcacgtgccctacttgattcaatcccctgtgaaagaaaaggctgtgttttgtcttgttgagccttgggtcgccagtgcatacctcagtatacagcaaatatcagactctcactatttgttggttgaatataaagtgaatacattaatatatgactaatgcatgattgaggggatcagtatatttaccagaatcccttgcatgtatgattttattgtttttaattctgttttgtaatatgtgtataaatacaggcatacttgttttattgtgctttgcttgatatggtttgggtatttataccctccaaatctcatgttgagatttgattcccaatgttgatggtgggcctagtgggagatgcttgggtcatggggtcagagccctcataaatggcttggtgccctccctgtggtcatgagttattgtgagatctaattgtttaaagaatatggcacctgccccctctcttattccctctcttgtcatctgacaaagctgctcccccttcaccttctgccatgaataaaagcttcctgaagcctcacaaaagccaagcagatgctggtgccttgcccagacaccctgctaaacaatgagccaaataaatctcttttctttgtaaattagccagtcacacgtattcctttatagccatgcaaaacagactaacacattgctttatcacacttcacaatattgtgcttttaccaattgaatattgtggcaatgctgcatcaagcaagtctattggcaccattttttccaataacatgtactcactttgtgtttctatgtcatattttggtattctcagaatattatgaactttttcattattattatatctgctagggtgatctgtgatcagtggtcttggatgttactattttaatttttggggtgccacaaaccatgcccatgtaagacagtaaacttaatggattaatgttgcatgtattctcactgcttcactgactggccattccccaatttctctcttttcctcaggtctccctattccctgacacacaataatattgaaattaggccaattaataaccttacaatggcctataagtgttcaagtgaaaggaagagttacaggtctctcgcattaagtcaaaagctagacataataaggcttagtgaggaagacatgtcaaaagccaagacaggctgaaagccaggccttttgtaccagttagccaagttgtgaatacaaagaaaaagcttttgaaggaaattaaaagtactactctggtgaacacagaaatgacaagaaagccaaacagccttattgataatgtggagaaaacttcagtggtctggatagaagatcaaaccagccgcaacattcccttaagccaaagcctaatcccaaacaaggccctaactctctttaattcaatgaagtctgagagagttaaggactgcagacgaaaagttggatgccagcagagggtggttcatgatgtttaaagaaaagaagccatctccaatacataaaagtacagggtgcacaagctacccatttaacaaagctgcataaataccctctgaacctaaaataaaagctggaaaaaaaaaggagtgtgaagtgaagcagcaagtgctgatgtataaactgtgacaagttatccagaaagtctaactaagatcaatgatgaaggcactacactaaacaacagattttcagtggagacaaaatagccttctattgggagaagataccatctacaactttcatagctagagaggaaaagtcaatgcctggcttcaaagcttcaaaggaaaatctgactctcctggtaggagctaatgcagatggtaactttaagttgaagacaatgttcatttaatattccaataattctagggcctttgagaattgtgctaaatctactttgcctgtgctttataaataaaaaaataaggactggatgacagtgtatctgtttacagcatggtttactaaatattttgagcccactgttgagacatactgctcagaaaaaaagattcttttcaaaatatgactgttcattgacaatgcacctagtcactcaagagctttgctggagatgcacaaggaggttaatgttatcatgcctgctaccacaacattcattctgaagcccatgttccaaggagtcatttcaacttttaagccttattatttaagaaatacatttcatagggctatcgctatgatagacacttatttctctgatggatcagggcaaagtaagtcgaaaactttctggacaggattcaccattctagatgccattaagaatatttgtgatccataggcataggtcaaaatatcaacattaacaagagtttggaagaaattgattccaaccctcatggatgactctgaggggttcaagtggagaaagtaactgcagatgtgctggaaattgcaagagaactagaattagaaatggaacctgaagttgtaatgaaattactgcaatcttatgataaaacttgaaagaatgaggagttgtttcttggatgaagcaaagaaaatggtttcttgagacagaatctacttctggtaaagatgctgtgaacattgttgaaatggcaacaaaggatttaaaatattatataaacttagtagataaaccagcagcagcgtttaagaggattgactccaattttgaaagaagttctactatgggtaaaatgctgtcaaacaccattgcatgctacagagaaattgttcatgaaaggaggaatcaatggatgtggcaattttcactgtagtgttattctaagaaattgtcacagccaccccaatcttcagcaaccaccaccttgatcagtcagcagtcatgaacattgaggcaagactctccaccagcaaaatgtttctgacttgctgaaggctctaatggttgttagcatttttttttttagcaattaagtatttcttacttaaggcatgtacattgttttcttagagacaatgctattacacactacaatatagtgtaaacataagttttatatgcactggaaagccaaaaagtatgtgtgacttgctttattgtgatatttgctttattgcagtggcctggatctgaacccacaatatctccgaggtatgtctggtatataccttcaagaaataaagttagtctgaattaaataatgttggagaaataagaaagccaaaatcacatgttaactgagacacagaagagttagtagaggagtaaagagggagaccacccttgaaatatgtgatcaaaagctgggaaagttctagaaagtgaatggtaaagaagtatagtatttatgtattataaactttatattctaaatattatttatatattataaattacatatttaaaaaacaagtattctaaagtttttaatatctatatctagctttcacacagcaaggggtgtgtgtgtgtgtgtgtgtgtttatgataacatttagcactaatcacaactgtttaggaattacgtcatggtaaaattcagaaccccctgagaaaaagccctcctgggaatgtggacaaaggtctcactttaacgaagctcagagccacgaacttcagtgtaaatgatgctaatctattaaacaaagttgacccatcatccagatatgttgcatacatgacttcaaacaacataactaaatagcatttatttttgttgaattcctcagatttgaaataatctaaaagtgcccggctccatctacttcctttcaactggagggcagattctaaatgaatgagagaaatgggatgaaaaataatatggaaattctaagttctagaaagaattctaagtacctagaatttttttttggttggggggaagtgtgtttaacccaagaagtgatatattttttctatagtttttttctatatacagattttttaaaagaaaacttttgccattttgtagtgctcatttgtagagaaaaaaagtttgattacttcatcctttaatgaatttcaactgaaaatatatttttcattttggatttctccaagcaatgcactctggtcatgttaagtttgaatcagtattatacattatgcaatacataataattaaacaaatacaatttggtcagaatatttttacctgcatttttttcataaacacaaatactgtaaaacagaataaaaaggcttttaaagaattataagctctccttaaacacttcagtgattcacagttctgcattacagaaggatggtcagccagggcagtgtttgttgcaaagaaactatctatggagtggaacaattattattgagtgatggaaataatcaaaggaaagggctttgttgagttctgccttgtgcttaatatagtattgtgccctagcacttttcacggtaaaataaatgcttccttgggtttgccttaaaaaatatgggattccccaaccaatctctattactaaaacaagtcatattggcacaagaaagttttgaaaatagggactagatgctctgatgttggtgaacgcagaagttgtcaccctctttagtgtttttaacaacgtgggagcctggtgaaatagaagcctttgatttctaaaggtaaaccttcccctggtacatgctgctttactgacacacagatataaagtaaaatactgtggtatagtatcagtccattcagcatatccttaatggggacaccagaatgtactacaataatgaaaaggtactgtgataacctgaaaaagacactggagtttaatcatgatcatattattttgtaaattgaaggcatggcagatatagcataaaccttttagagagtctatgataggtgagaaaaaagtcagcatttttacattgcttattttagattagattcaagaattgccctgattctggaaataagatgatttttatccagatattttaaagtgctccatcactcttagaatctaattttaatcttgaaaatcacaaatttggggccaggcatgatggctcacgcctgtagtcccagcactttgggaggctgaggcaggaagatttcataaggccaggagtttgagaacagcctggccaacatggcaaaaccccatttctactaaaaatacaaaaattagcctggtgtggtgggacatgcctgtcgtctcagctacttgggaggctgaggcaggagaatcgcttgaacctggggggcggaggttgcagtgagccgagatcacgccatttcactccagcctgggtgacacagcaagactccgtttcaaaaacaaaacaaaacaaaacaaaacaaaaataatcacaaatttacaaagtttaaggcaaagacagataagattaaatcagaacaatgctttaaaataaaaggcttgtgatattttgtgagtatcctgagaagtttagataaacactacaatcataaattgcatgtaaatcaatcaaaaccaaaagaatccaattttgtctgcttagtatgcatcttcaagattattggaagtattgtttcccaatttttggcattgattacttttaaaatttcatctagctcaagaatactatatttctacagaatgtttcacaatcatgattatgtgttttattttcaattttgggaagctttgcctagtgggttatagatcttccatataacattcaataagaacttagataaatcacttaaagcttgaacatacatcaaacatgaaggtacaggcttcatggtagactgtgaaatacaatctctagctttataaacacccttatatccaaattatttaaaatatgaaatgcccattaataccttcttaagtttaaaaggccaaatttgaaagatcagatgtgtctgatccagccttctgtttttccttttttattttctgtttggattttgattcaggaataaattgctgaaaacaatcttttttttaatgttctctctaacgtactgtttgtactcaagagcacaagatgaagagtggttagtcaaagaatccaatgtctaactggcatctgtgaccagtccctctgtgaatagcacacaaatcaaggaaatatttctggaagatccttgtaaaatgaacccttatatgaataaagtaattcttctctctctgttgggtagttaaatttatccccaaaagtgaccatgtcttcttttacattcttttcattttctttttttataggacatagtgatacgaaggtacacagtgtacttcttcagacaggtaataggatactagggatgagaaagtgtttgtaacattctccacccacccatatccctgaatatacatctatccagaggtgtgtcatcatgtcacaagggaataagttgctcttggctctcattttattatagcagatgcagcaatgaaatgtaagtagagagttttattgctacctcccccacattttcttcattcccataacttcccacctgtgaactgggaatgatttccacatgtgtggcaagctagactctccttagattgtctaggggcacatggaccacatgtgggaatgtaagtcagtgcccaagatagggctgaaaggagatcctaattcctcctaaggattctaagcaggaaactatttagaagtcagcaaggttgtggaagaagtgaagcagaagtagggagaccaccattctcattccaaacataactgaacagcacttgaaagcaagacatgtgtgcgggaagatgccagatacagacttctgaacagaaatgtcacaagtccataataactgtaactttctgaaacaggagccaatttctgattgactcccaaatctgctagaacatccatctctaccccaagagttatttgtagagtatctctgaagccaattccaataagtaaacaaatattaacaacaacaaacattatttgttctaatattttcccagcataggagttgcagtttttgatgttatatattaagtattcacaatatgtgaaaaatggggataggtagtataccattagaacaaacccatgaagtaggtgctcgcattattcctacttttgcttttttaaaattaggaacttggagtggttaagtaccttcacaagatggtagtaggtgggagacaggactcaaattcagaccatctatgtccagagccccactcttgtctactcactacccggccatcagccaccataagcatgctgttgcttcattctcaactcttctctgcctgccctcttagtgcttggatgtcttatttgccaccatccaatattcaagggaccagctgtccttgtctccaagtgaaattgctctgcaggttaaatgtcattcttgttttccccttattaaggtgggtccacttcttgccttacagtttcctctccctgctgcacacttccctcatatttcacaggtccctaggattaccaacatattcaaagtaaacataaagtaaaaattcaagacactgtttagaacaaaatattcactttataatacacatgtctaacaaaatactcatgtctagaatatacaaagagccctcagaaatcaataagtaaaataaaaactgaacaaatgtctgaatggtcataacacaaagaagatatccaaatgttcaataaacacatcaaaaggtaagcaatattcctactcatcggggaaatgtaaattaaaaccacagtagtataccactacacattcaccagaatgaccaaaatgaaaaagactgaaaatactaagtgttggtgagaatgtagaacaactgtacctactacgtattgctggtgggagggtaaaagagtacaacactttagaaaactgttgggcagtaatgaaaataaatatttgcctccttatgactcagaaatgctactcctgggaatatacccaaaagaaatgagtgcatatattcacaaaaagactggtataagtgtacatagcagcttcattcataatcccctcaaactagaaacaacccaaaggttcattagtaagagagtaaaaataaatacattatgctatatttatgcaataaaaacaagctgctgagatatacacaaacatggatatcaaaaaaaaattttgactaatagaagccagacacaacaagtacatacagtacaattccatttatgtgaagtccaagaggaggcaaaataacctttagtgatcagttgagaaataggatggtgattacatgacagtataaatacatattaattcaagatgtataatgcatgtaaattataccttaataaaaagattttatgaaaggtaatagaaaattatttaggaggaaaatatgaaaaactgactttccaaattacttctatgccacgttcataacatttcaagtcattaatagctgtctctcttacttcgaggaaggtcagtaaacagccatgaagcctgaattcgcctaccctgtacagaaagttaactggcagatgaattcagggttataggcatcccaggtcttaataattctgttttctgttcatttacagtttcttaagtttgctaaatcacagcatacacacaacctaacagtttgggcatactcaaaagaaattgttaaaaagtgtacatttgaacacattcgcattgcttgggaaaaaaagtcaaagtagaaatatggaagtgtgaataactaaaagtccttttgaactcagtctcttgacccaagtacttcatgaggaagctaatagctgtcatctacgacacttatttctgcacatcaaagttctttttcagaaactaatgattctcagggccatactgtggctttctaaaggggtggtacaagtctctagacccactgcctgacacttgacaaagaaagtatctggcatactgatatgccagaagaaagagcaaaaggctatgatgttaagaaagaaaggaaaataaatctggagggcatgaaaagtcgccttgaccatcaaagatttgcaattgctaaggtatggtctcagtataggttggcaatgggacttaaaggcatactaacctttaataatgaggcaatgggctggagacaactcagttaaaataggctaaatttcccattagctctttctgacagctgtaaaggaatctggggctcctggttaactaaaatggctacagaatataagcccgaacttcacctttcgttttttgttttttgttttttgttttttattttgagacagagtctcactctgtcgcccaggctggagtgcagtggcgtaatctcggctcactgcaacctctgcctcccgggttcacgccatcctcttgcctcagcctcctgagtagctgggactgcaggcacacactgccaagcccggctaatttttttttgtatttttcgtacagactgggtttcaccgtgttagccaggatggtcttgatctcctcaccttgtgatctgcccgcctcagcctcccaaagtgctgggattacaggcgtgagccactgcacctggccccgcactttaccttctacttctcctccaaagcttcgacattccagaaagttatactcctgaattttctagtcctcaatattcaattcgcaaattgttctggcttccaaatgtaataacaatacctttaatatctacttagtttggttcttgttgattggccattattgtctattgtttcttttgaaatgaaacccttgttccatctttcaaaaagaaaaattattttcttcataatattggataaatttgtaaatagtaagcatgacattgcttacatagtcattccttggtatatgtaggggattggtttcgggtctaccacatgtaccaaaattcatgcatactcaattcttgcaattggccctgtggaacccacatatatgaaaagtcagcccatctgtatacatgagtttcacatcccaggaatactatattttccatttgtgtttggttgaaaagaatcctcatataaaggaacctgtgcagttcaaacctgtattgttcaagggtcaattgtacttgattcttaaatcttaatgaagatggaaatgaatgtgaatcaacagaaatgctgggacatagacaattcggaaccctgaagttccttggcacttggaaactgtttttagcaatacattctctctctgacacccaggccagggtgcagtggcaggatcttgactcactgcaacctctgccttcaagcaggctgaagcgatcctcctgcatcagcctgctgagtagctgggaccacaggcgcatgccactacacccagttatttatttgtgtttttgatagagacaaggtcttgccatgttgcccaggcttgcctcaaattcatgaggtcaatcaatccctgcctcggcctcccaaagtgctgggattacaggcatgagccactgcgcccagctcaagattttagattacacacaatatccaactacatagagatatattaggtatattgcatcattttattttaagggcacatgatataacaccaactcaaaatgagaaatcatggttagcaaccaaaatttttgagataccaaagctaattgaatatatcagggctttaaattagtgcattttaattttaattataatctcttcttccacaagtgtgaagaaagtaagataactattctaagataacctggtgtgtagtaaacagttaatcaggactgtgtcaattaaatataggaagacctgtttgaaacattggcctttagcagacctgactttcaggagtgatccaccattctctaaatggtaagactggctcaatttgcctaaactgtctgtgcaaataatgtggtttatgctgcatatccactttccttctggaaatctggaagtttgtatatcctaggcagagggtacctaagtgactggcctccagtaaaaactctaggtactgagtctttaataggcttccctggtaaaggcatccctggtgaacacatttcacaagtgttgtctcaactcattactggaggaattaagtgtatcttgtcttacttcacttggggactcttggaagcttatgtttggtttcctccagattttgttccatctacctttccctttgcttattttgcattgaatccttttgctataacacatcagagccatgaatatgactatttgctgaattatgagagctctgctagcaaatcattgaacccgagggtgatcttgggatccctggatacacctgatatctgtgaatctcttctacacagaatgaacggcagcaatgttatttccaaagaaaggagaaatagtttcaggggaacagcatttttcaaaaaatgttcaggtcaagctgtcatataaaattcccatctgctttagtatgagtctgatcaatgtgtgtgcattcttctttaaacacatagttcaattacaacaacagaaacaaaatatatttcctcttttcattgcttcaaggtgaatatttgttttcttattatttatctagtagtattttcctcatacctttttctaacacaggtcccttagactggtcaataacaagtaaaacagctaaattcagtatctttgagttgagttactagccaaatttcctctgagcacaaccttcctaactttaacaagatccaaaagacattttccccagagatgcctttaacttggcagagaatgtgggaccatcacatttgtagcatagtaattgttttgttcttgtagttttagcaaatgttcaagagtctatctatgtatggcccactggcttcatcctctttcctttctatccaggcttcttaaaaatgcagctggtcacaagaacaaataattgatgtgcccaatatccttactttctttcacaatttttaaactggtgacattgctttaaagtgtaaaactccattggtaaacaacacgaaaaagaataaaaacaaaaattataccctgcaaagtaggaaataaaaatgttacatgatggagacgtggctgtggctgactcctctataagtactaatgctaaataaaatcaccttatactgggagctgaaatagtattctggtaagcaatacctcaaaatgtcaaaggcaaaatttttagactcatgaataccattgcatatttcttttgattctaattacaatacaatttattcttgattccaaattcattttgcatcagtgaacatttcctattgtttctagacatgtatcactacatggtaatttgtccattagttctcatttgttaaaatgtcttctatcaagtcacatatggccaatattaattttccaagtacaactgccctttggcaaatgtttattagcattcaccaatacattttcagctcttccatgtaaaacaatttcactaaaatgtcttctcctgcagatatagaaatgtcacctgagaaattcatccttttttttttgactctagaaaccccattgttctcccactcaaatcaagcaatgagccacaaaaactcaaaagaccacagacaacaatcaccatctaaaatataaaatggggaaatgacatctgagggcactcacccactggattctgcagaagtgatagcaatcagcggcagaatcttcagggggaggctggttggtcgttgaatgttctctgattcacttttcaagtcagcttgttccaactgtctgaaggcgagagggggaagctgaatattgcgacatgaaagtctccggacaagatagggttccattccgcggaaagggtcttcctcttcattactggaatgtagtgtttcctcagaggcctgaggtaataattcaagaaagtacatataatcaacaaaaatcacactgtttatcattacataatggcttaatactttcctgggaaagaaattaagtaaaatgtatacatgaaaaatgctatctagaaaacagtgacattaactgaacaatatttgattaactaaaatctaaatttatttttaaaatagcaaatttgttcaccaggtgtggcttggttaaaacagttaactaacatcttcagtaatcttagaatttattagctttgtgtgtgaattctataaaatcaaggataaatcaaaatgtttttataacttctatgaaatgaattgcaaacatcattaaatatatacattgacatatgcatgtgtcatatatatatatatatatatatatatatacacacacacacatacagttatgcatcacttgataatgatccattctgagaaatgcatcattaggaaatttccttgtgtgaacatcacagtgtatttaaacaaacctagatggtacattgttactgtaataaatactgtaggcaattataacacaatgggaaatatttgtgtatctaagtatatctaaacataggaaagatacagtaaaaatacagtattataatcttatggccaccatggtatgtatggtccatagttgactaaaatgttatatagcacatgactgtatatttatatatatctttcttacatgcatgcccatgaagagagaggaagaaaagtcctattttttctgcatatttaaggccatatttgaaacatatgttttcatatgtcacatttactcagatatactcttgccaatttttataagactgagagggtagtaagaaaaaaaagactttaaaagaaacttgaggacccagtagaactgtatttaagtcacagctcagcagaattttgcaaatttgatccatgttatccacatgcaaaggtaaacccaggtcaaaagttaatattttgattctagttgagaaaaatatactatcacatgagcaataattatttccaaatggctggaaagtctactctagcaatatttattatatccacatactgagaattatagaatcaccaaatgttataacatgcttctatagagtgttgggtttttgaatctttgcactgccactttactatttgtattgatagtgtgttgcttagtctctctaaggcttctgtttctttattataaaaatgggactaatatttacatacaagaattaaatgagatcatgcatatgatgtgcatagttcattacttgcattgggattagcactcatatatggcaatttccttcccttctgagttttacaggtgaagaagtttatatttctcaaaattaaccagctggctgaaagttggacattcatcgagcttggaacatccagacctcatttattacactccttactatacaactatctttgggcaagtcacttaggctcattgaggttgtttctccatctgaagactgagataataatatttacctctcggagtcattgtgtggaccaaatatataaagtatttgaagcaccaatatctggcaaagagtttgcactcaacaaaatggcagctgttattataatccaggctaatttcccctttctccatagctctatgctgtctttgatgctcactcttcacattgattcccaaatagaaaatttttgtcttcctgatttatatcttgaaaaaaggtaaaaggatgtgagatggtggactctatccaaccttgggttgtattgtccagttgtatagacaagacgacagaagggtactgagaagatttaaaaaacaaacaaaaaaaaagaggtcaaagctaaaaagaaagttcatttatttcaaatcctaaattctgagaatctgtgctttgaggaatctacttgctttataaaacatcaataataatgactaatacttactgagtctttattaagtagtgccgtgttttacatatactgtctcatttaatttttactaaaatcctatgagttacttcttcttgcttttccaattttacccattaaaaaacccagagacctatcatgacagagccacatggctagtggggtgattaatcatcttacttcgcctgggaccttttgattttagcactcaaagtcctatgtccagggaaaccccacagtcccaaggaaaccaggatgattgatcaccctacatgtcaggatccaaacccaaatctcttctagttaaaactggagctaaaagccaccatgctgcactaccttaacaagtatagtcactggcagagtgagtattagtagaaaataacagaacacacactaattgatcataactcaataagcttcacattttcatttgaaaaattaaacagaactgagatgagagcagccctacataaacattagaaatgaatgacaatctgtcattaaatgagaggatagaaattttatcccctgctctgccagtaattactcaggtggtcttaagaggtgccattggttgttacaaaatcagagtacttcataactggaaggggtcttaaggtttattttgtataatgtcttgattttttgtctgcagagactaaagacaagcaaggctaagaccagcagatctggaataggacctgggagtctgaattttagtatgcaccacctctgatcccaatgcggagggtttgaacaacacattttgaaaaacaatggcttggagatatcagaaatactatcttttccatcatctccttgcaataattccatttgctagcaacaacataatatacaaatttctataataacctgttccagatctgctggtcttaaccttgctggtctttagtctccatagggataaaatcaaaaggttatacaaaataaaccttaacaccacctccagttataaaatactgattttgcaagaaccaatggcaaatcaatgtttctgtgagataacaaatatagaaaaaaacagaaagcatatgcacttggaacagtcttagcttttagattgggaaagtgagcctctgtgtacttatgtacttaggaagttcctctaagaacagaacttcattcctggattggaaacaggtcatgattaagttaatgacttatgtgttgtgatggttaatactgagtgtcaacttgattggattgaaggatacaaagtattgttcctgggtgtgtctgtgagggtgttaccaaagaagattaacatttcagtcagtgtacagggagagtcagacccaccctccatgtgggtaggcaccatctaatcagctgcaagcacagctgggttaaaagcaggcagagaaacatggaaggactggaatgccggagtcttctggcctgcatctttcttctgtgctggatgtttcctgctctcgatcatcagactcctgttcttaaacaggtggactcttggacctacacaagtggttttccagggactcttgggccttgagccacagactgaaaacagctttcctacttttgagtgtgatgagaattatagaatcatcaaatgttacaacatgcttctacagagtgatgggtttttggatccttgcactgccactttacttacttttgaagttttgggactcgaattggcttccttgctcctcagcttacagaccgcctattgtgggacttcaccttgtgatcgtgtgagtcaatactccttaacaaactccctttcacatatacatgtatcctattagttctgtccctctagagaaccctgactaatacatgtgtaaatactcttcttctggatgaacatagaaaagaagaacaaaggatgagtctagcaaagcttcagtagcactaaatatagctggccaaagttaacatctttttataagcatttagctgcctactctgggtgttagcattgcaattgcaaaaatgctttatataactgaggttatctgttgaatgacttaatgtttttgacattcttttttagataaaactgcctcaagacgtaacttttttgagataattatctctactaaaaatgaagtttacactcatgcttatactctgttagtttaaacccactttctataaatacttttatctttacaataaaaatgataaagcactagagggctatattctaacattttccattccaaaacagtataagaggcttttttcacactctagatcaatgtgtatcagttatggttcagaaataaaaagaacaaccttatcaggtagaaggtaagaggttaaatgcctttattttggagagagatgtaaaactaatcaccagagcaataagtatcttatgttattgttagaaaatggcattatggcagggagaagatggaaaaaagatagtatttctaatgtctccaagtcattatttctcaaaatgtgacattcaaaccctctgcattagaatcatagatggtgcttgctaaaattcagactcccgggtcttattccagatcttcctaaacacaatctctatgagtagggcttatgagtctgaataagtcaccagtatcattccagtgcatattaaagtttgagaactaatggttttgacattttagacatagtttaataaaactgtttggcaaatatccaggcacaaagatgttcactgcagctcatttataatagcaaataactggatgtaatctaattgctgtactgaaggattggcttagtaaatgttgatacatcatatgatgaaatactatgaggctgttaaaataatgtagaagaatacgtaatcatgttaatgacacaatgttgagtgggaagaacagattatagagtgctcccatttttataaaacaataatatcaaaacaaaacaaaaaagtcacatattatattcataaaacaattgtttaaggatgtatcctaattctctaaaatggctctcctgtgcaatattggtaataattttgttttagtatctttattaattatgagcttctgtattccctataataaagatgtcttgtttttcaattttaaaagtataataaaagtcataataataaaatgatacaacattcaccttgctattgatgggacttagaaatatattcggcttcaagatatgcaatatcaaaataaaagaaatgctcacatattgaaataactgtaatatgaacctgctaccttgtagtaaaataaaattatattcaaaaattagccaacttatatggaataattgacagacaaataactttaatgttatgctttttactgcataaaattctttctgaaatacatgcctaaagtaagcaattccataataattgacacttacaatggatgaatgttaaatttattattattattttcctttttgtttgtttcagtttttatccaagatatttaattaatttctttgtttaattttttttctttcaaaagtagacaataaactacttaatggcctttaaaacacaggcatgcacattactagggttaaataaatttctgtggttcttaataatctcacagtctctgatatttatttcatatatatatagagaggggggagaaataaaatttctataagaaaatccccttaagatgtgtgtgtgtgtgtatatatacatatacacacatacagtatatgtatacacacatatatatatacatacatatgtaaacatgtatatacatatatatatttatacatatacatatataggcattgcaggaaagaatgtttctttcttggcatgcagtgagaccacatctccagactcccttacaggtagctatagagatgtcagtgagtgttacattacatgctcattgattataagttaaggaaatgtgtatgggtctgtgtatgtgccactttcaggcctgccacataaaaattttgtgagtacaaccccctatttctcttcccctctgtagcccctcaccatgtgttgaagatggtagagtcacaagatggaagaagccatggtttcttaatcattatttacatgagagacacttgccaatcagaaacacttaatttggggtacacgagccacagataatcttctgttggggtaatccacaaaaatttagcattttcttgttacaggtagtactattttatgtgtatatctctaaaggagttcaacctatcttaattgtgtttccattcctattaatttcccaattaatcatttattgagcacctactacctttgatgcttgtgtcgggtactgaaaatgcagagatgaattaggcacctccttttgcttaagcacttacagttcatttgaggaaaaatataatagacagataatcaccagtatatgatcaaagctgtaacagagaacttagggtttactggagtacataacacttttgcaagttgaaagaaagtgctagccagttgtgacatcgacaaaaagagaacacctggactgttgcagacaaaaaaagatgtagatcaccccataaattggacatttatttttgctttctgtctatctgcttctccagtcattttcatttagtctcattgctggctcctcaattaactgtctttaaaacctaggcattgtccaagctgctatccttcaaccatttctcttttcttttctttctttctttcttttttttttttttgagatggagttttgctcttgttgcccaggctggattgcaatggcatgatctcagctcactgcaaccctcgccttccaagttcaagtgattcttctgcctcagcctcccaagtagctgggattacaggcacctgccaccacacccagctaattttttgtatttttagtagagacggagtttcatcatgttggccaggctggtctcaaactcttgacctcaggtgatccaccgcctcggcctcccaaagtgctgggattacaggtgtgagccactgcacccggccgcatttttcttttcaatctgcctactcaagttgaaaatatcatccaagacaatgaatacaaatatcttctgcctttttatttatgacaccaagtcagccttcagcctgacaactgtaggagaatgatttgcctgtgtgactactcactctgttagcctggacacatggacacatctggaaggaagggagacaaaacaacttttgtacccctagcacttagccagtgcctggaacaaaacatatgctaaataaatcttgctgaggaaagagtgaagcatatagacatactcatctccatttcttcaactgcaagaaattaggaaagaggaaatggtattagatattggtgttactagcaatgtagtatttgtaactattattataagtcaggcataaagttgaaacacataatagggaatttctataaaaattccaaaacttcagccactcaaactggttgggtctctccccatgttcaaatattctttcaaatatatagacatcatgattaagtattttcacctattttgttttaaataagaatgaaggatttcagacactcagtgctttcagtgagcctacactatgcagagcattgtaaaggtcagcatgttaaatagtcagataggtccaggaagaagacagtcataggcagaggatgtgttttgttttatcacttccaatgccacattccttttttttcctgtccagttagtttgatgcaacattaagttctgtaaaagtaaagtttccctgtacctaattttgtagtataaacaagataatgttagtgactcttcaaggactaggatacaatttaataggctattatcacagtggattaaaagtcatatttgcaatcttaacatattatatgccaatagcagacattttctccatatattagtctttcatgtccccatgaaattgttaataatgcactaaagcaataatggaaaatgagccttaaatttctctaagccttatgccaaatgtttttcctcttgtctcattacttattatgtatgttttatcttaaaactgaatgctattattgcccaaataactttacaggaaacaaacaagtcaaggcaataaacatcctgtcctttaatatagaaaagggcattgtatcgacttaacacaatcaattttcaaatggatatttgtatatagaaaagatactcttgcaaaactaattctatataaaaatgaaaatttctacctcaggttaacacaaagataacagataggtttcaaacattcacagagcataatccaaatataggctgtgatttcatactgattagaagagacagaaatcactgaagtccttctaaagccaatttcctataactcagtcatcaaaacttccaaaaagtttccaaaaaaggaatagaaaaatctctcattcagtaatattctactgtatattctcatcaacaagaaactcgatctgcaactctaggattcaattaaccttttgtaaatagcattgtacatttcctggctgactttaaaaaataaagtcaattctattttgttagtagaggaaggaaaaaaaataaggaaaaacatgagttctgtcaattatttccttcacagttacatacagtaatagaatcccaagtgtagaaaagaaactaacattgtttttttagcagctaaaaattatgtcttacagtaagtataggtaaaactcagccagtttactctctcaagtgttttgaaaagtttctcacttgaggaaccaggggtcaaatcacaaccttaaaagaaatacaaaggatctattgtcttcattctcaagttttatttaaataccaataccaatcaaaactatgtgtataaacatgaaagaaaaacctaaaaccatcatttaagtgatgatatatttataatgataaactgggtatgtaaatctagaataaactaacaaatattgggctgtgggaggaaaggggagacaaagtaaagctaagttccctttccacatgcagagagccagaaatgttgctttgcttttggctttgatattcagataactacaaaatatccccttgataaacaaactatggatcaaaagaatgtttatattaaacttatatttaacattatagctactggtaaagcataggttcatgcttaagatcaggataataatagaaacttagtaatatttattgtattacatatattgtataggtagctacttgattcttataaaaactgtacaaaaaactgttactattcccatgatacagatttggaaatgaagcttaaacaggttagtttgtccatagtgacactatcaactgtacagaggttagtttgcctggaatgagaacagcaggctggttccatgggagctttccacaggccatctaggcctggctccagccttgcttcagacaaaaaagaatgtctcatgtggtctgaggactcatggcaatgtgtgtgcagacctccctctagccacctcgtcttttaagacctctcagttctaactgaggatccttcagagttttgagaccaggtttagctgatatcaatgttcatagttttagcccaaatgtaacattgcccccatttttcaaaaacctctaacaaattcagtaacccaatgtgaggaatagaaataggaggcataaaactataagaaaagtgaaggcaactttatccttatttgattacaacctagtttaatgtaggaaacccagaaaaatcaactgaaaaataattgaaaataagaatagtcaggtaagtttgtccagttttaaagtaaaatatgcaaaaggcttttatttataaaatcaaagaccagttgttaaaattaccacaccaacatctcatttataaaaacaaacaaaaccaaaatgtttaaaaataagctcagaaagaaataagtagaacttagattaagaaatctatacaacttttccaagacttatataatcaagactgatgttcctttgaataattttctaagtttaatgttattgcaagaaaatcatctcttttttagttttttattttactttttggaggaattaggccatgttataaaatataacatggttacggtcttgctctaatacatataaaattttaccatgaagccacaataacaaccaaaagtgtggtaccttcaaataatcaacagaaagtttagtggaaaaatacaaaattcccttaaatattttcttatataagaacttagtatgtgtcaatatgtgttacaggaaacactactagctattgggaagagaacaattatataagtgttaggaaagtgactatgtacgtgtgagatgaaataagagcaatattaaatactgtaaaagtattctgtagagtttcatcagcgagagagctaattctccaccagagacgccaacttagcaataatatatgatccaaaaagttttatgaaaagtctagaaaccagtcaagaagttgcagtgcctgaggcaaacttaaagaaaataatagtctcattgaaacagatgagaaaaggcatttcacgtcaaccatgacagcccttcctccaagccagcacagcttggtgtcatcaggaaaaataaatcacaccttatgacttctcccttaggagagaaagagaagagtggaatgtatgtccaatgttctggtttttcagagtgttgtctgagagactggtttctgtcttgcctgattcagagcactaatggaatctacatactttggatgcctggggtctgcagagagcaaaaggtaactcagtggcttattgcaatgccacagaacctgcagtggtacagacagacaccagacggagaaggagattaaaagctcttggaagaaaaagaagcaaatcactctaactgggaaagaacacacacaaattcaaagaagatgtatcccgtggtaaaaaaaaaaaaaaacaaaacaaaactggagaggctcccaaaatctctatgtgggctaattggtaaaagtcttcccctgtatgaagccaatttataaggactgaagaggtggctgctttttcaaatgcacaaatcacagaaaaaaataactaggcacacaaagaaacagggaaacatgacacaatcaaaggaacaaaatacacctccaggtaccaaccagaaagaaataaaaatttatgttacttggcaaataattaaaaataatattaaagaagttcaatgtgctagaagagagcacagacagaaaactaaatgaaattaggaaaatgatgcaggaacaaaatgagaatatcaacaaacttcaaaaagaaaacaaacattcatggagatgaatacagtaattgagttgaaaagttcactagagcatttcaacagatgactccatcaagcagaagaaagaataaatgaactcaaagagaggccacttaaaattatgaagccagagatacaaagaggaaaaaaagaagaatgaagaaaagtgaagaaagactaagaaacatatgggacaccatcaagtgttccaacatacacataatgcaaatctgagaaggagatgatagaaagagagaaggacagaaagcttatttgaaaaaaacaatggctagatacttgccaaatctgaggaaggaaatgaacaaccaaattcaagacactgataaaactcaaacgtggaaaaaccaacataccaacataaattataatcaaactgtcaaatatcaaagacaaaaagggaatcctgaaagcaggaagagaaaatggctcatcatgtgcaagcgaccttcaatgacattagcagatttctcaggagaaacattataggccagaagggagtgggacaatatattcaaagtgctgaaagaaaaagtctgtcaaccaagcatactctttctggcaaaactgtattttgaaaatggaggagaaataaagataaacaatggctaaggtagttctttagcactagacttgacttacaagaattgctaaaaggagtcctttgagttgagacaaagtatgctagacagcaacacaaaggaaaaggtaaatatttagacaaataaaaatcgtataatattgcaatggtggtgcataaattatttttaactctggtatagaacttaattataaaatataaatataaaactatgttaacaaatgcaaaatataaaaagctgtaatatgtgacattgataacataaatgggcagagatataaaggagtagagttttgtatagagctgtctgctaactatgatatcctaaaactgaaactgtggcctgagagcagtcctgtctccacttagcgacctgtcaggactcattcccatccatgttctcggagacaggcttgccaaacttggttccacagcagattctgagatggccctataactttgctccattcccacttagacttggcccaaggtcaatcttgtccccagagatgtatgcccatccaactccctggaggcaagtcctctcagatgtggaccctgaagcagcagtgacttagttccaagctctctcatgttgatctggggacggttctccctacccatagacatactcagagagccagggggagtcctccagaaacccagagggaaccacgcctatctgcatacctaataacaggtctgccattggtggaagagaaggttgttaaaatcagcctgtaaagaccgaaagactgtttgcttcttcaaattcacagacaccaatgcaagcctacatggataacaaataaataatatggaataatatattcaaaacattgaaagaaaaaagcctgtcaaataagaatactgtaccctgcaaagttagccttcagaaatggagaggtaaagacattcccagacaaacaaaaactgaggatgttcattaccacaagacctgccttataagaaatactaatgtgattcttcaagttggaatgaaaagctgctaaataacaacataaatacatatataagtatacaactcactggaaaaggtaaatacataattaaattctgtatacttgcatgtggtaatggtgatgtataaattatttctaaatttagaataaaagttaaaaggtaaaataattaaaaataaaccatagttacagtaatttgttaatggatatgcaatacaaaaagatgcaaagcatgacatcagtagcacaaaatgacgggggaaagtaaaagtgtagagtttttgtatgtgattgaaattaacttgtcatcagcttaaaataaaatattataattaaaagatgctacaagatgttttttgaaagtcccatagtaattacaaaggaaaaaaaaaaaaaaactctaatagatccagaaaagacaacaaggaatcaaagcacaccactacaaaatatcaacaaatcacaagacagcaacaacaaaaaaaagcacaagaaccacaaacccatcagaaagcaattttttaaatggcagtaataactccttacctataaataataatcttggatataaatggattaaattattcaatcaaaagacacaaagtggctgaatgaattaaaaaaaatccaacaaaatgctgtctcatattgggacaataagagactcacttaagccttaaggatacacataggctgaaagcaaagggatagggaaatatattacatgaacctcaacagaccaatagcaagtaagaagattgaatccataattaaaaaaaaaaactcctaacaaagaaaagcacaggaccatgtggcaacaagggtgaattgtagcaagcattttaagaattaatacaaatgcttctcaaactcttccaaaaaaagtgaagagaagggaacacttccaaattcattttatgaggccagcattaccaacagaccagaatcagataaggaccctataagaaaaaaaattacagggcagtatccctggtgaacataaatgcaaaagtcctaaacaaaatactagcaaactgaatttgacaatacattaaaaatataattcaccatgattaagtggaatttatcctagatttgcaagtatgatccaatatacacaaatcaaaaaatgtaatataccgaatgaacacaatgaaagataaagatcatatgatctataatcatctccatagaggcagaaacagtgtttgacaaaatccaacatcctttcatgacaaaaactctcaacaaattaggaatagaaggaatgaacctcaagacaataaacgccatatttgagaagcccacagctaacatcacactaaatggtggaaaactgaaagctgcttctctaaaatctgaaacaaaacaagaatgcttactcttgccatttgtgttcaacacagtaatgaaagccctagccagagcaattaggcaagaaaaagaaataaaaggcatccaaattagatttgcagatgacattttctatatttaaaaaaaaactctaaagacttcactaaaaaactgtcataattaagaaaataattcagcaaatttacaagatataaaatcaacatacagcaactagttgcacttctatatactaacaataaactatctgtaaaataaattaagaaaaacaatcccatttaataatatctaaaagaacaaaatacttaggaatgaatttacccaaggaggtgaaagatctctacacttaaagacattaatgaaaatgaaaatatatcccatatttatggattgaaagatttcatattgttaaaatgtccatatgggatctacatattaaatgcaatccttatcaaaatttcaatggaatttttcacagaaatagagaaaaccattgtaaaattcatatgaaaccaaaaaagaccctgaatacccaaagcagtcctaagaaagaagaatggctgggcgtggtgactcacgcctgtaatcccagcactttgggaggcctaggtgggtggatcatgaggtcaggagttcaagaccagcctggccaagatggtgaaatcctatctctactaaaaatacaaaaattagccgaacgtggtggcaggtgcttgtaatcccagctactagagaggctgaggcagagaattgcttgaacctgggaggcagaggttgcagtgagccaagatcatgccactgcactccagcctgggcaacagagcgagactccatctaaaaaaaaaaaaaaaaaaaagaagaagaagaagaacaaagttggaagcgtcatactccctaattccaaactatattacaaagctatagtaatcaaaacagtgaggtactggcataaaaacagacacacagaacaatggaacagaatagagatcccagaaataaaccctgcatatataatcagttagtctttgacaagggcatgaataatatacaatggggaaataatagtctcttcaataaatgttcctgggaaaactggatgttcatatgcaaaagaatgaaattgtatccatattttattacatacaatacaaaaatgtgcttaaaagaaattaaaacattaaaccacaaaactcctggaagaaaacaggtggaaagcttcttgacactggtcttggtgattattattttaatatgataccaaaagtgtaggcaacaaaataaaaaataaatgggactacatcagacttaaaagcttttgcacagcaaaggaaacaatcagcaaaatgaaatattttctacatatggatgatagaaaatatttgcaaaccatacatagttttaccttggtatccatgggggattggttcaacctttcccaccctctgcagaaaccaaaatcttcagatgctcaagtcctgcatataaaatagcatagtatttgcatataacctacatacatcctcctgcatactttaaatcatctctatgttatttataatactaatactatgtaaacactatgtaaataattatactatattactttttaattatttttattgttttattatgttttttcaaatatttttgattctcagataattgaatcccttgatgcataacccacagatacaaagggctgagtgtacctgatatgttcaaaatacacaaaaaaatcctacaactcaatagcaaacactccaataacccattttaaaaataggcaagggacttgaatagacatttctccaaagatgacatacaaatggccaaaaggtatataaaatggtgttcaccatcattaatcaccagggaaatgtacatcaaaaccacaatgcggtatcttctcacacccattaggatggtcataaaaagtgttggtgactatgtggagaattgggaacgcttgtagcactgcggtgaaaacgtaaattggtaactccattatggaaaacagtatgaagattcctcaaaaaattaaaaatagagataccatatgatccagcactctaatgtttgggtatatatccaaaggaaatgaaaggagcatgctgaagagatgtctgcactgtcgtcttcattgcagcattattgacaatagccaaggtatggaaccaacctaagtgtccattgacaaatgaattaatagagaaactgtggtgtatatacaatggaatattattcaacagtaaaaagaaaaacaaatcctgccatttgagaaaacatggataaacctggaggacattatgctaactgaaataaaccagacacagacagccagatgctgtatgatcttgcttatatgtgtaatctaacatagttgaactcataggaacagagagtagaatggtggttgccagaatctgggacatggtagaaatggggtaatgttggacacagcatactaactttcagttataagacaaatacattatggggatttaatattgcagcttggtgacaatagataataatactgtattgtttaagtttgctaagagagtaaatgttaagtatccttaatacttaatccttaccacacacacacacacatatacacacacatacatacatagaataaggtaaccatttatagggatggatgcattgattaatttattgtggtaatcattatacaatgtatacctatatcaagtcatcacatgtctacctcaaatatatacaatttttatttattatttataccttaataaagctggggaaacaaaaaacaaaatatgcttatcctctcaaaataataaaacattagtcatttatcaagcctttagatttaactaataattatagaaaattcaaaggacaggttgaacaacacaatagagatacaatcagcaaaattgaacctatgagaaactctgtaagatgtatgacccagtttttttaaaagggtgcagagagaaaggatagaaagaggaaatttatagtgtaaaagagaattcagacacataatgatttcgatctgttaaccttagttgctaccatttcataccaaaaattaaaattatttaataaaattgttttaaaaatcagctacatttgataataagaaattattaggaaattttttaggaaaatttacaagcatcttaatgttattgaggtaatttttaaaagactatttttagatacatactaaaggacttacagatgaagaaatattgtgtattgaatttgaaaataattgtagaggaaggaaatatgggtaaaggtacagatgaaacaagaactagttgtatatcgagaattgttaaaactgggtgatgagtatttaagatgcattatattaggttgggcgaaagcaattgtggtttttgccattaaatggcaaaaaaacacaattactttcgcgccaaccaattactattctctgtacttttgcatatatttgaaattctcaactacgtatttttaagtataaaaatgtataataattttctcctttagtttacagaaggagaaataaggtgctgtgcaaaaaggaggtatccctgcaagcagaagagtcaccaaagtaaaacagtgtttgcatcaccattttacctaaggctggctctaaaactagggttaagcaatatgtcccccatgccctatgagaaggctgagaaaactaattaaaacaaattcataaattgctaagtattcctcagagatagacgcttgtatactcaacacataataatgatgataatgatgatacaggatattaaggttatgtggcactgctccataatagaaatttttcccattgttctgtgctgtaaacatgatgatgcataggtctaatccaaccattaagtatccattaaccttttaaaaattaagtgcttcttttcttttttcctgaaactaagcaggagaaaatgttatcccttataaaataacatttaacaaaaatctattaccatatccaatttcaaataaacagcaagtttccaagaatttaataagctattgctttacatagttagcatacagcacctcaggactgcattttaaatacattcatttctagaactcaaattcagggctttagactttttattttcccttcaagtttataaagaaatttttcatctttctggattttgaaaatattaaaatgctagaccttcacaataaaaggtgcatagaatttctattaaaaactatatacttaactatgtgttcctttgccacatgttggcctctgaacattattttctaggttagttatagtatgatttttcaaaacgtcaccttcagttaccaccccaaacaatgaaaactgaaatcagttctcaatgatttgatttgttatcatgggtcttcttgaaggatagaataacaaatcatgccaaacctcaaggcaacgtgtgttttgtaagttaaattacaaataccagggaataaaagtatatttgcatcacgtaggaatgattaactgctgcttagatgacacaaaacgattgaaaatggaataatcactgtcatcaatatggacataagatataagatatagttaaatatcagaaaaatctcaactattggatattttcatttaaaaatctagccaataatttcctgtccataccataaataaataactggcaaactgctttctcagttttgttaccacacatacctacactactttaactttactatgcttaatatttaatgtaaaatacataatcccattctatgtcactgtctgataggctttcagggttggcagtaactttaaatgtcatctacttcagtatttcccttgtttcatgaccctctacttatattgttaattactttttcctacagcactgacaagtagaccatgattctatgtttgaatatctccaattatgaaatctacaaatatttaattagctcctactacatggcaggcactgatttaggtgctctgatatagctgtaaacaaaattgacaaagatctctgctctcaaagagcatatattctagctgctcctggaatggaattcaccactcgcaacctgttttgccacatttattcagttaagagtggctgagtacaaacattgtcagaaactcttctcggtactgatgaacaaaagatgaataaaatagccagtctcaagtcactataagatagttattctatatggttaatggaaatatgttttcttattattaataccagtgtttaacattttggggacacaaagattgggtctaattgctctgccctatgaaagctctccagatatatttatatctctccaaccccaaccttgttttacaggccatgaattccccagtccttttttatccccccgggtgttagcaccccgattgctataggcaccagaaatttaaagtaaatgagtaaagtggtctgagaggaacacaaacacaggatcacacaccctcacagtagcaagagtaaatcccagaaatctatatttaatgagacatctactaattttgaaacatctgccgcaaattcaaatttctaaaaaccccatatgggccatttagaacacatctgaaggccataagtttggaaccacagctttaggtattcttcacgtgacacagtttggactcatctttccatgaggattgcaagttttaggtgtacactacttctcaaagttcttaaagtgaattgcccaggattggggtcatagctctagctatgggagaagcaacataaatttacagccaaatcattaccttttctattctaaacccagttctattcatgaaacccaagaatgaatgaatatttgggggaaataatgtcatattattgatttatgcttctgtaactaccacctaaacctacagttgttattaaactatgtctcacctttgctcctattgctcctcaaacaacattagttcctacttctctctggtgttttagactttatattttcattttagtattttgtcttattatatttacctctcccatttagtctgtcaagtaattttgtatgctgattttgttaacagccatattagtggttcctgccatttttatttcatctgtggattagctccttatgccattaataccaccctcaaaattaacaatgaaaatggtgaacaggaaatgtgaagaccaaatccttcagccaattactagaggtctctctctaaacattgattcatgaatacaggcattcagctgttactctgcctaacagtatcatcaactgccttcctacatcttaagcataagttcatcatggaaggtttttatcaaacgttgaaattcagatagacagggggagcagcactcctcagatacactggtcttatgggaaaagtaagttatttaatctgatatgctttactattagtgacctaatacaagctccaggtgatcatcactttcctttctaaaggctcacaagatttttttttaagatccattgaagaacttttcctaagattaatcaattgattgattcattcattcaataattatttatcgagtgcctatattaggcactggaaatacagtagtgtgacaatgacaaacattcctgccttcatagaatttcactagtgtaggggaagagaaaataaacagtataaacaagtgagctatatagaatgttagcgtcatgtgtttaggatataaaaagcactaaagtagatagaatgtgttaaaatcagatcaagttagaaaaattttttaaagtttattgagcatacaaaaggacagtttgcaaaccagggacctcaaatcaaaagtggtaagaagctctgttcacagcatttaaaatgcagcttataaagcataattaaggaactgcatctgtcttcgctgtggttggctatcataaacttatattccttttaggacaagtaaaactgtttaagctgatttgtctgcagctgattggtttaattttactgagtcatgttgacaaggatgaaaagctcacatttcacgttttgtttatggttagacctagtattttggagaaaattgagataatttaaattttggttatgtggctaatggcagttggtcttggagtatgtacattgtggcctctattttttttaaacaaaagtctatagaatggggagtaattttagatagggatccatgagaagcctctgtgaaagtaacatttgcaaaaagaactaaaagaaatacaattaatgtcctactccctaaggacataagtggggagaattcactttcctcttcttcctgaaaattagaataactcaatcccatctctaatatactgttacgtatttcctcaaagccactggcaagttatttaacttttatatgtctactcatttgtagaacaggcatgaaaatagtgcccaccgcatgcagtaattgtgaagattcagtgagataaagcacatagtttgcaacagtgcaaacacttgcaaagcacaatgtattctgaaacatgtttctctaatgcaaatacattcatacaaaattgataaattaggggtacatgtcaatataccatggacattttgtggattcagatgtgattttccccagcacattatgttttcacaaagtaaaaatcagtcaaatgcaaatacacaaaaaagtttatcactccccaggggtggtatgtggtactgcacatgacatctgtgtacccctcatacttcctcttgcctcattttggccacaggctttgtgttcataaagcctattgcatggaacactcgattctttgtgcattttgctcttgtcttatggtgaaatgttgtatttgtttcaaatattatgatgcagactgaatatcttctacaacataggatagctatctaatgtgcaattttgagattatctttagttctaaatcatttttattttactcaattttataggtagtaatgattttttaaacctttgtagtaaacactagtaaagcattcagttattggtattatctaaaataaactcaaactaaaacctcttaataacttctcacttacatcaacaacagtaaaaagtgtgttctgcatggcacaaaggccatgcatatgtgagatgaaaatgaattgtatcacttcacaggagaaatttatctcaacctgcactgtttctcaggagaggactgatgcaaacacagtgctaataaagacaagattgtaattctgattccttaccagtccctgccagcttcactgaggaaaacaggtctgcaaacacaaaaggccccattagttccagcaatcacttcagaaaagatgtcatttttcatagagaatttcaaacaaaagaacatggacagctcctcctaagtggtcagcactattgagagtgagaaatggagctccagaaagggcatgttctgctgatgggtgggtcaaagacctatgcatagattcctcatttgaatatctatgtggcatgagaggaaaagacaaggtgcaggatttagcctgtggcagtagtttgctgacacctgtcctagactgttactagatgagaacaaataatacttggcaaaaacgagaagtctggttaaaaatgactgttattcgtgagtgctgggaaaagcgacacacatttgcaaaagtttttgtaacaacgtttacttctatacatttcttaattttatgccaaagagaccatattacacaaagtttttattaagccctgtcttttctactgatactatattgacattaaaaacagcagtctatgcataggtccttttctgctgttgtaccacatggcagtttagtatttgtagcagaaatgatgtggcccacaaagctggaaatatttactaccaggccatttacagtaaaagtatgctgacccttgctctaggacataaagaagcagcagagcaaaatatggagaccctgtttcctaattaataactcggtcatcaaaaatcttaattacagcaattcttaaaaagtggttctaattgacagttatgttctcctcagactcaggatccacaaaggaaccgggtagtggagaaataaaggctctcatagacattaaaaatccattctaaatatgtagatgctatagatcttcaggctactgaccatgacagccactaaccgagacatcactatcacagtggtgcatgaaagtaggactcatataaattggactataggtagaaatgctgtgtgctgactcactgccaagaatctcagaaaagctataaaaatgaacaataatatataaaaataagtcagatctaaaaattactccctatcaatgcctaagatacattcataattgaaatctttaaaagaaattaattgaactttttaatgggccgaatgagaaggaaaagaaactatcctcccaacaagaactgcatgagtgcatgctactttttccttttaatgtatttcttttgaatgccactctaaatttctcctttttaatcaagaaactctacttttcttaaacatgactttaaatgatttcattttattctattcagaattttcaatggaaaacgaaagtacaatgtgactttataagagagcataagctttcagactgaaataataatcagcatgaggaaagataagatgctcagaatgattcagaaaaaatcctgacttctgcaactgagacataggagtaccggcaattccgatttccctctgggtaggaaccattcaaggaagacgactgctataaccaaaaaaaatggactattctacagatggaacaaaagatggcagagatagcatcatttttttgaactgtgtgagtactacaaatgccatcgacagcttcatagcctgacagtttctgtgtgggagtcccctttttaggaaaacatcatattctcaagaagttaaagattagatcattgaaataattgaaggaacaacctgaatcccatgaaaatttaaaggggttctgatgcatgtcaggagctaccaatttgctgccatcgtattctaaccagatgtctttttccacctatggctcaagatctgcccacatgctgtgaacaagttttacttttggctataattatgtttggagacaatggctccaaactaccaaatttttctcttgcctctgcgccccatagctatttgtctcaacatactgggtatatctaattcttgttttcctggatttcttgcctgtgtccctgatttctgctctctgactccataagcttctatatctggtttagattcatgagtgccctgactccgcttttttggaccccgtataatcctgacttattttctggttccaaacttcaccatcactgtgtgttctcatataactgtgatccctgatctcaaacttccacctctcccaaggccaacagcttttggccaagaactaatagtatctaacaccaacctttcttctcaacttttaacctttttacctttaatcaccttgagctatgcaagcgctgatttctgattacaacctggtcctgatatgataaaaccacagttagtccattcaaaacctaactgctggtctgccaagtacaccattaaaacatagtagccattgttaagtaccactgtgagtacctcgtgtgtgtgtgtatgcatatgtgtgtacagttgtcacaaagatctagtagcatctgtgtcatgttttctattttacaagcagcaaataagaatcccagaagcacagcaatttgccctaagttatactactagtaaaaggtacaagaagttgacaaatttatttctgtccagctaccaaactactctgtgtgagagattgttatatgggtgacccataataaatgctacctcttggcactgccacttcatgtagtttctcccatgttgatcctggccttgccatatgacttactttggcacattagaaaaattatgcaagcaaatgctagataagtgcttgcacattgggcaggcctgttcctttaaaacaccttcccttggagtcagcctccatataaaaaatctgaccagcctgcaagagaccgagaccatcctggccaacatggtgaaaccccatctctgctaaaaaatacaaaaattagctgggcatggtggtgcacacctgtagtcccagctactcaggaggctgaggcaggagaattgcttgaacccaggaggcggaggttgccgtgagccgagatcatgccactgcactccagcctggcaacagagcaagactccaccttaaaaaaaaaaaaaaaaaaaaaaagtctgaccagtctgaatcagccatactattaggaagcccaagatgattccacatagaggccatatggaaaagctcagaggtgccaggtatatgactgaaactttcttggaccatccagcccagaccagctattgactaaatgtagccacgtaagtgacctacctaatcaataccacatggagcagaagacatactcaggaaaatcctacccatcagaaataggaaactgttattttaatccacaaagtccaactcaggacttgctggcttagaaaataatattatttctcattctcaacccctccagatggcagaaggttttcagagtaaaaaatggtctctgatcaaatcaagtactgctagtacaatgtggcctcagggtaaatatcaagtcaagaatgtggtagtaagatacctcttaaaacccttataagttccactctgctaggagacaagggtgattaaactcttaaaaacgttactgcacaggattctgactctcagtctaaagaagaaaagtgtctgtcttaaagagacttggggaaatagctttcgcccaatggaatggaatataactggatacattagaaaattacaaagtttaaaaagaagctgtgccaccttggaagaaaagggagagtgacaggacaaaatgaaaagaagattttaggcctccaaacctttaatggaataaatagtctcacaaagtgactccgtttgcgaatgagggccatttcttacagaaaaggaaggttaacttagaggagagagtcaacaggcactgaaaacaatggaatagaaatccacatccagagaacaggatccttttcaggaaacctagatttgagggaattggtaacatgttcccagctggatctcagaatttttatgaagcaccgattgctatgtgcctctcatttccctccttttgaatggctgactttcttgctagcgatacaacaatccctgtctcatcaatgtatgttgcagggaagggggattacacagaaggtatcattttaggtacaagtatctagataaagagggaacatcaactttaaatatacccaatttagattatgtgattttggaccttgaagctgggcccagcactgtaatgtgatgagactttctgaaaagggacaagaagtgctgtggccagagggaagattgtgatagctagtctccaactattcccctcatccctgcccacatatgctattcctcacaccatgaagtaggttgtagttttcttccccttagctatgagctagacctgtgactttctttcaccaatagaatgcaacagtaatgatatcccgggactcctgagctcaggtctgacagacccacttgctctccctgggaagccagctgctatgctgtaaagaagcccaagcttctttgggctaaatgatgagacactacacagagagtatgatgattaactttatatgtcagcttggctagcccatggtacttggatatttggtcaaacatatctatattgccgtgaaactattttttagatgagattaatcagtaaatgagtaaaatagagtaccctccataatgtggatgggcctcactcaaagaattgaaggccttaagagcaacaataacaaaaacaactgatgttctcaaaggaagagggaaatctgccagttgatagccttcggatttgagttgcaaaatccactccttgggtcttcagtctgctggaccatcctgcacgttttggactcaccaacttccatgaccaaatgaaccaattcttttttttttttttttgagacagagtcttactcagtcacccaggctggagtgcagtggcacgatctcggctcactgcaagctctgcctcctgggttcacgccattcttaaaataatctctgttctctctctctctctgtgtgtgtgtgtgtgtgtgtgtgtgtttgtgtgtgtgtatacatacatatatatacacatacacacaggcatacctcaaagatatagcaggtacagtttcagaccactgcaataaagcaaatattgtaatacagtaactcacatgaatttttttgtttctcagtgaatataaaagttatgtttacattgcactatcctgcagtctattaggtgtgtaatggcattgtaactaaaaagtgtacacactttagttaaaaatactttatactagaaaatgctaacgatcacctgagccttcagcaacttgtactctttttgctgacagagggtcttgcctaaatggtggtagctgatgactgatcagagtgggggttgtgaaggttggggtggctatgtcaatttcttaaaataatacaacaatgaagtttgccacatccattgactcttcctttcatgaaagatttctctgtagcatgtggtgctgtttgataacatttttccctcagtatatcttctttcaaaatagaagtcagttctctcaagccctgccactgctttatcaagtaagtttatattatattctaaaacctttgctgctatttcaacaatgttcacagcgtcttcatcagatgtagattccatttcaagaaatcactttcttggctcccataagaagtagctcctcatctcttcaagttttatcatgaaattgcagcaattcagccacttctgcagttacttcctctactgcaaccttgaaactttcaaagtcatcatgagggttagcatcaacttcttccaaatgccggtaaatgttgatatcttgacctcttcctgagagtcataaatgttcttaattgtatctagagtagtaaatactttccagaagttttaaaatttactttgcccagatcctttagagaaatcactatctatagcagctacagctgtatgaaatgtgtttcttaaatagtatgacttgaaagtcaaaatgactcctagatccattgattgcagaatgaatgttgtttttgcaggcatgagagaaacattcatcttcttgtataccttcatcagagttcttgagtgatcaggtgcgttgtcaatgagcagtaatattttgaaataaatctctttttcctaagcagtaggtctcaatagtgggcttaaaatattcagtatatcatgctgcagacagaaatacggtaatacaggctttgttgttccatttatagagcacaaagagagtagatttagcatatttaatttaatttaattttaagttgttggatacacgtgcaggacatgcaggtttgtcacatagataaatgtgtgtcctggtggtttgttgcacctatcaactcatcacctaggacttaagccccacatgcattagctatttatcctgatgctctccctcccctagcaccccctgaatgggccccagtgtgtgttgttcccctccctttgtccatgtgttctcattgttcagctcccacttataagtgagaacatgtggtgtttcgttttctgttcctgagttagtttgctgagaataatggcttccagctccatccatgtccctgcaaagaatataatctcattttttttatgactgcatagtgttccatggtgtatatgtaccatattttctttatgcagtctatcattggtgggcatttgggttgattccatgcctttgctattgtgaatagtgctgcaatgaacatacatgtgcatgtatttttataatagaatgatttatattcctttgggcatatacccagtaatgggattgctgagtcaaatggtatttctggttctaggtctttgaggaattgccacactgtcttccacaatggttgaactaatttacattcccagccacagtgtaaaagcgttcctatttctccacagcctcaacagtatctgttgtttcttgaccttttaataatcgcaattctgaccggcatgagatggtatctcattgtggttttgatttgcatttctgtaatgatcaatgatgttgagctttttctcatgtgtctgttggctgtatgtatgtctacttttgagaagtgtctgttcatgtccatcagattaacagcagacctttcagaagaaaccctacaagctagaagagattgggggccaagattcaacattcttaaaaaaaaaaaagaatttcaaacccagaatttcaaagcagccaaactaaacttcataagcaaaggagaaataaaatcctttttaaacaagcaaatgatgagggaattagtcaccaccaggcctgccttgcaagagctcctgaaggaagcactatgtaaaggagaaaccattacaaaccactgcaaaaccataccaaaatataaagaccaaggacactatatagcaactgcatcaacaagtctgcaaaataaccagctagcatcatgatgacaggatcaaatttacacataacaatattaactttaaatgtaaatgagttaaatgccccaattaaaagacacagaatggcaagctggataaagaatcaagacacatcagtgtgctgtattcaagggactcatctcatgtgcaaagatacacaaaggctcaaaataaagggatggaggataatttaccaagaaaatagaaagcggaaaaaagcaggggttgcaatcctagtttctgacaaaacagattttaaaccaacaaagatcaaaagagacaaagaaggacattacataatggtaaagggattaattcaacaagaagggctaactatcctaaatatatatgcacccaatacatgaacagccagattcatagaacaagttcttagagacctaccaagagacttagacacaataacagtggtagacttaaacaccctactgtcaatattaggcagataatcaagacagaaaattaacaaggatattcaggacctgaactcagctctaggtcaagtgaacctgataggtatctgcagaactctccacccaaaaacaatagaatatacattcttcttggtgccacaagacaacttactctaaaatcaatcacataattggaagtaaaacactcctcagcaaatgcaaatgaactgaaatcataacagtctctcagaccacatcacagtcaaactggaactcaagattaagaaactcattcaaaaccacacaactacatggaaactgaacaacctgctcctgaataactcctgggcaaataatgaaattaaggcagtagtcaagaagttctttgaaaccagtgagcataattcttaagagccctaggatttttgaaatgctaaatgagcactggctttaatttaaagtcgccagctgcattagccctaagagtagagtcaacctgtcctttgaagctaggcactgacttctccactctaactatgaaagtcctaggtgacatctcttccaatgtaaggctgtttcctccacattgaaatctgttatttagtgtagccactgtgatcaatggcattagctaggtctgggtaacttgatgcagcttctacatcatttgctgcttcaccttttactttgatgttatggagatggcttctctcctttaaacctcatgcaccaacctctcctagcatctgacttttctccttcagcttcctcacctctctcagccttcatagaaataaggagagtttggcgcttgcttgagattaggctttggtttaagggaatgttgtggctggtttgaaccttctgtccagaccactaaaactttctctatatgagcaagaaggctattcgctttcttaccactcatgtgttcactggagtggtatttttcaatttccttcaagaacttctttgcttcaagaattcagaacttcaagaacttttattttttttttttgcattcacaacttggatagctgcttggcacaagaggcttagcttccagcctatttcagctttcaacgtgccttcctcactaagattaatcatttctagcttttaatttaaagaaaaagattgaaaactcttgaacatgtagaggccattgtaggattattaactggcctaattttaatattgttgtgtctcagagaatagggaggtttgaggagagacagagagataataaatggactaaatggatggttggtggagcagtcagaaaacacacaatctatcacttaagttcacaatcttatataggcatggtttttgaaaccctaacacaattatgatagtaacaacaaagatcattggtcacacataacaccgtaacaaatataatgataatgaaaaagtttgaaatattgtgagaattaccaaaatgagacacaaagtgagcacatgctgtggaaaaatggcatcaatacacttgttagatgtagagttttcacaaaccttcaattggtgaaaaaataaaatatctgtcaagcaccataaagcaaaacacaataaaatgaggcatgcctcatttgtatgtttatgtatacacacatacacacacaaacatacaggctgtatgtatacatatacacacacacagcctattggttctatttctctagagaacactatgacagtgaaagaaaaaagataatatacagaggagccctgaggcaccacagataggagtgaaggcttcctggaatttccagcccagaccaacccagcccagcccagctcagcccagtcctgtcaccagttgaatgcagctaggttgatgccacatgaagagaagaatcaccaagccaatacctgatctggcctaacaaattgtgaggaaaaaaaataattattgttcttaagccattacattaagccacaacataaggaagtgaaacatcttcttttcttccagccattctctctcccatcctagacataagcttaatcttgtttagagggttagctctgaaggaagtggaaggtcagcctataactgggaattgcccacctccaatcagtaaagtctgaattttattcaaaccaatcatttgggatcatgtttgcatttatatgacaatttggagatttttaatagccagctatttgttcatcttatagctgtagccttcatttaaggtctctttataaagatagataggaaagggggaaaatccagacaaaggaactataaggggaaaataaaagttagccctcctacacaaaacctcattggtccctagagtctctatgtcataatagattcaggaatgcagtcattggaatgcaagaagggctgctgcaagtggcaccaagtcactcaatgacatgcaacaagaacaactggacacagctttatacctcctgagagcagtgttaggtaataggcatagccacagaagcctttgagaatccaagcaaaatgaaatcaattaaattctgcctatcgctcttcaaggaaaatgtcacgctgtagccaccttgagacgcaagctcagggcacaagcagtgctataacgtggcaaacaacaaaagtggatgcagagtgctgtgcaaagctgctcagaataagaatttgtggtaattttaagcatgggatccatctgtcaatgcaggaaaatgacacatttgagggtacatttatttatgtaaggagtgtaaattttataccatcattagcatactggatgaaaagctgaggtcaaatttcaagtcaattaccggatgctctgttataaatgcaggaatactaaatacactaagaatattggtattgatacttctgtaaatctaaccagtgttcttcctctctcaggagaaagcaggagcagaccctgtctttaatgtcctggtggtggaccatttcaagtccatcctcaagaagcacatcttagcagtaaatattgcatttttattttatttttaccttaattttattttttaaaagagatggagccttgctacattgtgtaggctaatctcaaactcctaggcccaagtgattcttctgacttgatctcccaaagtgcaaggattgcaggtgtgagccatcacacctggctgaatattgcatgtttttgtgtaattagtagaaacaaacatccctcctctttggacatggagctgtattaatggctgctgtattactggctgctgtcttccagctgtggttttgtcaaagattccaatttagagagccagagtctggataggacagttttaaaggtcattttttgtagctttattctccttaaaagagctccttttccaaaatcagcttagcttagaagatgggctaaaaacgtttttgtagatggactcctctgtacccataccacctcctaaagttccctataatctttcgaataacaataaagtcaccatatttattgaatccttataacagaggagtattcctgtagaagaaatggggaagttaatttaagttatggagagtgcctagactcaagaattttatattcctttagacaaggtctttaaatgttttcctttaatcataatccaatttttaaaatgtgaaaaccaattatggctctaacttttttgctatacttacctctttctattacagacagggatatcaatgaagttcttgagagcatcccagctctctctctgtctaagatgtcacatccctcattacatctcaatgtccctctcagcctgcgctcccaggctccagatacagctgcgaagcctctattacaaacatattcctttgccgatgctgacccctcattgttatttggtaattacttatttccactttagttgactccctatcacagactccacagtgatgattctaattcattccattcttcttaggctcctcttgtgtctccctggtcctctaattagtaaggcatttctttctgtgccaagtggaaaccattacattgtctctctctcttatctatttcaaagacaccgagtctccctccatccgcatctctttcctcctccactgatgctgactcctcaacacatctatagcctcagctcgacctgtcaccagctcgggacattaatgctccattgaatgtccctgtgtctctagcacagtggttaaattcaggaggcctctggagcaaaacctccttctttgaatcctgacactcacttgtttgtacgacctctctgtgccttaatctcctatccaaaatatgaataataatagcaggatttatctcttaggtgtctcatgaagattaaattagctaaagcatttagaactctccacggtgcataataagcagtcaaataatggcagctattatagcattcagccctccttaaattctttctctacctcaactgttttcttaatttccccatgtccttagcatctgggctcttgttttcttatttcaacttttttgtttgaaagcatggtttatacctaccattgaacttgctcatagctgcctgactcaactcctagcaatttcagttgcattccccccaccaataatttcctagacctcagctccaaaggcctgtttcttttcttatctgtcttcatttccccactaacaatgtcttttaagcctttcttcctgcttcacatgcatcaatcaccctgatgctcctagttttccccttttcagatttctttctctacttctacaggtccccttctctccactcctaaaagggtgttacctgaagtttggctctattcttttttgtgtcactgcttctcacactagttgcattataaggctggctgaaacaaccttagaagcagaataattcatactattccaggtcagcaaacttcatgttttaagtcctgtaagtagaaaatattcacatataatgagtgactggaaaatatggtacatcagagttgttggggaagcaagtgtcactaacactgtaatcaaatcaaagtgaacgtatgcacgactgtgaccacagatatcactaataattcccaaccatagggctagtatttctctaaaaaatgggtcagagaattttgctcttgattttcctcaacatgtacaatgtcttagtaaaactaaaaaattttacaaaatacaatatttttaatattcactattttagctaaaactgtaatataatgagaaaagactaagaaaacttatactactacctagatggatttttccttaaaaaataaatagtattcatggttagaattttctaattcaactataagtgagagggagagagaaagagagagagaatttataaaacagtgtgtcttcttacaaaccataattgtttattttatttttgattgaacatgcacacacataaccactggttcaaccacatgtggttcaagtaccacaaatgtacttaaacaaaagttctgtgtacagacatgaaactatgcttagttgcatttcttgttgaagctagtctgaaaatagcaataagtctagagattctaactttagagaactgtcactctgtatttattgtttcaaagatgtatttatttaaaattacagtttcaattagaaatttacagaggtggtcacaagcagttatgtttggagcaaaagcttgtaagtggtaaaaatggaaaagatactgagatgaattcagaacaaccttgaagcatggggtacatcacagggcatttggtgatttaaggcatcatgtaacagtccccaagcacaattatggaactccaaatgagcactgcagttggccacaaatttgtaagtcatattttgatgttcatttaaaacagaggtttttaaatcacggtggagatacaaaatgagccttatttagctgttcagtggaaaactctgaaaaattgttccacggaaacatccattgaatatataacatataaatcaatttggaaaaacagtttgaagttaaaaggcaagagagcaaaatcttggttatgagcaatgcttcaaacgcacaaacaagcagagaaaaaaaaaaactgcttgaagtatcatcaaggtttgtttgtttcaaaagcagcaaggaaggtagaactcctggcaagggatagtttggtggagctctgtgtgggcaagttagattagatttgttctgattcaaaaagaggcacttgagatgtatttttgaggtgtatttttacaggacaaagcattgttgaataatcaagaatatgaagataaattggatttataccaattattagactgaagatacagatgtaaatgatgtaactactttattagttggcctcacttataaagtagtctgtcaagatattgccaaagaacttgaaagtagaacttatgaaaacgtttgcagcaagatgtgagcattagaagaaaaatgttagactcacatctatgttaagcaaacctttggaagcaatagtttgaatcaaagacattatgcccccgactactccagcaactaatgattttatttattcatcccaaagttttgagcttcttgaataccaaccactatgctagatcctggggattcaactccaagtaaagcagacatagtcttaactttaaagtgttttgcatttaccaagagaccactcaaaacaactttttttcttgatttttctcagcatgtaaaatgatttagtaaagctagaaaattttacaatataccatatttttaatatttattattttaggtaaaattctaatataatgagaagagacttagaaagcttgtgccactactagatgtattcttcctgaaaaatataaatagtactcatggttagaattttctaattcaaccataaattagtttatttccatgtaagtaacaaagacatcatgatttaaaaaaaaccctaaatattaatcacttaaacccaggaggtggagtctcactgcattcaatcagttgaacccagtgagacaagattgcaccactacactccagcctgggcaatacagtgagaccctgtctcagaaacaacaaacaaacaaatcctaaatattatgagttaatttattttttatacttaacaacaaattgtgggtcacatgggattgtctagttagcagatttttccctcaaagtcagaacactctcattcaactattaaaaaggtaatgtggtgatggtttttataaatggtagcaaaattataacatgaaatgatagtttgagagttgaatagagatatatcagaatgtgaataatttgaggctcagttcatttacatgtgcaaaaattacagcattagtcacgaaacaaagatcactattcatatttcttcattgaaaatgtccttgctaaatatttccatgggaatgtttaaaacaaaacaacaacaacagcaacaaaaacagtggactagagactcttttagtccacccagacaagtagacaagtgctccaatgactcagcagtaagatagacacattcacatttttggcaagagcagcctgacaacatggcatcatccttccatttatgattctggccttatcttcacacatcattcctcatgcacagatcataaaatctttaaagtgctcacatgtacttaattaatttgagtcctgagaatgaggaaacaccaagacaagaaaaagtgtagtgatactgaaccgaatgtatgtgattagctgtctttaactcagtccaattatacaggaaaatgataaactcgatgaataatatttaggggttagtcttttgctcatcactttcaacaccatgataagtccattagccatcccctcagctgttttcccagttttcacttctagccccatgcaacacattttccacaccctaggcagaggaatcatttacaaacttaaatcagatcgtttaatcttcttgctgaaaaccctcaatgatttgccgtggcatttaaaataaaatctacttctcagcatggtatcccagaaccgtgctcactcttcaatttcattctgcttcatgtttctgtagacttcttttttctccatactaatgagcttctcacacctaaaagcctttacacacgcaaattttttctgtccaggtgacttgtcccaaagtataactgtatcctcgttgttattcagggctcagttcaaaggttacctcttcagagaagtttagtcataccctctcattcccccgccatttttttccttctctctttttttctttttaattttagattcaggaggcacatgtgtaggtttgttacatggatatgttgcatgatgttgaggtttgctcttctattgaacctgtcacctaaatagtgaacattgtacccaatagatagtttcttaacccttgctccactccctccctcttccctcttggagtctctagtgtctattgtttccatctttatatctgtgtataaccagggtttagctcccattataagtgagaacatgaggtatttggttttctgttcctgctttaattcacttaggataatggccactagctacatccatgttgctgaaaggacatgactttgttcttttttatgattgcataatattccatggtatatatttaccacatggtgtatatgtacctaggtgtcaataggcacctagattgactccatgtctttgctgttgccccccaccactcatcatctcatcactatgttttacttccatcatagtacttgttttctgaaatatctcatccattactggtctcttgtctgtctccctctcacaacactgtaagcgtcatcacaggctttgccagtttcagtcacaggcatatccccagggcctggaatggtgtctgatgcatgctggacactcaataaagatttgttgattaaataaatgaatctcaatacagcaaaaccttgtccattagtgctggaatcaggaagaaatgtgtgactacatcatgcagtggaataaagaatctatccatatttttaaagcaaaacacatgatactaaagaaatgttgcattttgaactgtgccatcaaataacttgagttaaaactttcgtgtcctctgctgttctgggtattgtgaatgagttggaaaattctgagaatctctgttctatattctatgcctgatacgatcatgtcctcttatggcctcaactgtcattcacctccaaacagaggaccctgaaatacttctctcttatttcacttctccatttgctaaatgattcttttagcttacaccccagacaacatagactctatttgcccaaatacatcactatttcatggacccagacactcttcctctgttaatcacttatcactgtcaggctgataacctttgagctctctttgcctttttcttctatcttttctgtctctcaacttgactttttcctttagcttcatgttttgggggccccaagatttattttcctttcacactggatacaatgtacattatttgagtaatgggtgcccccaaagccctgccttcaccactgtgcaatctcaacacacatctgtataaaattcttcacatctgttcctttgtttctacagccactatcctgggtctgtctgccctcattgtttgcctaaactattgtgaaatttttctaattggtcttcctcagtataatttttccttccctccaacatatccaccaataaatcatgctctgttcatttcactcaactcaaaacctttcatggttgccgctgactgaaggaagtatcccaattacttgtataaaaatgagtaaaatccatgaaatgcccctgatccatattcctagtttacattcctcaactgcctctttcctcctatagttctttgctttaagacccttctgtgactcaacattctaaaaacttccttgcatttttttctcttttgatctttgatctcaatataatctcttcccagtatgcccttccaatgattcctaaattctaggcactcaatacatattgatttgctgaataaataaacccctgttttgcctcaaggccaagtcaatgacaacttctctaatcttcctcaatccctccagtcagattaccctttccctcctcttaaacatttatgatgcacaataattctattttagcatattgagctcactccactttccagtataactggttagatacatatctgtcctccccgctaaattaaaaattgctttatggctagggccattgttatttttgttttgtttttgttatttatttatttttacttgtataaatgtatggggtacaagtataattttgttacatgcatagattgcatagcagtgaagtcagggcttttagggtatccatcactcaaatcatgtaccttatacccagtgtgaaaggaaaataaatcttggggcccccaaatcactaagctaaaaggaaaagtcaagctgggaactgtttagggccaacctgcctcccattctattcaaagtcacccctctgctcactgagatagatgcatatctgattgcctcctttaaaaaggctaatcagaaactcaaaataatgcaaccattcatctcacttatctgtgacctgtaagttcccgcttccagtcttcctgcctttgcttcaagttgtcccgcctttccagactgaatcagtgcacttcttacatacattgattgatgtctcatgtctctctaaaatgtataaaactaagctatgccctaaccaccttgggtatatattgtcaggacttcctgaggctgttaggggtgcacatcctcaatgccatcttggcaaaataaactttccaaattaactaagacttgtctcaaatcttgaaggttcacaccagtaagtaatctttcatcatctaccacccgccaccaccaccctcttacccttctgagtctctgtttgttcttccatagcatcagttaggcagactgaaggtgattgttgaagttaggatggaggtcaagtgcttgttggtggtggtgatggtgatgatgtggtaaatggagtgagttgtggatgtgctacttgatggtacgggggccccagcatcccccatcctcagagacgggggaatttctcatactgtgcattctattttccaattctggctacctaaaatccccaattaacccaggtatatacaccagtgagctcttagaccataaatgcaagttacagaatcattcccatcatcaaccattgatgcctaaaatgctggattaaagcagcaactggtttaattaatcccaatatcctaaagccctaattacacagacttaaccccaatgtccatgagccaaacactgcttaaagagttggttaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaacaaaaaaacaaaaaacaaaaacaagagttggttaatatccatgatcagtagagctgaaagcaataaactagatacttccaatagaacattcattcctacactcagatttctaaaactcgtcacattctgaagtcagcataaatcaaatcttaaaaagacacatgattttaaaataaactcgctccctattatatttcaaccatagataacatggcataaaattcaatgcttttgtgacacgagtttacctttataacaaaattgcacatataccccaaacctaaattaaatgttcaaaaataaataaataaatgaatttaaaaactcacactacctcgtaaggaaaatctacagtggcctattaatttttgcttttccgtgtaagttttagacccagattggcaagttcccccaaaataaacaagtcagtattttgacttaaattatatcaaatctacagatcagttgatggaccactgcaatttttatgatttggagacttctgatccagggacatggtatggaccttcatgttattttaattcaatgttcccataatttatgcttttgttgaaaatagatatagaataatgtaggacctaaaagaatagtggacaactaagaacacttcacattttatttgtgaaagaatattttctgttagtcagagatatgaattttccttgacatctttagcatcttatgaaatgtatttgggtaaaggagtagtgaggattaaccacctatgattaaagaaaccctgatttagtctatagatacaagaagaggctttttgctttaacaaacatttaattataatgaaaaattttaaaggcctttcactggcaaatagattttaagggaaattaaacatgacaaaggctatttgctttcctttacttcatcacatcagttcccagaacatcctgccattgtagagtaaatcaaaacaaaagccaagcacacacaagggccaaaaaaattggtgaatcctaaatacaagcatgcaggctgctgcagaaattgggaacagcagcggggaggagcctggggataatttccatgtatagcctccctttaaatctgtatttgaatccaaaccaaagcagatgtcagtcagctagccctgcctgatgaagaataatatgtttacataaatttcaatctatctttttacctactgctaaaccaaagttttttactggaattccacatttaaaaattgcaagaaatttatgataagaatatttaactgctggaatagctattaaaattaaacaaataatatgtcttataataagagaaagagagagggagggagagagaaagaaatgagagagaaagagaaacaatgacaggttaaagtaattggaattatttacctcagagaaaataatcaaaacctgatgtaattacatatgcagaaaatatacaacagactgtcagtgaagttgaagcaaattacaagaataattaaaatcagctttgttttctagctattatcttaagaagctataaggaagcgctttattatcaactggttagtgataaacattataaattacctttttaattagtaaagcttctgaagtatttagtaaaacttcaaaaacagaagaatttagtaattcagggaaatacaataaaatcttagtaaaacttcaaaaatagaagaatttagtaattcagggaaatacagtaaaatcttatagattaggctatgtctaagaaaaatgataaccatgatgaagatagtacaaacataattaatgacttcttggatagaatataaatctcgtcccctttagactatggtatgctcatttaatttgatcaatgtgtatagtcacactgaataattcaggctatttagtttggtaaaattagccatacaacttctacttctctattgcgttcttatttctggattacaatgctctttgttaacttctctctttgatgatctcaacactttctattttctgagccattccataactaaacagggtaagagtttccaggactcatttgttttaaatgggaaaggtactcattcccgcaatatgttactttgatgttgcgtaaagcacattgtgagctttggaataatacaaacctgcattcaaatcctaccttttctaggaaagttatgaaacatctcttagctgcttccttaaagtgtcaaatgggagataatttactagataaggtagttgtaagaattaaatgaggtaacatgtgaagcacttactatagagctttccacatagttattaaaaaatgttatttctttccctttgtttgttgtcacaagttcttttagggaaggatgtagagcaaaagatatgcataaacttgtgaaactttaccactgttcagaattcctcagagagagaaactacattcatcttggaaatccatattgcgtactttgaagaactgcagttcttcttgcaaactctttatttctttgaagttaggtcaggagaataatacggcatcattctgtggacaagccatggttattgccaccaaataaaatgtctctgtatcaagaatctggcccttctaaaagtagcatttgtgattagagatcatgtccaggtctatctatacacagtgcccccgccaccccaatatacttttaattgagtttttactcactgagacctacaatatcactggtaaagtatctcagctttcatttgtgctgttgttcggtaaactacaaattttccttgagaaacgagtgacatttattttcaatgtcaatattctacctttggttgtatactgagaaccagaacacaaaaatccccagtaattcatctccagtgtctgataactacctcataaatgatcatggtgtgaagttttgcacgaggattttcaaagaaaagatattcaaacctcttttcaaaagacaattgttgatggttcaacaagaaagaggatgttttggttatcctaccacttttacactccaggaattcaaaaaatgttttaaaagggtgaattttattttatccattttttgccacaatttctaaaacaacaacaaaaaaagagtgagtgatacaaagtagctacacaatctcactattaaagtcaggtaatctccattaattgtaaatattaacttccatgctaattaatttcacccaactgaagtgtaaatatgccctttgcttttgttgacaccctaaggatttagagattctacccattaggatgttgaaaagcagtgtggggtttttgaagaggaacattttcacaccatctggatgaatcaaagggtcatcttagaacacagttgtcaatacaatttctagaatcagtgcagtgaaagtaaagcacccagagaaatttggcaataggcatgtgggaaacagagagtttgctctcagttttttctccaataaaaatattgctaagacatagttccaggatgaaataaaaataatatacactgctagctcagagttatttacatgagctatggataaaggaccacaagatttcaaagcagtctcaggactcttttcttagctagcaaactatatctgagatgatcttgtcctccctctcagaggataagcaggaatttgctgagtagagaagttgtgagaaaggcaatgatgtgggagataggaagaagcaggaaggaaaagcagatatgtaaaggcaagaagcatgcaagtaaaagtcagatttgggggatggtaaagacttcaacatagctagagacagggttatggatgggaagtgcattcatttcccattgcccttacaacaaattaacacaaactgagtggtttaaaacaccacaaataagtcagaagtcctgaattagtcttacagagctaagctaaaatcaggatgtcagtgggattaattgcttctggagatgccaatgggggattcatccctttcttcttccagcttctagaggctttcagcattgcatgccttggcttgcggcttcacaccaatttctacttctgctgtcacattgccttcttctgcctttgaccttcctgcctctctcttaaaaggcccctttataattacatttagggcctgcctggatcatcaaggaaaatccccccatctcaagatccttaaattaaccacatctgcaaagttccttttgacatataaggttacatattcacaggttatggaaattacgacttggatatcttttgaggaccattattcagactaccacaggcagtaatacaacttatgatatttatcatttccgcatgttattcgttacactaggtactttacctgcattatatagccacaatgctctctgtctctgcaagatgagaaatattatgggtgagattcaaaatgtttaaaaacttgtgctcaggggcactgagcaatcagcatgggtcagacacagttctgaagccctcattgctgtacaactctccctctgctgtatgagagagatccacatggtagcctggaagatcatccaggcaaaatgtgcatgcagcagggtgcggtggctcacacctgtaatcccagcactttgggaggctgaggcgggaggatcacctgaagtcaggagttcgagaccagcctggccaacatggcgaaacccagtctctattaaaaatacaaaaattagccgggcatggtgacgtatgcctgtagtcccagctactcgggaggctgaggcaggagaattgcttgaacccaggaggcggaggtggcagtgagttgaaatggcgccactgcacaccagcctgggcaacagagcgagactccgtctcaaaaaaaaaaaaaaagggcatacttgtgtatactgattaaatatcaatgttgagaatagcacatcaaggtaggtcctctgccaggtattttgcattcattattgtacttaatccttattttcaccctctgaggaaggcatttttgtctctgttttacagattaaaattcaaaaggctcaaagaagttaaataacttgcccatgttcacatggcgagtcactctgagaaccaagagccaaactctgtatgcttctagacccccttttccttccatcaagttaggcggagtcttatttaaaaatctaaaataataataaaatttagagatacttaaggattatgaaacccatatgatagtctgtgtaataaattagatattatatttttgaaaatttgtagtgggttaatcttcaatggcagaggtgagggtggccacccctcctcccaaatagggagagtgcaacattatatcaaatgaccaagttaattccttgggaggcacccgatgggctcacttacttgtctcaataattggattgccaaagcaattagagatgtcatgcgggcccctcctaaaaactcaataccaagctggggtcttagcatgagaaagtcttaacatccttgccattcctttgctactagtgccactataacattcccagcagattcaaactgtgattttaaaagatacacaacaaccaaataagttaattatgctcttcacagtttgcttagacatatagaatttaacagccactaaacatgtgaaacactgagtgatgtttcaaaataaagtttggctggaaatattatagttatcatccttcatcattacctggaagatcatattcattttgggttgatatgacacaaatgaatgtattcatgtgaacctgatagattttactgttggttttctgagaaaatattttaaaagaactaaggaaaatcagctacaagttcatgaggtacacatagcttaaaatatctcaaataatgtcctaaagctcatgcagacacacttgtacagctacacagcacataatagtgtaaggacccaccaatccattgttcaagttattctaaggaatacgttttgtttaaaatccagtcccctggtttacaataattcctgtatcaggaaaaaagggtgtgagctcatcagcagagtgaatcacaataactcaaacaggatgattgatgagatagtgaaaaggtgttggtgaatttacacaggccattaacctaataatttattcaactttctctgcaaactcccgtgaatatatccaagaaggcacataaactcatgtctccgaactcttgttaaaagaatattagggaattcacaaagttcacagaattatggggaaaaaaattaataagtcctgagtctcctttatgccctgacactgaagtcaatgttgtcctcttaccaaaaagcaaacacaagcctgactacggcactttgttgcctagttaccctcgtgtcctcacaggcctgggttgcctatctctgtgggaatgaattaaattctgcaaataaactctgacttggacacttcagggtccattggtttactcggactaaactgtgctttgtctataaatggtcctagaatttcattcataattttggaaaggggtagagggaggaaaaacacaaaatacatataaaatctgaaatctgaaatgtgttctatttaaaaacattttgtcttataaaaaacgctacctccatgcaaggaggggggcccattgtgatatgtcagcagagaccagatcacatgcacttcagttacctgcatgccaggttaattcacataggaataggatacgcatatggtttttcatcacagaacaaaactagatgagaatgtatgtggataacactatctggtgggtagggacagggagagagtaagccattatataatcttgaagtttggggcattagggaatattacatgcaatacaatatgttaaaatgcttagcacctatgaattcagcttaattgatgtataaagtatagaaacaaagctcatttgaacataacatttcaatggaaaaaaggatgagcattttttttatcttattggtactagatctttacaaaaagatttaaggttcataaatttcccttaatttgcttcagtttcaaataaaagattatttcattaatttattattgactctcactaatacatataacttactttttagtctgggcccatttgtttacttattcgttgctttcctcattcattggttttaataatgtttatgtgccaatcactgtgctaagtcataaaaattcaaagcaaacaagagggagagtgatctctgccctggtggggtttttgctgaagcagagaagacaggtgattctaaaaataattaatacattacctaaatgagtgttttgaagggagacaggtagcacatctgaaagtctataattcctaacctatttatgtgcaatattgtttagctaaagaaatcaaaggtagttctgaaatatggaacataagcagacaacttttattctgacactttttatttttaaagtgatttcctaagcaaccctaaaatattttaagacaactgcattttttagtcctatgcatattatcaaactgataaaaaataaaattttatatcaaaaatgaaatattgtctaagtgacatatttatatcaccttcattttgcagattttggaaaaatttaggtggctccatggtctttcttgctggttaaatccattaaaaaatatagatgagtaggtcgcgaaaattttctcccattttgtaggttgcctgttcactctgatggtagtttcttttgctgtgcagaagctctttagtttaattagatcctatttgtcaattttggctttggttgccattgcttttggtgttttagacatgaagtccttgcccatgcctatgtcctgaatggtaatgtctaggttttcttctagggtttttacggttttaggtctaatgtttaagtctgtaatccatcttgaattgatttttgtataaggtgtaaggaagggatccagtttcagctttctacatatggctagccagttttcccagcaccatttattaaatagggaatcctttccccattgcttctttttctcaggttcgtcaaagatcagatagttgtagatatgcggcgttatttctgagggctctgttctgttccactgatctatatctctgttttggtaccagtaccatgctgttttggttactgtagccttgtagtatagtttgaagtcaggtagtgtgatgcctccagctttgttcttttggcttatgcaggctcttttttagttccatatacacagcaaaagaaactaccatcagagtgaacaggcaacctacaaaatgggagaaaattgtcgcaacctactcatctgacaaagggctaatatccagaatctacaatgaactcaaacaaatttacaaaaaaaaaacaaacaaccccatcaaaaagtgagtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatgccattactgggtatatacccaaaggactataaatcatgctgctataaagacacatgcacatgtatgtttattgtggcactattcacaatagcaaagacttggaaccaacccaaatgtccaagaatgatagactggattaagaaaatgtggcacatatacaccatgcaatactatgcagccataaaaaaatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacacactggggactgttgtggggtggtgggaggggggagggatagctttaggagatatacctaatgctaaatgacaagttaatgggtgcagcacaccagcatggcacatgtatacacatgtaactaacctgcacattgtgcacatgtaccctaaaacttaaactataataataataaaagaaaaaaaataaaaaaaataaaaaatatagatatatatgacaaggttcttaggacccaactacatctgtggctttgagaccatataatcccatgtctttagtttaatctacaccaagtagtattcatttacaatttctgatattcaagatgtttcctagcttttcaaagacccatagatgtcctttcctcagtggtaaaattgtaatagccaccatcaggaaattctgctattgtgctaaggttcctttctttctcttttgaagagcaaaaaataaacagagccagttacagcacaatggctgcccaggcttccccacttaacattcctgaacatatttattgtggaaataaattctgataatattgcaagtattttatttttatcattcatttagaaatatattttgaatgccccattcactctatcaaaactggaaacacttccttttcaattttcccaattacctttatttcttaagatgaagttatttaaatttcacaagtagaagaatattggactaatttatctatgtgtagtttccatcagccacaatttttgtatttgattagcgtctaagcaaaattcttttctgagtttttctaatatgaaggtttacagctcatcacacagaaaaagcaaagcctcttttttggtactagtgtgctgctgtgtagaaagaccagtgttgtcacatcaccagcaggatgggagctgtggcttgcttttctagtagagtgggatgctgtgattatctgcctctactctctcaccaatttcccctttgaataaaaggtaaatgctgatgagcctccaggttgggtggaaattccacctgtagatgtagaataacattgtcctaattaatgttgtatatgtctacagtctgtgctttatctcactataactttcaccaaatgaattaattagctttcattttggttatatacaaccattactcagaaatgcatacttcatggaaattatttccatgttcttaaccatttaaattaggattattgatatgaggtaatattttaaaaataaaatgaccaattgtgtactatacatacagttaatattaggtgtatgcacattcaaaactaatgatacattataatataatgaactatttttctttactgcctctgtccattccctaagtattctgtccgataattaaaaacagacataaactattattaccctaaatgttaattcttgttccatttactgaaaaactcaatgaggtaacattttaaacaatggtttcttctttaagatttttatttacaattaagtgagcccgaattctttcgtaactgtgttgaaaacaaaactctcctcactataagttgaatgctttagctgattaaaataaaagtattttagtattttagctggttaaaataaaagctcatgaaaggctcactgattcatattagtaacttcagttttataatttaactgccattatagttcttataaaaaatttccatcattaaatcacaaactgctccaaatttttattttgagaagcaatatgttcataaatgaagctttggattattagatatatagatagtatattcatctcattgttgaaagttgaaaattttggtcgatagtcacggcttggctgatttcttcatagaattctctatgtatgttctacatgacattgctatgacactaatgtccaaagcctccatttctcttgagaaaaaaaaatcacttcttgtcatgtttcaatcaccctctgagacgaagccacacacagatgaaacaatagctaattctttaaggcaactaggaactcttttgtgccctggcaggatagtgtttgaaacttgtaatatggtatacagttctaatggtaacatttgaaaataagtgaattacagtggctggctggcaagatggccgaataggaacagctccggtctgcagctcccagcgagaccaatgcagaaggcaggtgatttctgcatttctaacggagatacccagctcatctcattgggactggttagacagtgggtacagaccacggcgtgtgagctgaagcagggttgggcatcaactcacctgggaagttcaaggggttggggaactccctcctctagccaagggaagccatgagggactgtgctgtgaggaatggtgcattccggcccagatactacacatttcccacagtctttgcaacctgcagaccaggagattcccttgggttcctacaccaccaggatcctgggttttaagcacacaactgggtggctgtttgggcagacaccgagctagctgcaggatttttttttttttcataccacagtggcacctggaaggccagtgagacagaaccattcacaactgtggaaagggggctgaaaccaaggagccaagtggtctagctcagcggatcccacccctgtggagcccagcaagctaagatccactagtttaaatttcttgttgccagcacagcagtctgaagtggacctgggacacttgagcttggtgaggggaggggtgtctgctattactgaggcttcagtaggcggttttctcctcacagtgtaaacaaagccaccaggaagttcaaactgggctcagctccacaaagccactgtagccagactgccttcctagattcctcctctctgggcagggcacttctgaaagaaaggcagcagccccagtcaggggcttatagataaaattcccatctccctgggacagagcacctgggggaaggggtgcctgtaggcgctgcttcagcagacaaacattcctgcctgctggctctgaagagagcagtggatctcccagcgcagtgcttgagctctgctaagggacacaatgcttcctcaaatgggtccctcacccccgtgcctcctgactgggagatacttcccagcaggggtcgacagacacctcatacaggagagatccagctggcatctggtgggtgcccctctgggaaaaaccttccagaggaaagaacaggcagcaatctttgctgttctacagcctctgctggtgatacccaggcaaagagggtctggagtggacatccagcaaactccagcagacctgcagcagagaggcctgactgttagaaggaaaactaacaaacagaaaggagtagcatcaacgtcaacaaaaaggatgtccagtcagaaaccccatccaagggtcaccaacatcaaagaccaaaggtagataaatccatgaagatggggaggaaccagtgcaaaaagtcttaaaattacaaaaatcagaatgcctcttctccaaaggatcacaactcctcaccagcaagggaacaaaactggatggagaatgaatttgacaaattgacagaagtagacttcaaaatgtgggtaacaacaaatggctccgagctaaagaagcatgttctaacccaatgcagagaagctaagaacactgaaaaaaggtgagaggaattgctaactagaataatcagtttagagaagaatataaacgacctgatggagctgaaaaacccagcacaagaacttcctgaagcatacacaagtatcaatagccaaattgatcaagcagaagaaaggatatcagagattgaagatcaatttaatgaaagaaagggtgaagacaagattagagaaaaaagaatgaaagggaaagaacaaagcctccaagaaatatgggactatgtgaaaaaaacaaacttacgtttgattggtgtacctcaaagtgatgggagaatggaaccaagttggaaaacacccttcaggatattatccagtagaatatccccaacccagcaagacaggccaacattcaaattcaggaaatacagagaacaccacaaagatactcctcgagaagagcaaccccaagacacataatcatcagattcaccaaggtcgaaatggaggaaaaaatgttaaggacagccagagagaaagctcaggttactcacaaagggaagcacatcagactaacagtggatctctctgcagaaaccctacaagacagaaaagagagggggccactcttaaaggaaggaattttcttttttttttttttaaggttaaggaatattaaagagtttattttatgctcatttattccttcttgaaagctcttcttttctttacgtagatttcagtttttgacctatgtcatttcatttctgaccgaaaaatttctttcaacatttatttcaaggcaggtctactggtgacagattcagcctttgtctgagaaagcatttcttctttgcttttgaaggatagtttcactgtatccagaattctagttttatcctttaaacactttaaatatttcacgctaccttcttctttcttgcatggttgccaatgagatttctgatgtaattcttatccttgtccctccttaggtaaatttcttctcttctgtagcttctttcatgttttctggttgtctttagttttctgtgatttgaacataatatgactaggtgtggactttttttttatactcaacaataatttattgtatattttcaaatagctaaaagaggagaattggactgtttctaatacaagacatgataaatgcctgaggtgatggacaccccaattgccccaataagattattatatattgtatgtatcaaaatttcacatgtatcccatagatatatacacttattatgtacccataataattaaaaacaattttttaaaagatcctgtttcttaacatctttgacacttcatttatactctagtttttccttttttttatattatactttaagttttagggtacatgtgcacaatgtgcaggttagttacatatgtatacatgtgccatgctggtgtgctgcacccactaactcgtcatctagcattagctatatctcccattgctatccctcccccctacccccaccccacaatagtccccagagtgtgatattccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcatgttttatggccgcatagtattgcatggtgtatatgtgccacattttcttaatccagtctatcattgatggacatttgggttggttccaagtctttgctattgtgaataatgccacaataaacatacgtgtgcatgtgtctttatagcagcatgatttatagtcctttgggtatatacccagtaatggcatggctgggtcaaatggtatttctagttctagatccctgaggaatcgccacactgacttccacaatggttgaactagtttacagtcccaccaacagtgtgaaagtgttcctatttatccacatcctctccagcacctgttgtttcctgactttttaatgatcaccattctaactggtgtgagatggtatctcattgtggttttgatttgcatttctctgatggccagtgatggtgagcattttttcatgtgttttttggctgcataaatgtcatcttttgagaagtgtctgttcatgtccacccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcctatttgtcaattttggctttggttgccatggcttttggtgttttagacatgaagtccttgcccatgcctatgtcctgaatggtaaagcctaggttttctcctagggtttttatggttttaggtctaacatttaagtctttaatccatcttgaattgatttttgtataaggtgtaaggaagggatccagtttcagctttctacatatggctagccagttttcccagcaccatttattaaatagggaatcctctccccattgcttgtttttctcaggtttgacaaagatcagatagttgtagatatgcagcattatttctgagggctctgttctgttccattgatctatatgtctgttttggtaccagtaccatgctgttttcattactgtagccttgtagtatagtttgaagtcaagtagtgtgatgcctccagctttgttcttttggcttaggattgacttggtgatgcgggctcttttatggttccatatgagctttaaagtagttttttttccaattctgtgaagaaagtcattggtagcttgatggggatggcactgaatctttaaattaccttgggcagtatggccattttcacgatattgattcttcctacccatgagcatggaatattcttccatttgtttgtatcctcttttatttccttgagcagtggtttgtagttctccttgaagaggtccttcacatcccttgttaagttggattcctaggtattttattctctttgaagcaattgtgaatggtagttcactcatgatttggctctctgtttgtctgttgttggtgtataagaacgcttgtgatttttgtacattgattttgtatcctgagaatttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgctctggtcagaacttccaacactatgttgaataggaggggtgagagaaggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagcattgttgaattttgtcaaaggccttttctgcatctattgagataatcatgtggtttttgtctttggttctgtttatatgctggattacatttattgatttgcgtatattgaaccagccttgcatcccagggatgaggcccacttgatcatggtggataagctttttgatgtgctgctggatttggtttgccagtattttattgaggatttttgcatcaatgttcatcaaggatattggtctaaaattctcttttttggttgtgtctctgcctggctttggtatcaggatgatgctggcctcatcaaatgagttagggaggattccctctttttctattgattggaatagtttcagaaggaatggtaccagctcctccttgtacctctggtagaattcggctgtgaatccatctggtcctggactctttttggttggtaagctattaattattgcctcaatttcagagcctgttattggtctattcagagattcaacttcttcctggtttagtcttgggagagtgtgtgtgtccaggaatttatccatttcttctagattttctagtttatttgcgtagaggtgtttgtagtattctctgatggtagtttgtatttctgtcggattggtggtgatatcccctttatcattttttattgcgtctatttgattcttctctctttttttctttattagtcttgctagcggtttatcaattttgttgatcctttcaaaaaaccagctcctggattcattaattttttgaagggttttttgtgtcactatttccttcagttctgctctgattttagttatttcttgccttctgctagcttttgaatgtgtttgctcttgcttttctagttcttttaattgtgatgttagggtgtccattttagatctttcctgctttctcttgtgggcatttagtgctataaatttccctctacacactgctttgaatgcgtcccagagattctggtatgctgtgtctttgttctcattggtttcaaagaacatcttaatttctgccttcatttcgttatgtacccagtagtcattcaggagcaggttgttcagtttccatgtagttgagcggttttgaatgagattcttaatcctgagttctagtttgattgcactgtggtctgagagatagtttgttataatttctgttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattccagggtatccttgttgactttgtgtctcgttgctctgtctaatgttgacagtggggtgttaaagtctcccattattaatgtgtgggagtctaagtctctttgtaggtctctcaggacttgctttatgcatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatggttttcctgattacagcacactgatgggtcttgactctgtatccaatttgccagtctgtgtcttttaattggagcatttagtccatttacatttaaagttaatattgttatgtgtgaatttggtcctgtcattacgatgttagctggctattttgctcgttaatcgatgcagtttcttcctagtctcgatggtctttacattttggcatgattttgcagtggctggtaccatttgttcctctccatgtttagtgcttccttcaggagctcttttagggcatgcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttttggcattctctgtatttcctgaatctgaattttggcctgccttgctacattggggaagttctcctggataatatcctgcagagtgttttccaacttggtcccattctccccgtcactttcaggtacaccaatcagacatagatttggtcttttcacatagtcccatatttcttggagggtttgcccgtttctttttattcttttttctctaaacttcccttctcacttcatttcattcatttcatcttccatcgctgataccttttcttccagttgattgcatcagctcctgaggcttctgcattcttcatgtagttctcgagccttggttttcagctccatcagctcctttaagcacttctctgtattggttattctagttatacattcttctcaatttttttcaaagttttcaacttctttacctttggtttgaatgtcctccagtacctcagcgtaatttgattgtctgaagccttcttctctcagctcatcaaagtcattctccatccagctctgttccgttgctggtgaggaactgcgttcctttggacgaggagaggcactctgctttttagagtttccagtttttctgctctgttttttccccatttttgtggttttatctactattggtctttgatgatggtgatgtacagatgggtttttggtgtggatgtcctttctgtttgttagttttccttctaacagacaggaccctcagctgcaggtctgttggagtacccagccgtgtgaggtgtcagtctgcccctgctgggaggtgcctcccagttaggctgctcaggggtcaggggtcagggacccatctgaggaggcagtctgcccgttctcagatctccagctgcatgctgggagaaccactgctctcttcaaagctgtcagacaaggacatttaagtctgcagaggtcactgctgtctttttgtttgtctgtgccctgcccccagaggtggagcctacagaggcaggcaggcctccttgagctgtggtgggctccacccagtttgagcttcctggctgctttgtttacgtaagcaagcctgggcaatggtgggcgcccctcccccagcctcgctgccaccttgcagtttgatctcagactgctgtgctagcaatcagcgagactctgttggcgtaggaccctccaagccaggtgcaggatataatctcctggtgccgttttttaaggccgtcagaaaagcgcagtattcaggtgggagtgacccaattttcccggtgctgtctgtcacccctttctttgactaggaaagggaactccctgaccccttgtgcttcccgagtgaggcaatgcctcaccctgcttcggctcgcgcatggtgcatgcacccactgacctgcgcccactgtctggcactccctagtgagatgaacccagtacctcagatggaaatgcagaaatcacccgtcttctgtgacgctctcactgggagttgtagaccagagctgttcctattcggccatcttggctcctcccccaggaaaagaattttcaacccagaatttcatatccagccaaactaagcttcaaacgtgaaggagaaataaaatcctttacagacaacccaatcctgagagattttgtcaccaccaggcctgccttacaagagctcctgaagaaagcactaaatttggaaaggaacaaccggtaacagccactgcaaaaacataccaaactgtaaagaccatcaacactatgaagaaactgcatcaactaatgggcaaaataaccagctagcatcataatgacaggatcaaattcacacataacaatattaactttaaatgtaaatgggataaatgccccaattaaaagacacagactggcaaattggataaagaggcaagatccattgttgtgctgtattcaggagaccaatctcacgtgcaacaacacacataggctcaaaacaaaggggtggaggaatatttaccaagcaaatggaaagcaaataaaaaagcagaggttgccatcctaatttctgataaaacagactttaaaccaacaaagatcaaaaaaagacaaagaagggcattacataatggtaaagggatcaatgcaacaagaagagctaactatcctaaatatatttgtacccaatacaggagtactcagattcataaagcaagtttgtagagaactacaaagagacttttagactcccacacaataatattgggagactttaacaccccactgtcaatattagacacatcattgagacagaaaattaacaaggatattcaggacttgatctcagctctggaccaagcagacttaataggcatctacaggactctccacccaaaatcaacagaatatacattcttcttagcaccttgtcacactgattctaaaattgaccacataattggaagtaaaacactcctcagcaaatgcaaaagaacagaaatcataacaaacagtctctcagaccacagtgcaaattagaactcaggattaagaaactcactcaaaaccacacaactacatggaaactgaataacctgctcctgaatgactactgggtaaataatgaaattaaggtagaaataaataagttctttgaaaccagtgagaacaaagatacaatgtaccagaatctctaggacacagctaaagtactgtttacagggaaatttataggaccaaatgcccacaggagaaagcaggaatgatctaaaatcgacaccctaacgtcacaattaaaagaactaaagaagcaagagcaaacaaattcaaaagctaacagaagacaagaaacaactaagaccagagcagaattgaaggagatacagacatgaaaaacccttcaaaaaatcaatgaatccaggagctgtttttttttaaaaaagattaacaaaatagatagaccactagccagactaataaagaagaaaagagagaagaatcaaatagacacaataaaaaatgataaaggggatatcaccactgatcccgcagaaatacaaattactatcagagtatactatgaacagctctatgcaaataaactagaaaatctagaagaaatggataaattcctggacacatacaccctttcaagactaaatcaggaagaaattgaatccctaaatagaccaatacaaagttctgaattgaggcagtaattaatagcttaccaatcataaaaggcccaggaccagacagattcacaactgaattctaccagaggtacaaagaggagctggtaccattccttctgaaactactccaatcaatagaaaaagagggagtcctccctaactcattttatgaagccagtatcatcctgaagccaaagcctggcagagacacaacaacgaaaaaatttcaggccgatatccctgatgaatatctatgcaaaaatcttcaataaaatactggcaaacagaatccagcagcacatcaaaaagcttacgcaccatgatcaggtcagcttcatccctgggatacaaggctggttcaacatatgcaaatcattaaacataacccatcacataaacagaaccaatgacaaaaacctcatgattatctcaatagatgcagaaaaggcctttgataaaattcaacaccccttcatgctaaaaactctcaatacactaggtattgatgaaacatatctcaaaatagtaagagctatttatgacaaacccacagccaatatcataccaaatgggcaaaagctggacgcattctctttgaaaacaggcacaagacaaggatgtcctctctcaccactcctattcaacacagtattggaagttctggccagggcaatcaggcaagagaacgaaataaaggatattcagatagaaagagaggaagtcaaattgtctctgtttgcagatgacatgatcatatatttagaaaaccccattgtctcaggcccaaatctccttaagctgataagcaacttcagcaaagtctcaggatacaaaatcaatgtgtgaaaatcacaaacattcctatacatcagtaatagacaaacagagagccaaatcatgagcaaactcccatttacaattgctacaaagagaataaaatacctaggaatacaacttacaaaggatgtgaaggacctcttcaaggagaactacaaaccactgctcaaggaaataagagaggacaaaaacaaatggaaaaacattccatgctcactgataaaaagaatcagtatcatgaaaatgcccatactacccaaagtaatttatagattcaatgctatccccatcaagctaccactgactttcttcacagaattagaaaaaagctactttaaatttcatacagaaccaaaaaagagcccacattgccaagacaatcctaagcaaaaagaacaaagctggaggcatcatgctacctgacttcaaactatactgcaaggctacagtaaccaaaacagcatggtactggtaccaaaacagatatatagacaaatggaacagaatgtagacctcagaaataatgccacacatctaaaaacatctgatctttgacaaacctgacaaaaacaagcaatggggaaaggattccctatttaataaatggtgttggggaaactggctaaccatatgcaggaaactgaaactggaccccttccttacaacttatacaaaaattaactcaagatggattaaagacttaaacataagacctaaaaccataaaaaccctagaagaaaacctaggcaatactattatggacataggcctggccaaagacttcatgactaaaacaccaaaagcaatggccacagaagccaaaattgacaaatggaatctaatcaaagagcttcttcacagctgaagaaactatcatcagagtgaacaggcaaactacagaatagggaacatttttgccatctatccatctgacaaaggtctaacatctagaatctacaaggaacttacacaaatttataagaaaaaaacaaagaaacccatcaaaaagtgggcgaaggatatgaacagacacttctcaaaagaagacttttatgcggccaacaaacatataaacaaagctcattaccactggtcattagacaaatgcaaatcaaaaccacaatgagataccatctcatgccagttagaatggtgataattaaaatgtctggaaacaacagatgctggagaggacgtggagaaaaaggaatgcttttacactgttggtgggagtgtaaattagttcaaccattgtggaagatagtgtggcaattcctcaaggatctagaaccagatacaccatttgacccagcaatcccattaccggatatatacccaaagaaatataaatcattctactgtaaagacacatgcacatgtatgtttattgcagaactgtttacagtgcaaagacttggaaccaacccaaacgcccatcaacgatagactggattaagaaaatgtggcatacataccatggaatactatgcagccataaaaaggatgagttcatgtcctttgcagggacatggatgaagctggaaaccatcattctcagcaagctaacacaggaacagaaaaccaaacaccgcatgttctcactcataagtgggatttgaacaatgagaacacatggacacagggaggggaacatcacacaccagggcctgtcggtgggtggagactaggggagggatagcattaggagaaatacctaatgtagatgatgggttgattggtgtggcaaaccaccaaggtatgtttatacctatgtagcaaacctgcacattctacacatgtatcccagaaattaaagtataataaaaaaaaataagttaattataaactaaaggatagtcatcaagagttcataagccttttaaagtattctctcctaaataagcatattttatactttatcaaatgatgttgtctttcctaggtatttctacctgcagaaaacaaactaataaacaaaaccagaccaaaactgtgggaagaagaaagcaggctgaatacaaaacatgttgcataggaaattccaagctttatctctaattataaaatgtctagaatactgcaggcagcaaaaagcaactcaacgaatataaagagataactacagatgtgaagtcattatcaaagactaaggagaagaaataaaaaaaaggttcaatcatgtagcccattacaaagatcaatggcatcaataaacactgccttatgttccaagttgcatatacatcagctttcccagcagctaggagccttggcagctccgagagaccagggaccagacaatatatcttttgatttatcatgattatttatatggtgttatagattgcaaatatatattaaatttaattaaatatctgaaaaaagatataaaatcacaaaaactaaaaccttacaaaagcttcaaacttctagcaacaatggcacttacataggagtcttagccaaggagcaaggaaagaaagtaagtggggtcaatgtctcttaggtgtgcacacatctctgtggttaatttcctcatacctttcttcaaagcccaagataagtaagttataaaatttgtttagaacaattgagcccattctcctttccattagcattagatggctaaactataccaatagcttattgtaattgaaagactaagccttctacacaaaatgtatatattggaataaccataaatgtaatatatatatgaaagtcgtgactgcatactataagatagcaacacatgtgctttgtactaagcactttcatatatctcacttcatcctcaactctgattgaaacttatccaataagacataaaaaattgaaaagtgaagttcagtgactcaatccaaggtcactcagtcagtaagtggtagagaggattcaaagccaggcagtctgactttagagcctatgctcttaaccactaccatatccactctctttcatactacaggttggaggaaccatggaaagaaagtagtaacacaaagaagcaaaatcaattataaggagggataaagggaaggaagaaaaggcttaacaaagaaaccaaaagggaaaggagaagcaaggaagggaagaaaggaaagaaagacaagatataggtactaataaaagaaggcagttgcatgaagttctgtgtccttgctgtatgattttctcagtgaaattgtaggaaaatgagaaatcttcatctcctctcagcataaaacattaagtgccatatcaaaatctcataaaagaaaataccaatatatgtatgagtcacacttccacttctactccccaaaattgcctgatttcttcattgtaagtaagatattgggtctcccttgaatgaacccatcgcagcattttctatttcagttcataatacagaaaatcgctgcctatattaaacaccttttcccaatgaggctggcaggctgcactgagaatcagaggcaccaacccccaaacaagttttcactgagactctgctcaaatgtctgtcataatgtgaatgatgaaggaagacgggaagcagcagtagcaggacaatctgtcaaaaaaaaagcatagccagccacagggatcagtgtttttatgctaactagatttccccgcaaatttaagtggaagagagacagcagagggtttattagcatatatgtggaggggagggaggggctgtcaatgagctctggatgatcatacagtttcttcctgttctatgattccgtatatctataatttcaaagcacaatgatatatttgcaaagggaagtcaagaggcccaagttctgggctctgctctcagtcttaagcaacctgtctaatttttctgggcctaggtttccgtatctttaaaatacagtgtcctttttagcttttataatctatgactttttgatgacaactacctttgatgatcaccattttgtacataaaagccagcacgtgcacaagtatgcaaacacatacacacacaaacatgagctctaatttgatattattatgactctctacctccaggtagaactatagctattttattcaagatcagtgtttatgtaacctaaaaatttatttggatgacacatttaatatcttactaggaaacctattccaacacctatcaacagaaacttaaaggaattttcccacatatataaacaattgtttttgaattggtttttaaatcctacattaaggcaaataaaagtcttgagttcttctattggctcaggtatataatttcatgcccacttatatttgatgaaactaaagtctctacacagaataaattagaaactagagatatttagatgatgaaagtaaaactacatcaatcaggattatcaatgaagatgctaagtaaatgaaaataaagatcagtaaccaacacagcaagtaatcacagttgtgaaatttgagaagcaacaatatacaaatgttaggatgtatttatctttacatgcagccttctaggtcatctgcaataaggtatttgaaggtacatatgcctggaattcagtcatgaaaaaataaaaagagtaatatctgaacaaatatttctcctatttcaatactcagctccagccacacctcctctccaaagtttttcctcattcagtttctccattcctcttcagtgccttctgtccccagccctgtagaactgtgtctgtcttgcacatagaaaactgtattgctcttatttttttattttgatgctggtctcccattagctagtgttgagtttttgaggacagtgaatatgtattatttgacttgcacaatgcctagcactctgtaaatatcgagataaataactaatttatgtaaatataatactggattcctatctgtaacatgctgttaatgtagagtatattgaaataagatttgggtataggtacttatgaccaaagccatttttcatttgaagaaaatagaagttatatattcctgtctctagattaacaacatagcattacaactgactacagtaatgttaatggaacaaaaagcttaacatctgatatatataccaaaggtctatagtcccctaaaattgtatagaacatgtttgggaaagtatgactattattctggaaagatagattctctaaatcttctgctttgtagtttattgattctggatgctctatgtttaagtgtgataaatggcaagaaaatactgatcctcagtcaaacccaaggaacagcaaggtacccgaaattgaggtttaaagaacactttttaaaatggtgggaatttaaagcctcctgaatatataacttaagttttgagcattttgagctattttgattaatctcactcctgtttcttcactaaaacccttcctgagtatgattaaaaacagtgaaataaatagtgtgctaaactttgagccttcttgattttgttctgagttttttgttttgttttgtttcttgcatttgatctgctgacttcatatgctaagagattactattctgcaagcagtgactgaaaccaaaataatgaaaagtgaaacaacatcttcagagttaaataataacatccccataaggattatttataaattacaaaatcttactcttttccttttcagtgttagcactgttattataaaattgtctatccatatttataaagatataaatgaaagtaatatctccagaaaatgtaatctctacttttaccttgtctcctggggaagagaagatgaaataaacttaaaagctgctaaaagtatttctacataaagctcttttatgggatggaactgagagttgtttaaaaaatcataaaagttagaatatccccataatcatgtacaagtttaccattaaaatacaataaaaagacagctcatactgccaatctcttgttgccctataacattttgagaaaaaattaaaaggcagtattgtcactcatacgagagataccgtatgaaagcatcataacatgaaaatcttcctcatttttttaaaaataaaataaatcccaaatcacagttattcattgttttaaaattctgaatagttatattaatttcaacctttatgtatatattcagaaaaatgatatccataccattctttctagcttcttcaggaaactagaaacatcaatgaaattagaagttctatctatcttttttggcattgtcatatgtgtgtgtgtgtgtgtgtgtgtgtgtgtgtgtctgtattcaataaacatgttatttctccattctgtatgatacagtaatggtggatacatgatataatgtaattggcaaaacccaaaacacactggagattttcctgagaactaagttttaagctgttggcaccagagaacactgttggcagctgtctgtgatctttccacttcccagtttcttgcattctagtagcaacttctctaatcacctaactccaagttctcagaatgaccatgtaaccttttaattacctgtattacataatatcttgtgtgaactacctagaatagcatatatttccctgatgaatctggtcatatgtatttacaatctttcccatcttagatgtcactaaaggggagaaaagtacaaaaccctaatggtagtaaggaactgaaagagagtcatgagaatacaaaatatgtcaacagatgtatagatgacaaagcagataaagaagagatagcacatgaaatagagtcaaccacaggttagattatctagaagggatataaatatgacagactgagagagagaaattgcctttccagaaaggctaagaattccaaaacaccacatgcaatgaagacaggaaagggtacaggagtgacatggggaactgacaattacaagtatctatgggtagaaatagccactatccaaccctgcaggaaagaggacacccaggagacaggcctctccagcttagagaaatatttgaggattctttataacttcactaaaataaaacctttctaaatcaaaataatagctccagacaaaagacttccatcatctggcatgttctgatcccccccaggaaaactgttaattcatagccccatgactccaaagcaaagtgcaagtcagagcccaatcagcttttcattccttaaacttgaataaaattataatcatagctcatcaggcatctaaagaaagcttgctttgaaaaaagacagtccaagatacacaaataaagataaaataaccccaagtgaagataatttggagaagagaagaaaattcataaatactctaataattattctatgagagatttaagaaaatcttgatttccatcacaaagttctctctctcttgctctatgtttctccatcccccagtagatatgcccacactactttgataaaattcttttaaatttgaagaagttactctaaaaagggaatttttaagttaattcagttatttgatttatcctcttccatctatttagaattacagcagagctttgtaaaagccaacattttggttataaagacacctttttctatctgttcccatgtgtggagactaaagcaactccatcttcattgtcagtccaccatactgacatctgatttaccccagttccaggaatgcctctaagatttatactttacctactgttaccataaattctaccctttgttcaaaacagcctcaaccataaatccttcccttaggcagatttacatagcatgcttgcctttccctgaggagttgatttcaactgtcctacatgttccttcactacagcaaataattcctaggtctggggctaacactgcagtgaaccaccatctcctcttgcagccacctgggacctggctattaaatgttttttgttttttcatttttcctgagaagctggatatgtcagcctcttcagcctctcagcttccttgaactttgggggtaggtttgcatagatctattcactgcagaacaccatgtaatcttagaatttggtaattggtatctcgatagatgcagaaaagaccttcgaaaaaattcaacatcctttcatgataaaactctcaataaactagatattgatggaacatttcccaaagtaataagagctacttctgacaaacccacagccaatatcatactgaatggccaaaagcgagaagcattccctttgaaaactggcccaagacaaggatgccctctctctccactcctattcaacatagtattggatgttctggccagggcaatcaggcaagagaaagaaataaagcgtattcaaataggaaaagagaaagtcaaattgtctctgtttgcagacaacttgatcctatatttagaaaaccccattgtctcagccccaaatctccttaagctgataagcaacttcagcaaagtctcaggatacaaaatcagtgtgtgaaaatcacaagcatttctttacactaacaatagacaagcagagagccaaatcatgaatgaactcccattcacaattgttacaaagagaataaaacacctaggaatacagctaacaagggacatgaaggacctcttcaaggagaactacaaaccactgctcaaggaaataagagaggacacaaacaaatggaaaaacatcccatgctcatggataggaagaatcaatatcatgaaaatggccatacagcccaaagtagtttatagattaagtgctattctcatcaaactaccattgactttcttcacagaattagaaaaaaactactctaaaattcatatggagccataaaagagcccgtatagccaaaacaattctaagcaaaaagaataaagctggaggcatcacactacctgacttcaaactatactgcaaggctacagtaaccaaaacatggtacaggtatcaaaacagacacatataccaatggaacagaatagagacctcagatataagaccatctgatcttcaacaaacttgacaaaaacaagcaatggggaaaggattccctgtttaataaatgatgctgggaaaactggctagctatatgcagaagactgaaagtggaccccttccttacaccttatacaaaaatcaactcaagatggattaaagacttaaatgtaaaacccaaaaccataaaaaccctggaagaaaacctaggcaatcccattcacgacataggcatgggcaaagattttatgatggaatcaccaaaagcaatcacaacaaaagctaaaattgacaaatgggatctaattaaagagcttctgcacagcaaaagaaactgtcatcagagtgaacaggcaatctacagaatgggagaacatttttgcaatctacccatctgacaaagggctaccatccataatttacaaggaacttaaccatatttacaagaaaaacacaagaaaacccattaaaaagtgggcaaaaacatgaacagacacttctcaaaagaagacattcatgtgggcaacaaacatatgaaaaaaaagcacaacatcactgatcattaaagaaatgcaaatcaaaaccacaatgagataccatctcacaccagtcagaatggcgcttattaaaaagaagtcatgaaacaacagatgctagagaggctgtggagaaagaggaacactttttcattgttggtgggaatgtaaattagttcaaccattgtggaagacagtgtggcaactcctcaaggatctagaaccagaaataccatttgacccagcaatcccattactggataaatacctagaggaatataaataattctattataaagacacgtgcatatgtatgtttattgcagcattatttacaatagcaaagacatagaaccaacccaaatgcccatcaatgatagactggataaagaaaatgtggtacatatacaccatagaatactatacagccacaaataggaatgagttcatgtcctttgcagggacatggatgaagctggaagccatcattcacagcaaactaacacaggatcagaaaagcaaacagaaatccatcttactcataagtgggagttgaacaatgggaacacatggacacagggaggggaacaacacacaccagggcctgttgggtcatgggggcacgaggggagggagagcatcaagacaaatagctaatgcatgcagggcttaaaacccaggtgatgggttgataggtgcagcaaatcatcgtgacacacatatactgtgtaagaaacctgcatgttctgtatatgtatcccaaaacttaaagaagaaagaaagaaagaaagaagaaagaaagaaagaaagaaagaaagaaagaaagaaagaaagaaagaaagaaagaaagaaggaaagaaagaaagaaaaagagaaagaaaaagaaagaaagaatttggtaattggggagaaaggaagaacctcaatacaggaatatatttatgtaaacattaggatccactcttaggtataaagtgattctttcttaactttataaatatttattgagcaaatgctttgtctaattgtgtcaagtacagagaggttggaaaaggtgtgggaagtagcatcaagaaggatgtttgtccatttaacagagaaagattagtaaaatatgaaaccagctttgcaaagattataacaatgagagaaggctagcatggctgactccatcttgcttctagcctcagagggtggctttccttgcttgttcctgggtgtaggccaaccttgccaagggagaaatttagtttatagtttgaaagagatggagattgagaatgagatcgaaacaatgctaaaatggttgttatgaaagctcccttgaaagctatctggaagagtaaaaatgctatatgtgaggcacttagcacaaagtctaaaatatttaagtgctaaataagtaagtataactgattttaatagattatttttgatggataaagaggtaggtaagtgagatttgcatggaggtgatggctggcataatttggaacaattaagcctgagaatctagatagtaataaaaagattgagggtttacagaagatactgcctttgaggagcatggattttgacagatgacagtgatacaggtcaaaatgcatgtttactttaggggtaggatggagtaggggtcagccatagattggcccgaggagatgtgcccatgacacaattgtatacattatgcatcttttgaacacaaaagtcttcctggaactatgatacctaaatgttcactatagttatctgaggacaaattgattttaagtaattttttctctttgcatctttctttaaaatcttttaaataataatcacatataattttcataatcagataaaaataataaatctatttccattttttaaaagtttttatccataaaagttaatacttacggagggtttactgtgtaccaaagaatgctcgaaataatttaacaatatttattcattttatatttgaaacaaaactataaggtaagttttattgtgcatattttatgaatgaggaaaatgagaacaaagaataggttaaatacattgcttaaggtcatatggctagtaaggagaacacccagtatttgaaggtgtctagcatcttatgcctttttgtataactacatctcatactcagagctctcgttgtgctgttttcaattagaaaaaaatccacacagcattaatgataggtgcaggcagcactactttgcaatcttcttattttgcacccttccacttataaaatgtaatattttctgattaaaaacttcaagcttgttcatttgactgacactatcagcataaagccacatgaacagctagaaatatgccattcaaaaactgttgagatgcggtctcctaaacaagttgcatgtgaaatcaagtccctcttgtattatttctccatctcctcttagattaaatcaatggatacctcatcacctttcctcaaagggccatttcaaaacccttcagttatattggcatctctgctcccagtataaatgtcaggccatatcggggttagataatgaaatgtgaagccatctatttgcttgatttttcaagggcatttggtgagaactgctgttctatacaccttatccatcaccctattactgccttgactgcaaaagagtaggaactgcaagtaattcttaattcttttgcctctaggcaaagcctatgctgtaatgtaggacagaaaagaaatacaatagtgaataattcctaacaaaccttcaatacacacattgcattgctattcttgggtctttttggtttccttttgtgctcaactcaaaaggattcagaaaagcagattttgagtataagccttttcttccaagaagctcttaattctgctattaagaaatcggatatgcaagatagaatctatgtttaatcagattccttagtagctaggctattgcaaatatagtgcaagtgtgtgtgtcgtgtgtgtgtgtgtgtgtgtgtgtttgtgcacgcatgcatcagggctatgatctattatttattttatgtataaaatttatgttttacatgcacattctatattacatcttattgtgattatttgtgtgagtaggttacatgaccttaaactagttaccaatttattatcattattattattatactctaagttttagggtacatgtgtacaatgtgcaggttagttacatatgtatacatgtgccatgctggtatgctgtacccattaactcatcatttagcattaggtatatctcctaatgctatccctccccgctcccccgaccccacaacagtccccagagtgtgatgttccccttcctgtgtccatgtgttctcattgttcaattcccacctatgagtgagaatatgcgtgtttgcttttttgtccttgcgatagcttgctcagaatgatggtttcgtttcatccatgtccctacaaaggacatgaactcatcatgttttatggctgcgtagtattccatggtgtatatgtgccacattttcttaatccagtctatcgttgttggacatttacattggttccaagtctttgctattgtgaatagtgcagctataaacatacgtgtgcgtgtgtctttatagcagcatgatttataatcctttgggtatatacccagtaatgggatggcagggtcaaatggtatttctagttctagatccctgaggaatcaccacactgacttccacaatggttgaactagtttatagtcccaccaacagtgtaaaagtgttcctatttctccacatcctctccagcacctgttgtttcctgactttttaatgatcgccattctaactggtgtgagatggtatctcattgtggttttgatttgcatttctctgacggccagtgatgatgagcattttttcatgtgttttttggctgcataaatgtcttcttttgagaagtgtctgttcatatccttcgcccactttttgatggggttgtttgtttttttcttgtaaatttgtttgagttcattgtagattctaccaatttttttaaatactgtatttccctatacacaatatatttttgcttgatagtatttagtacatggagatgtttttgaacaatcttttgataagatagtagactttttacaaccaactcagttcattgcaacaaggtacactattgacctagaaagtgaaatgaaataatcaatttggggtctagaattacttaattcaactaatcttatcattatcaactctgttgcattttgtagtgtgcagctccttcctaaagcaaattatcatcatcatcatcatcatcatcatcatcatcatctcaggaaaatgaccaagaaaatctgaactgaaacaacagtttttctctttgatgcttttattagatgagtcatctcattcgtaagcattaccctggcttagtctacataatttaaattccttcttttaactaatctcatttgtttccatatatgccgatgtgcattgttttctcctgagacatagtgaaaaggaaaactgttgtgcttttatctattcatatgttttttctataatccagcaggaagctcaatacagcattttactgtcacacaattatgtggtcatctgtcaccatctataagtttttcagagaaactgctctacttctacttctctgaaatttctcacactacttcaatgattattaacaatacaataataaaatacgaaagaaagttcaaaaacaagcaatagaaagatagcatctctgtcctctctggacacagctaaattttctcctctgatgtttgatatattcattcatatatgtctacatttcacttattcattttcctcaagtctcctaaacctagaaaatatcctgagcagttctatatctttcattgttaatcccagtaatttgtcctctcccctaaagtttggcatgtgatctgtaatgtaaattgatatggtagatgagaacagtaggaagaaagattggactggcccagacacacctttgcaaatataaactagaactgaaagagatagaggaaagctcagtctatgttcttgaatatcaggaaggaagatgaattaaagggagtttccctttaatttccttataaattgctctatgtctcaaaataataaatgaactgttacctataaatgtaagaacatgccccaaatttagaaattctaattgagtttaagaaaagaaaggaaaattataataccactgtctttttattttaaaaaattgtgctaaaaacattaaacacaaaactactttcttaacaaatgcatatgtgtacaatacattattgttgactataggtacaatgttgtataacagatccctagaacttattcatctttcttgactgaaactttacgcccattgtttagtaactccccatttctctctaccttctctctacctccacccactggtaaccacaatccaactctttgattctatgaatttgactattttagataactcatataagtggaatcatgcaatatgtgtctttctatgactcatgtatttcacttagcacaatgtctttaagtttcatccatgttgttgtcacatacggcaatagttcctgcttttttaaggctgaataatagtccactatttatataccatattttctcatctattcatctgtcaatagacacttaagttgtttctaaatcttaactattgtgaataatcctacaatgaatataggagtgctaatacatctttgagatcctgatttcaattcttttgaataaacaccccaaagtgggattgctggatcatgtaattgcatttttaaatgtttagaggaacttcatttgtttcccacaaaagctgcaccatattgcatttccaccaacagtgtgcaagggttccaatttctgtacatcctcgtcaacacttgctattttctgttttttttaacagtagccattctactatagtaggtgttaagtgatatttcattatagttttaattcacatttcctggatgattagtgacactgagtatttcttaaaatatctgttggccatttgtatgtcttctttgaagaaatgtctatccaagtccatagcccatgtttaaatcaggttatttatttatttatttatttttctctctcttttattttaactaataacctgaaggggtttattttagatattttggatactaaccctttatcagatatacggtttgcaaatattccccccattctgtaagtgtccttttcactctgttgattcatatcattattttattaattattattattactattatttgcaatagggtctggatctgtcactcaggctggagtacagtggcccaatttcagctcactgcaacctctggcacctcccaggtgcaagcaatcctcctacctcagcctcccaagtggctggtactacaggtgtgagcctaccatatccagctaattttttctttaattttttgtagagacaaggtttcactatgttgcccaggctggcctcgaactcctgagctcaaacaattcacccacaagctttttagtttgatgtattcttatttgtttacttttgtttttgttgcctgtgcttttgatgtcatatccatgaaaccattgccaagaccaatgtcatgaaggttttcttctagtagttttatagtcttggtctatgtttaatctttaagccatttcaagttgatttttgcatatgatgtaagacaagcatccagtttcattccttaatatggatatccagttttccaagtaccatttgttgaagagactctccaatctctatgtgtattcttgacacctttatcaaacgtcagttgactgttgctatagactgaatgttggtgtcacccaaaatccatatgttgaatctttgtctccctaaatctatatgttgaatggcattaggagacggggacttacagagatgattaggtcataaaagtggagacttcatgaataaaagacatctgagaggaatgcttcacctttccaccatgtgagacacagtgagaaggcactaactatgaggaagcagtccatcagtacctgtgcctcaattttggaattccaaacttctggaactgtgagaaatatatttctgttgttataagctacccagtttatggtattttattatagtagcccgaatagaataaaacaaccaagtatgcatagatttatttctggattctcttatgttccattggtctatatgtctgttttaatgccagtatcatattgttttgatctctgtggttttgcaacatatctagagatcaggaaatgtgatgtctctagctttattctttttttcaagattgatttggttatttcttgactcatggctccatataaattttagagctttttttcactttctgtaaaaaatgacattgagatttggatagggattgcattgaatctgtagatttcttttggtagtatggatattttaacaatgttaagtcttctagttcatgaacattcaatgtcttttgatttgcttagtatctttcatcaatgttttgtagtttttaatacacaaatctttcaccttgttagttaggtttaggtgtattactaaattattttattctttttggcactagtttagatgggcattgttttcttaatttcctttcagatagtttgttgttagtgtatagaaatgcaactgattctggtatgttgattttgtactctgtaatttcactaaattcatttgttagttctaacagtttcttaattgaatcttcagagttttctctatatataggatcatgttacctgcaaacagggaaaattttatttcttccttcccaatttaaatgcctttttactttttttcttacccaattgctctagatagggcttcaagtatcctgctgaatagaagcagtgaaagtgggcatccttgtcttgtttctaatcttagaggaaaagccttcattcggtttttcaccattgagtatgacgttagtgatgggcatttaatatatggcttttattatgttgaggtatataatatttgtatttgtatttgacataatctattactagtttgagtttttaattaaaagatgttaaattttgtcaaaccctttttctgcatcttgagatgatcacatgtttttatgctttattttgttaatgtggaatttcacgttaatttttacacactgaaccattctaacatcccaagtacaaatcccatttggtcatggtgtataatccccttaatgtgctcttggattcagtttgctggggtttagtagaggaatttgtatgttcattcttcagggatattggcctatagttttgttttcttgtggtgcttttgtctgactttagtatcagagtaatgaatttggacatgttccctctccccttcaatttttttgaaaagttttagaagaaatggtataaatttttctttaaacgtttgttagaatttcaccagtgaagccacctggtactgggcttttccttcctgggagctttgtaataactatttcaatatctatactagttataggtctgttcggactttctgcttcctcagaatccagtctcggttgattgtatgtttctaggaatttattcatttcttctagcttatccagtttgttggcacataattgttcatagttatctcttttgattctttcttattttgtggcatcatttgtgatttctcttctttcatttctgatttttttatttgaggcatcgctctttttttgctagttagtttacttaaggttttaccaatttagtttatatttataaaaaaccagtaaaaccaattcctagttgtcttatttttttctattatttttgaattttccgtttcatgtatttctgctcaaatctttgttaattccctctttctgcctaatttggccttagtctgttgttattgttctacttccttgagatgtagtattaaattgtttaagatttttttcttttaaattttaatttctttagcaaatgggatgcattctttaattggtgcacacagccatctaaaagaataaagaatcaaagattgccacattaaaagctgccaaattaaattaagacttaatttgccttctgtaaggaagtctttttcactaatattattaaaagtctttttcacaaatattattcaaaaatcttaaaagtctttttcacaaatattattcaaaagatttagccatctgggcaaaaaatctttttccattggccagtaaaacaatttggatccagatattaaaaagacatttattttaggttcagagatacatgtgcaagtttgttatataagtaagcttgtgtcatgggagtttgttgtacagattattttgtcacccagttgctaagcctagtttccatctttgtgtccatgtcttctcatcatttagctcccacttataagttagaaaatgcagtatttcattttctgttcctgcattagtttgctaaagataacagcctccagctctatccatgttcccgcaaaggacacgatctcattcctttttatggctgcatagtatgccatggagtatatgtgccacaatttatttactcagtttaccattgataggcatttagattgattccatgtctttgctgttgtgaatagtactgcagtgaacatatgtgagcatgtgtctttatgatgaaacagtttctattcccttgcgtatacatccagtaatgggactgctgggttgaaaggtagttctgtttttagctctttgaggaattgccacactactttctacaatagtttaactaatttacattcccaccaacagtgtataaatatttccttttctccacaagctcaccagtatctgttattttctgactttttaataatagccattctgactgatgtgagatggcatctcgtggttttgacttgcattgctctaatgatcagtgatactgagtttttttcatatgcttgttagctgcacgtactttttttgcaaagtgtctgttcacgtcctttgcccactttttaatggggttgtttaattcttataaatttaagttccttatagatgctggatataagaactttgtcagatgcatagtttgcaaatattttctcccattctgtaggttgtctattttctctgttggtagtttcttttgctgtgaggaagctctgtatttaattagatcccatttatcatttttttgcttttgttgcaattgctttaggtatctacatcataaaatctttgccagttcctatgtctggaatggtattgcttaggttgtcttccagagcttttatagctttgagttttacgtttaagtctctaacccatcttgagttaatttttatgtatagtgtactgaatgggtccagtttcaatctcctgcatatcgctagccagttttctcagcatcatttattgaatagggagtcctttcccctttgctttgtctaagatcagatggttgtaggtgtgcagccttatttcagggctctctattctgtttcactggtcatgtttctgtttttataccagaatcatgctgttttggataccgtatccctgtagaatagtttgaaatcaggtagtgtgatgcctccagatttgttcttttttgttctccttgcttagtattgccttggctgtttggtattgccttgctgtttatttctttctcttgcctgatagctctggccaggacttaaaatactatgttgaataggagtggtgagaaagggcgtctttgtcttgtgctggttttcaagtggaatgcttcaagcttttgcccattcagtatgatgttggctgtggatttgtcatagataactcttatttttctgaggtacgttccttcagtacctaggtggttgagggtttttaacatgaagaggtgatgaattttatcaaaagcctttgtgcatctattacaataatcatgtgggttttgcattggtcctgtttatgtgatgaatcacatttattgatttgtgtatgttgaaccaaccttgcctcccatgggtaaagccaatttattgtggtggattagtttttcgatgtgctcctagattcattttgctaatattttgttgaagattattgtatgcatgttcatcaagaatgctagcctgaagttttattttctgtgtgtttgccaggtgtttttttttttttttaaatcaggatgatgctggcctcatagaatgtgctggggaggagtccctcctccttaattttttggaatagtttcaataagaatgattccagctcttctttgtatatctactagaatttggctgtgatatgaatggtcctggacttcttttgtttggtaggctatttactgataaatttactgatccaatttcacagttcgttattggtctgcttagggattcaatttcttcctggttcagtctgagagagtgtatatgtccagggatttatcaatttttctagattttctagtttgtgtgcatagtacacaaaccatcatagtagtctctgatggttatttgtatttttctggggtcagtggtaattactatcttatttttaaaattgtgtttatttggatcttctctcttcttctttattagtctagctagcagtccatctgtcttattaatttttcaaaaacacagcccctggatacattgatcttttgaatggcttttcatgtctcaatttccttcaattcagctctgattctggttatttactgtcttctgatagttttggggttggtttactcttgcttctctagttcatttagttgtgatgttaggttgtttattttaaatctttctaactttttgatgtgagcatttagtgctataaatttcctggttaacattgccttagctgtgtcccagagattctggtatattttatctttgttctcattagtttctgggaacttcttgatttctgctttaatttcattatttacctaaaaggcattcaaaagtgggttgtttagtttccatgtaactgtatggttctgagcaattttcttagtcttgatttctaattttattgcactgtggttcaatatgactttgtttcttttgcttaggattgtctaaagtctgattatgtgatcaactctagagtgtgtgccatttggtgatgagaagaatacatattctcttgtttttgggtggagagatatgtagatgtctattaggtccatttggtccagtgttgagttcaagtcctgaatatctttgtgaattttctgcctcaatgatctaatactgtcagtggggtgttgaagtctcccactattactgtgtggaagtccaattctctttgaagatctctaaaaacttgctttataaatctgggtgctcctctgttgggtatgtacctatttaggatagtcagcttttcttgttgaattaaaacctttaccattacataatatccttcttcatcttttttgagcttcgttagtttaaagtctgttttgtctgaaattaggattgcaacccctgtttttttctgttttgcattttttggtagatttttctgcatctctttattttgagcctatgggtgtcaccgcatatgagatgggtctcttgaagacagcataccattgggtcattcttctttatttagcttgccactctgtgccttttaattgggagcatttaggacatttaccttgaaggttggtattaatttgtatgggtttgatcctgtcatcatgttgttaggtggttactatgcagacttgtttgtgtggttgctttatagagtcactggtctgtgtacttatagagacactgtgtatttgcagtgtctgataacggtctttccttttcatatttagtgcttctttcaggggttcttgtaaggcaggtctatgataaggaattccctcagcatttgtttgtctgaaaaggatcttatttcttctttgcttatgacacttagtttgggcagatatcaaattctcagttggaatatctttttttgaagaatgtttaatatagtcccccaatctctctggctggtagagtttccgctgagaggtctgctgtgtcagaaggacttccctttgtaggtggcctgtcctttctctatagctacctttaacattttttctatcatttcaaccttggagaatctgatgattgtctgtcttggggatgatcttcttgtgaagtctcttatgggggttctctgcatttctgaatttaaatgctggcctcactagctaggttggggaagttctcatggatgatattctgaaatatgttttccaagtttcttccattctctccatctctttcagggatgccaatgagtcatagatttggtctctttacataatatcttatttcttggaggttttgtttgttcctttttattattttttctttattcttgtctgactattttatttcagaaagccagtcttcaagctctgagattctttcctcaggttggtctattctgctgttaatacttacaattaaattatgaaatttttgtactgtgttttttcagctctatcaggttggttacactcttttctatactgagtgttttgtttgtcagcttctgtactattttattgtgattcctagcttcctcagattggtttcaacattcttctgaatcttgatgatcttcatttctatatatattttgaattttatttctgtcatatcagccacctcagcccagttaagaactcttactggagaactagtatgatcatttggaggaaagaagacactcaggctttttgagttcttagagttcccacactggttttttctcatctttgtggtctgatgttcctccaatctttttcgaattttttttttttgagatggagtctcgctctgttgcccagtctggagtgcagtggtgcagtctcggctcactgcaagctccgtctcccgtgttcacgccattctcctgcctcagcctcccgagtagctgggactacaggcgcccactgccatgcccggctagttttctgtatttttagtagagatggggtttcaccatgttggccagggtggtcttgatatcttgacctcgtgatccacccaccttggcctcccaaagtgctgggattacaggtgtgagccaccacgcctggcctgttcctccaatctttgaaattgctgtcctttggatttttttcttttgttctatttcatgaccttgggtgtttcatggtggtataaggtgggttcagttgactggctcaatttctggaagattttaggggaccaagactcaactcaggactcgtggactgtgtgctctaaccctgggggactggtatcagttcccaactttgttttctggctcctcaaggttaggaacctgctcactggaggggctgagttacttctggactgttggtcacaacactctgatgggtagtgccagacaaagagcttcatagggcagaggcagcagaatctgttctcatttgcatgtgccagcagcagtgacagtggcaacacagcagggtgcatgcttgttggatgtggcagtgtgctagcaggtgctggggttctggcctctgtgtgggcattcacagcagcagtggtggccacatggcgacatggcttgggggcggggacccccaccagtgactgtgtgtgcattcgtgctggtggtggtattagcatggggttgaagtgctgatggacacaagactgtggaccctctgtgtgttttcatgcaggcagtggtggctgctcaaggcaggggtgactctgctgttctctgtgtccagtttcacattgctggaagtgttggtgccagagcagaatgctggcaaaggcagggctggtgggctctgtgccacccagtgctctaacaacaatggtggtttagtggggtgttggcaacaaggtgcactcatgcaggcagcagcggtatggtaggatgcatgcatgcacatatcctggtggggtaaggaaggcaaagtctgcccatgcaaatacatggtggcaaagcaatgtgggggtggccattggtgagtatgtgaaggccaagtagcatgggggacgctgcagttgtgggaggcaacaagcatgctggtgtctgcagggactgctatgctggagcactctgccagtcaggcctaacccactagaacaggagctgtaatgcaggcccccacgagctacctggggactgcactgcaagcacctgcagccaggctggggcccctggagaggccagcagaccaagggggtactcaaggtggactgccatttcatgggcaggacctccctgcagagttcaggtgacagttcccctagggctacagtctcctatggaaacaagtctagcttagggagatgggtgtccctggccatgctccactataggtgctcccactccaaaccctttgggctctgcactggctggacttctgtcccttccacttctctaagcagctctctctgccaattcaaatgtccatggtggttaaaggatttccccatgccaggattccagagatccatgcgagagtggatcgctcctggcctgttcaattcaccccatccccaggagttcttggggaccaggaaccggtcctggtgtgcactagcattgctcagggttcccagcttcctccctctgcagcccagcatctgtgtcttccctctatctgccctcagtgccttccctgtgaagatctgctaggagtgtgccagtctttctgatgtcccagtcctttggtgggagatgttccttctggctgcatctagtcgaccatcttgcctccttcctgatccagatattctccagtccagagacttaccagcttgcaaaatgtttttgcattcttcttggattccaatctcccctaccttgaaagtttgtgtgttttaggttctgtggagataggctttctcaacaaaatcagagttgtgctctctaggtgagtctgctaaattaaaatcctctcttcttttctaatataggtatttatcactatgaaattccctcttagcaatgctttagttgtatcccatatgttttggtatattttgttttcattttcattggttgcaagagattttcttttttttctttatttttatttcttgtaaaaaaaacgggatatatgctcagaacatacaggtttgttacataggtatatgtgtgctatggtggttttctgcacctattgaccatcctctaagttccctccactcaatcccctccccagaacaggccctggtgtgtgttgttccctctctgtgtccatgtgttctcaatgttcaacccccacttatgggtgagaataagtggtgttcagttttctgttccagtgttagtttctgaggatgatggcttccagcttcatccatgttcctgcaaaggatatggtctcattccttttaatggctgcatagtattctatggtgtatatgtactacattttctttaaccagtctatcattgatgggcatttggtttggttccatgtctttgctattgtaaatagtgctgcaataaacatacaagtgcatgtatctttgtagtagaattatttatattcccttgggtatgtactaagtaatgggattgctgggtcaaatagtatttctggttctagatccttgaggaattgccatactgtcttccacaatggttgaactaatttacatttccaccaacaatgtaaaagcattcctatttctccacaaccttgccagcatctgtcatttcctgactttttaataattgtcgttctgattggcatgagatggtatctcatagtggttttgatttgcatttctctgatgatccatgacattgagcttttttcatatgtttgctggccatgtaaatatcttcttttgagaagtgtctgttcatatcctttgcctactttttgatggagttgtttttttcttataaatatgtttaagttacttgtaaattctgggcattagacctttgtcagataggcagataggaaaaattttctcccattctgtaggttcactctgatgacagcttcttttgctgtgcagaagctctttagtttaattagatcctatttgtcaattttggcttttgttgcaattgcctttggtgtttttgtcatgaagtctttgcccaggcctatgtcctgaatagtattgcctaggttttcttctactgtttttattgttttgggttttacatttaagtctttaatccatcttgagttaaattttgtataaggtataaagaaggggtccagtttctgttttctgcatttggctagccagttctcccaccaccatttactgaataagagatcttttctccactgcttgtttttgtcaggtttgtcaaagatcaaatggttgtagatgtgtagtgttatttctgagatctctgttctgctccattggtctatttgtctgtttcagtaccagcaccatgctgttttggttactgtagccttgcagtatagtttgaagtcaggtagcctgctgcctccagctttgctttttttgcttgggattgttttggccatccaaagtcttatttgaatccatatgaaacttaaaatagtcttttctaattctgtgaagaatgtcaatgatagtttgatgggcatagctctgaatttataaattactttgggcagtatggtcattttcatgacatcaattcttcctatccatgaggatgaaatgtttttccatttgtttgtgtcctctcttatttccttgagcagtggcttatagttctccttgaagaggtccttcacatcccttgttagctctattcctaggtattttactctctttgtagtgattatgaatgggagttcattcatgatttggctttctgctttgctttcctattattgctgtaaaagaatgcttgtgatttttgtacattgattctgtatcttgagactttgctgaaactgcttatcagttaagaaattttggggctgagatgatggtgtttgctaaatataaaatcatgttgtctacaaacagagacaatttgactttctctcttcctatttgatcaccctttctttctttctcttgcctgattgccctggtcagaacttccaatacaatgtagaataggagtggtgagagagggcatccttgtcttgtaccagttttcaaatggaatgcttccaggttttgcccattcaatatgacattggctgtgggtttatcataattaactctcattattttgagaaatgttccatcaatacctagtttattgtgagtttttaacatgaagggatgttgaattttattaaagccttttctgcatctattgagataatcatgtggttcttgtctttggttgtgtttatgtcatggattacatgtattgattttcatatgttgaaccagccttgcaactcagggatgaagctggcttgatcatgatgaataagttttttgatacactgctggatttggtttgccagtattttatgaggattttcgcatggatgttcatcagggatattggcctgaagttttccttttttgttgtgtctcttaccagttttggtatcaggatgatgctggcttcataaaatgagttagggaggagtccctccttttcaattgtttggaatagcttcagaaggaatggtaccagttcctctttgtatttctggtagaattcagctgggaatcagtctggtcctaggatttttttggttggtaggccattaattactgcctccattttagagactgttattggtctattcaggaatttgacttcttcctggttttgtcttggtaggatgtatgtgttcaggagtttatccatttcttctagattttctagtgtatttgcatagaagtgtttatagtattctctgatggtagtttgtatttctgtgggattagtgatgatatatatcccttttatcattttttattgcatctatttgattcttctctctcttcttctttattaatctagctagtggtctatctattttgttagttttttcaaaaaaaaaaaacagctcctggatttgttgatttttttggagagtttttcatgtctctatctccttcaattcttctctgatcttagttatttcttgttttcggctagcttttggattagtttgctcttgcctctctagctctttttaattgtgatattagggtgtcgatttgagatatttccagctttcttatgtgggcatttagtgctataaatttccctcttaatactgctttaactgtgtcccagagattctggtatgttgtctctttgttctcattggtttcaaagaacttctggatttctgccttaatttcattattgaaccaggagtcattcaggagcaggttgttcaatttccatgaaattgtgtggattttgagtgagtttcttaatcctgagttttctctgcttgaaaattcttttaagaatgttgagtattggtcctcaatctcttctggcttgtggagtttctgctaagaggtctgccattagtctgatgggcttccctagtccctctggacaattcctcaatgcacaggaaagtgactaacaaaagtcttctcaggttcttttttgtttgtagaggttaatgaaagtttgagtaaagtaaattcatcaggatcataggcactactttacatctttttcttccttcttcttaccaaaggagagttctccccatccactctccattcctcactatagcagtacctactgcaatattacacaaagtggtttacttcccaattcagtctctgaaagggacatttcctctcatcttcctcaccctctatgttagggaatgaatgtttttctgccccccaaaatttatatgttgaaattctaacctctagtgtgatgacattaggaggtagggcctttgggaggtaattaggtaatgaaggcagagtcctaataaatgggattaatacccttataagaagaaataagaaatcctgcttcctctctctgttatccacgatgtaaggatataacaagaagacacccacctgcaaaccaagaggagtgccctcactagacattgaatctgccagcaccttaatcttggatttcccagcctccaaaactgtgagataaatgtttgttgcttaagccacctaatctatagtaatttattacagcaacccaaactgactaggacactatagtctcctcacatagggcccagcaccatttttcctccttgtcttactgaatgactactctagtgcagaggtgatctgatccattacatactttagtttcagaaattgaccagaaagttacaggcatcatttgtgctcacaactcactggctagatctagtagcagggccccacccaaacacaagggagccaggaagtgcaattctactttgtgtctggaatgaggtggaatgtcacatatctgggtatcagcagtagtgctgccacactgccctcttgttcttcattttgtgccattctctctcctactcattcttgccatgctggcctcccatcagttcctcagttcctcatgtgacctttgggcatgctgctcgctctacttaaattttctttctcccaccttgactgacaccttctgatttctcaggtcatagctaaaatattttcttctcagagaagtttgctataaaacctctcctccctccatctgaggtagccccctttattactctttttcaaagctctctcgtctatttattttgcagctctcatgttcatttgtaattatatggctgatgtgttcacctgattgagtcatgtccgtcccctccacttcactgtaaatgccctaaaagaagtgatcaggctcattttatttaccaccttgaatatacttgatgcctagcttgcaattggacaatatatatttgctgaataaataaatgaactcaggaccttttagtggtccacctcaagtaactttagaattacatttctctctcactttatacccatgaattatattagacagcactgtatatgacatgaattacacatttgacaagctatattgagtagcaaatacaaagaaaacaagcaataagaaaaagataggttaggctgtagcaaaaacactcaacagtgaaaagcaaaagaagccactcacgattttaataatgtaaaactctacaaaatctaatattctttcaaagcaaacttggcacaataaatttgtatgggaaagcctgagcttggtcatcagatgtaatcatcaaggaagatggcaaacagtatggaagatagagaagtagactttcatcataaaacacctgagaagttttttagtttttttgtttgtttgtttgtttttcaaaatagagtcattagccccaatttgtgtagcccttactcacttcctgggcctcagaaatactacttcctgttatacagctgttcccaaaaagtttcaagataaataaagtacacatagaacggtttaaggaagttcccttagaactttaagtaacagtcttaataatgggcttgttccttgacagttgctttctttagtaactctacggttatggtctggcctggtgggagccaaaggttagactttaccatttgtcaaggtgacagctcttgaccccatttagcttttaaccttttggcttattagaaattccctctaaagtatatgccagttttcttcattgtaaattgcgaactgaggcgtctctggctgatgttatattgttcactttttcatacattattgctttgtgaaaaattcatgaagaataattcatgaacatttttagattttacccatgagttcatatgaaccagatttggtaatatgctaagcaaaatagacaagaaataaaccccttatctgattattaatacagctgtaagagtaagcatagaaatggtgttttaaacatcagagagaaattttcagtggggtgccaaagggatttgctgtgataccatttcttttataattgtaactgaattatttacatcacttttatataagcttgaggaattctccccatttacagaaattagaaatatgacattttatgacagtgattcttcgcatcttaacgtgtgtgtgtgtgtgtgcgcgcgcgcgtgtgcgcatgcgcacgcatgtgtgtgagagaaatatgggcctgtttgagaatttggcaaaagtgattggtcttctttccagaaaaaaaaaaatctgcatataccacttcccctccaaaatttacatacaatttgaagatattcagtgacccatttgaagtacatttgggaaaaagaaaacaaaacaagcaagctacagagcaactacttaaaagaacattttaaatcaatgttccaaacacgtaactctcttaaagtttgtcactgcagggctaattctattaagtaactgttaatcctgcacccctacatagtgacccgccttggttagtcagcagtcatgtattattaccaaaatattacatagtttctgtcctggtggataaataattactactttgaactcccctagccctcaactgttaacctgccccatcagccagataagtaggaccatgtaatgatccagcaatgaggaaatttaagcctgattgatataatacgggcctccaggatgcaatgtctacacaaagaccaattctgattgttcagcgtccatgccttatttaggtgttacgagatattttgaatataaactctgatttgcccattttatttttcctaagagtaataatctactttgaaaaagagacagaactctagatactttctttactccactgagataagagtataatgaagcagttgtctttgtcctgtatttttaaaggtaggaacctgaaaagattattcacaggttaatcttccaatagaaatgcaaaaaaatgagaggggaaaagagttcgggaatagcagatgctgggtagtttgggtaagggagggaatatagggaatagggaatatatagagggaatatagccttagggtgtttagccaggtatttttgactgcctagactcatgtcctttcagaaagcatcacacaatcattccacatgattcttgcgaagcccctctcttgttcctcacttcctaacctccaggcatagccagtcttattttctcattctctattagcagtaatgtatctaaaaagtaaacatttaatccaagcaaatagccaagcagaatccaagcagatatattgataatgggagaaagaaactcttttctatgggaggttgtgcctccgtctttttttccaagtggagaatgccttcatgtagatgtagctaagaagaggtaagaaagtgatggagggaaaaagtcctactcatgacgaggtgagtctctgaggcactgactctacagttactcattttatttctacatctttaaaaatccttccagctaagataactaataaactttcatcatttattgttgttattatttaaattgcttatgctattttgatttgagtttctgtcacttgtaatcaaaagagggctgattaatttagagggttaggtgaaaggccatgtttatgtaaagaggggatttgtaaatgatgcaattatcagagactaaggcacaaaattctaaatagaagggacagattgccaatattaacacaattgactttacagctattgtgataatttttaaaagcatatcctctgacaatgttttaattacttagtaaaaaaatggcatctattttactcagtgcaaatattctgcagtttggaaatgcaatacctttattacgatagccaaaaataccacacactgaattaatctagttaaatctcaactagaaaaaatacatatttttgatgatttatgttaagaaagtcttaaatattctagataaaacaacaggggaagctgaggttgagcttttcaaatactttttccaataagattgaatatatggaagctttatttttaaaatactatttaggctttctgatataaaatcaaataacaaactattgctttattaacttatttgttactcaatgtccagggagctttagaaacaaaagaactgctagatattatagctctttaaactatatattttttatatttaagcatcagtattctagcctttctagtgactaaacaaactcataagaacattttatgaactaatgcataattattcccattcagtagagagagtcatcaagcttcatagcatttactaaaagctttagccataaatggaattttccataacagcagaaaactcatcacaattatatgaaaagtagattgtaagatagtataaggggacaaatggttataaagtaaatgatttgcaataattccatctgctgcctaaatgcaaacacatggttgacaactcaagagagcaggagaaatgttcaatctccccatcagtctgggaatcttcatgggaagcccactccagtcccatcatatgggaaccattgggtatcccagagggctgattggaagacaaggcacaggacattaatctcaaagactggcatgcagatctaggcagcaactctgtgcttcaatcagtgggggtgccatgttgaagagactggatgatgccatagtgctgcaagggggggcaccattcaagcaaaggcccaaatctgtggctgaattttttataaatcccaggtggagctttcccctggcccagaaacaactaaaagttgggactgagttctggtactcacctgtctttaccagactgggaaaaaactgtagggcagcaatataatttcaggacagcttttaacttccagtgctcactataaaacatccccagagtgggaaacaatggcagggcaacaagttagttccagcaaagtgtttttgtaccagtgcacactataagactcccagaatgggaagaaataacaggccaacattgaagtttcattactaaggaataaaggcctaacaccaccaaaaaaacccccacaataattggaagaggtagctgactcttcaaacacacaagcatcaacataaagacacaaggattgtggaaactcagggaaatatgacaccactcaaagaaaccaacaaaactccaacaatagacacagaagaatgcaacatctccaaaatgtcaggcagaaaattcagaataattctcttaaagaagttgaaagaatcacaataaaacacagattgaaattggaaaacaatccaggaacaaaataagaaatttcacaaaaataaaaacaattttaagagagcaaacaaattttagaagcaagcaatataataactgaactgaaaaactccatagaaagcttcaatagcagacttgatcaaaaagaggaaagaattagtgagcttgaaaaaagaataaatgaaattacccagtcagagaagcaaaaggaaaaagaatttaaaaaaagagtaaagaagaataaggggacaccatcaagcaaactaacttccacataatagaaatttccaacagatattatgtaaaagaggaaaaggtctagaaagcatatttcaaaaagtaacggctgaaatttctgaaatctggagaaaaccaacactatccaagtgcaggaagctcaaagatattaaacaaattcaactcaaagagaaaactacccagatatattataatgaaattagtaaaaatcaaaaacaaagaaagaatactttaagcagcaagagaaaagaaacattacattcaactgatctctaatatggctttcagcggatttctcagagaaacttagcagaccaaaagaagtgagatgctatattcacagtgctgaaggaaacaaatacaaaaagccagctaagaatactatacccaggaaaactatcctttaaacaggaaaaagagataaaaaactttctcagacaaacaaaagctgaggaaatttacaacacgacacttcgcctacaaaaaatgctacagggaattcttcaatctgaaaaaaaaatggatgctaatgtgtaaaaaacaaaaaacaaaaaacaaaacaaaaaaacctaaagtatgaaattcactattaaaaaacagaaaaatgcataattctataatactataattagggtaagtaaacaatttatatcctaagtatgaaagctaaaaggaagaactattaaataatctcaacaattgattaagagttaggcaatataaaaatatgtaaattgaaacagcaataagtcaaaatgtgggagggggtggtattacaatgtagagtttatttttgtttatttgcatcaaagttaaactattatcagtttaaaataacctgttataaatatatttttataagccttgtagtaacaacaaagcaaaaacctattatagatacactaaaaataagtagccagaaatcaacatgtcctaatagagaaaattattttgtgacaaaaacgaaagtaagagagagagagaaaaagaaagaaatgattctacaaaacaaccagaaaacaagtaacaagatagcaatactaaatccttacatatcaataatattcaaaccttgaatataaatgaattatattcttcagttaaaagacagagtggctgaatgaatttttaaaaggatccaactatatgctgtctacaagaaactcacttcatctgtaaagacattcacaaactgaatgtgaagatatttaaaaagatattagaagcaaatggaaaacaaacaaacaaaaagagcagaagtaaagctataattatcagataaaacagaccttaagtcaaggacagttaaaaacaacagagaaggcaatagtaggagactttaacactccacttttggcagcagataggtaatctagacaagaaaatcaacaaagaaacatcagaattaaactttactctagatcaaattgacctaacagacattttcagaacattttaccccatagctgaagaatgcacatttttctcaacagcacatggaacattctctaggatagaccatatgttaggtaacaaaacaagttttaaaaagtcaaaaaagtcaaaatcatatcctgtatattttctgaccacaattgaataaaactataaagcaataagagaaggaacattggaaactgtacaaatccatggaaagaaaacaacatgctactgaaaaacaaattggtcaatgaataaattaaaaaggaaatttaaaaaattttcttaggacagatgaaaatggaaatacagcatacaaaaacctagaggatataccaaaagcagttctaggatggaaatttgtagcaatcaacacctacatcaaaaagtagaaagacttcaaacaaacaacctaacattgtacttcaaggaactaaaaaagcaagaacaatcaaactcaaaattagtagaaggaaagaaataataaagatcaaagcataaataaataaaatttgaactacaaaaatacaaaagatcaacaaaatgtagttggttttttgaaaaaaaaatcaagaaacttttagctacaccaaccagaagtctaaaaaataaagtcagagatgaaaaagaatatattacaactgatactacagaaatacaaaaaaaaaagcaacagacaagattatgaaaattgatacaccaacaaataggaaaacctaaaagaaatggatgaatttctggacacatgcaaaccatgaagattgaacccatgaaaaaagagaaaacctgaaaaccagtaatgagtatgagactgcagtagtaataaagcctcctattaaaggaaagcccaggatctgacagcttcactgctgaattctgccaaacgattaaagaataacctataccaattctctttaaactgtttcaaaaaaattgaagagaagggaatacttctaaactatacttctaaactcatcctaaaaggccaggattatcctgatgccaaaactagataaaaacacaacaaaataggaaaactacaggtcagtatcagtgatgaacacagatgcagaaatcctcatcaaaatacaagcaaactgaattcaacaaaacattaaaaatattcattatgaccaagtgggatttatcccagggttgcagggataattcaacatatgtaaatcaatcaatgtgatacattgtatcaacagaatgaaggacaaaaaccatatgctcatttcaatagatgctgaaaaagcatttgataaaatttgacattccttcatgataataactgtcaacaaactggatacataagaaatatacctcgaaacaataaagatcttacatgacaaatccacagctagcatcattctgaatggggaaaaatggaaattctttcttccaagatctgaacaagacaatgatgcccacttttaccactgttattcaagatagcactggaagtcctatcacagcggttaggcaagagaacgatacaaagtgcatctaaattggaaaagaaaaagtcaaactatcattgttcacagatgacatgatcctatatttaggaaaacctaaagactcaaccaaaacctgttagaactgaaaaacaaattcattaaagttgcaatatacaaaataaacatacaaaaagcagtaacatttctatataccaacagtgaacaatctgaaaaagaaatcaagaaagtaatcccatttacaatacttacacacacacacaaaaacacatctgggaataaatttaaccaaacaagtgaatgacctctggaatgaaaactataaaacactgttgaaaataatttaagaggacacaaaagattaaaagatatccatcccatgctcatgaattggaagaacactggtctgggcaaagattttttaggtaagacctcaaaaacacaagcaacaaaagcaaaactagacaatggaattacatcaagctaaaaagcttcagcacaacaatgtaaatgatcaacagagtgaagagacaacctgttaaatgagagaaaatattcgcaaactattcatttgacaagggactaacatccagaatatacaaggtaaaaaagtacataatcccattgaaaagcagagaaggatatgaatagacatttctcaaaggaaagcatacaaatggctaatgagtgtatttaaaaaaacctcaacatcacttaattatcagggaaatgcaaatgaaaaacacaatgatatatcatcccaccccagtttaaatggtaattatcaaaaagacaaaaaataaacaatgctttcaaggatgtagagaaagagaaatgctaatacactgttagtgagaatgtaaattagtacagctcctgtgaaaaacactatggaggttcctcaaaaaattaaaaatagatctacagatgacccagcaatctcactgctgggaatacattttaaaaaattaaatcactgtattaaaaagatatctgcactcccatgtttattacagcactatccacaatagccaagatatggaagcaacctatatacctatcagtagatgaatggataaagaaaatgtgggccgggcgcggtggctcacgcctgtaatcccagcactttgggaggccgagacaggcggatcacgaggtcaggagatcgagaccatcctggctgacacggtgaaaccccgtctctactaaaaatacaaaaattagccgggcatggtggcgcgtgcctgtagtcccagctactcgggaggctgaggcaggagaatggcgtgaacccgggaggcggagcttgcagtgagtcgagatcgcgccactgcgctccagcctgggcgacagagcgaaactccgtctcaaaaaaaaaaaaaaaaaaaaaaaaaaaagaaaatgtgaaatatatacacaatatagtattattcagccataaaaaagcaatgaaattctgttatttgcaacaacatagatggaactagagtatattacgttaagcgatggcacaaaaagacaaatattgcatgttcttactcatataaggaagctaaaaaagtggatctcatgaaggtggaaagtagaatgatggttaccagacattgggaagggaagcagggaggagatgaagagaatttggttaatgtgtaaaaaaatacagttagatagaaggaataagttatagtgtttgatagtatcataaggtggcaatagtaatttattttatattgcaaaatagctagaagaagagatttggaatgttcccagcacaaacaaaggataaatgtttgaggtaactgataacctaattactctgatttgattattacacattgtatacatgtataaaaatatcacatgtaccctgtaaatatgcacaattcttatgtttcaataaaaaaagagagaatggagggtactaggaataaagttaggacttctgcacgctaaaaaaaaaaaacactctgaacactcttagaagacacatggtagagatctcactctttctgacaatgaagtttctttaactctactccaatgaggcctaaaagtgaatcaccaagcccatatcactgccagctggaactaatgccagatttatttgtgtgaacaaggccgtaggctaaattacaatgctctggagcaagattcatagacttgggacactcttgactctggggacaatacaaacaactaagtcataggggaagcatgactggactgcatcggggtgagcctagacatgactcaccacgagggactacctgatccaagcatatcatttgtacgattccagtcttaccacaccaaaacttgcagaatcaaaccaacagcttacaagtggttacatatctgatagattgaatgtgtcccagaaaagttgtgaggtaagtgtgtaaattacagattataaagaagtgagaaggagaggtaggtatggaatctttctgaagaagccttgaagtgatattgccatcaaacaaaaaagatgcatgaagcacatattctgccctcagctctgtgctgggtgctatacatctgacacgatttagatcccctgcttatcctttgaaaggatttcatgggttctctaaaattctgcaatacctagatatggttgccgtggacaccatgttgttctgggtccttctttttatattcaggaggtgaccaaaggaggggtgaattaaaaagaagagactatctctgctttccacttgttcctatctcagattattttttgaggctcttctctcaagagatataccagttttcatatcagggcaaaaggatggaaaaggctacttattcaagtatcttcatgcctgggtagagaaatcaggcttcagagatgaaccagagagtggagcaaagacaaagtgctgactgttgccttacccccactctgtcttgaaccactcatctcttaggactagagagtaggaaataagaaaagaaaattaaatttcaggagtaactttacaaggcttatgccatgctctctctagaaaaatgcaaaaatgaaaatattcttattttaaataattaaaaaataattctccactaagattaatggtgatttttaactgggcaaatgtaaaaatgttttttgcaacaagttttggtggtaagtaaaactacatatgtagttctgcagatataaatatataaattgaataataaaaatgtttataaacgatttctgtaagataatataccaacaattatctatggatggtgaaattatgagtaattttaatattaatctgaataagttttgagttttttcctaaactttcttcagtgatcacctgttacacttataatcaggaaaatcagcattttattaaaaaggcaagcactaaatgagtattttaaaataatattgaccatgcatatatcactaactttggaggcagcaagatgtagagttgaatatcagctctgccacatactaactatatgattttagtaaggccaagtttccctctttcctgagtctcaaagtgcacatcactgaattcatgagaaatgatctgtcagtggtatacagtgagtgattaaagtcacttatgggcagcttacaaaacatcaaaaacaaagttgaaggtaacctaaatgttaatgaaaatatataattttttagattattctaaataacacacattaagatggcatggtttaacactgtagagagactttaagttaaaagactaaaaatacttctatttaaatggctacttttatggattgctttgggtctccccagaattcatatattgaaatcctcacccacccccagtactttagaatgtgatttggtttggagataaagtctttacagaggtaatcaagttaagatgaaatcattagggtaggccctaacccaatgtgagtgacatgctttttttttttttttttttttttttttaagttggagggtatttgaacacagagaggtgcacagatggaagacaatgtgaagagacatacagggaaggaagttgtctatctacaggccaagaagaaaggccagggacagatctttctctcagcttactcaaaaggaatcaacgctactggcaccttgatttgagactcctagcctccagaactgtgaggcaatacatacatttctcttgtttaagccattcaatttgttgtacttttgttatggaagccctacagttactttacttttccgtacattaatatttttgaatgatcactctttatttgtcttcaccctcatgaaagcaaaatgtacaaatagaagtctagcatttatgaaagcacttggcatgaagcaagataacaaaaatatctacataatataattttttaacatatttctttttacttatttatttacttacttattatactttaagttctgggatacatgtgcagaacgtgcaggtttgttacataggtatacacgtgccatggtggtttgctgcacctatcaacacatcacctacgttaggtatttctcctaatgttatccttcctccagccccctcaccctctaacaggccccagtgtgtgatgttccactccccatgtccctgtgttctctttgttcagctcccacctatgagtgagaacatgtggtgtttggttttctgttcttgtgttagtttgctgagaatgatggtttctagcttcatcgatgtccctgaaaaggacaagagctcatccttttttatggatgcatagtattctatggtgtatatgtgccacatttttgttatccagtctatcattgatggacttttgggttggttccaagtctttgctattgtgaaaagtgccgcagtaaacagacatatgcatgtgtctttataggagaattgtttataatcctttggatatatacccagtaatgagattgctgggtcaaatggtatttctggtttgagatctttgaggaatcaccacactgtcttccacaatggaatctgtctatctacaagttgtctatctacaagttcaatggttgaactgatttacactcccaccaacagtgtaaaagcattcctatttctccacatcctctccagcatcagttgtttcctgactttttaatgactgccattctaactggcgtgagatggtatctcattgtggttttgatttgcatttctctgatggccagtgatgatgagcttttttttatatattttttggccacataaatgccttcttttgagaagtgtctgtttatatccttcaccctctttttaatggggttctttgtttttcttcttgtaaatttgtttaagttctttatagattctggatattagccctttgtcagatggatagattccaaaaattttctcccattctgtaggctgcctgttcactctgatgatactttcttttgccgtgcagaagctctttagtttaattagatcccatttgtcaattttggcttttgttgccattgcttttggtgttttagttatgaagcctttgcccatgcttgtgtcctgaatgatattttctagtttttcttctagggtttttatgaccaatggaaaagaatagaagcctcagaaataactccacactctacaaccatctgatctttgaaaaacctgacaaaaacaagcaatagggaaaggattccctatttaataaatggtgttgggaaaactggctagccatatgcagaaaactgaaactggaccccttccttataccttatacataatagaattttaaaaattaatattgtttaattaagtttttttcacagatggaatctccaaattatgcgttttctttcaaaaagagaaagcaaaacttcaaattataaagacaacttgtttgctctctactgaagttcacgatacattaagaataaacaaaaatatataggatgaaagaaggcaactttaagttgtactccacctcatgtcatatgttcatttggatgtacttcataagcacacaggactatctagaaggaagtttactcttacaagtcactgaatgctaatgtatagttttgatgagactagaaatatcctggtttaaggctgaaaccctgaaagctaatgactgaggcaattatgatgtttccagggggcacaatggaattctgagcttttatggtatttaattacattgctcctgggccatttacaaggtcattccagtttataagcaaatatctaattgttttatctcatacccaagtcttaccaacactcttctttcttttcagagtaacagttaatgcctcagaaaacatcattaaaatgggtatttcttcatataacaaggctcttattatttcagtcacttggatcttggatggacattgtgctttcaagcatttagaagtgtgaattcttgttgatattcatttcaactaaatgggaggtaatgtgctaagctaaaaatgaatatgatctagtcatactcttattctaaagccacagctagggaatgaagtcttgtccatggcaaagatggaaaataggaatgaaaaacatgtgaaggagaaataagaaaatgagtgctttgcattggccgtgtacctagatactgctcattggatgctatgaagttgtgtgtgtgtgtgtgtgtgtgtttaacaaataaaaagtaaagaaggaaagattgtcttttgctaaaggacaaatagagagcaagttggagaaatgcagtatgaagccctgcctttctgatctcaaatcccattcacatctgaaaactgcacatataatatatacaatttaagtaaaaagaaattgtgaactgtttttctgaacttattcttaataaaaggttattaggttatacagttttaagagtatgacttaatcacttgggtcaattcagccttgccatttgggcataggatattctctatttgagtatctgaggtgacatagtaaatttgtctatactttaagactgataccttgcttgctcccaaagttatatcaaatccacagttattagaacaataaggtaatattagagatcagttagtaacaactctcctgtctgttatttatttactcattcaatatatcctgtgtgtgtgtgcatgtgtgtgagtgttaaatccggtgctgtgatggacattagaaaatccaataatacacaaatcagaaaggatctctccttttaagtttacagaatcttcagacccagaaggaactagatatttacctgctcctgtaggctaacggggataaaaagagactggaaaactcttaatcaacagttgcagtgtcactgggtgtgaagtgagattacttaatctcaaaaataggatttcttacttagctctgaatctatctccagcacccagtatctgatgaatgtctgttaccctcatctaaactgaaattttccattaaatcttttatcacgggtcacggccagacacagtgatttaagattgacttccacttactctttgccttgggaaaactcttagaaaaactgtcaacacacagcctggaagttggttaatagatacagaaatatggttaaatagaaggaataagttctagcattagataggacagtaggaaaactatagttaacaataatttattatatatttcaaatagctagaatagaattataatgtacccaacacatttttatataaaaatgcaattggaattttgataggggttgaatctgtatattacatggacagtaaaggcatgttaacaatattaattcttctaatacatagacataaaatatgttttcattcgtgtatttttaaatttctttcatcaatgccttatagttttcagtgtacagatctttcacatccctggttgtatttattcttctgtattttattattttcatgctattgtaaacggactgtctttgtaatttctttctcaaatagtttgttgttaatgtacagaaatgcaactggattttgtatgttaattttgtatcctgcaacgttgctgaatttattaattttaagttttttgatgaagtttttagagattcctataaaaaaccatgccttatgcaaatagagacaatttaacttcttcctttacaatttggatattttttacttccatttcttgcctagtggccctggctaggactcccagtactatgttgaatagaagtggtgagagtgaactcccttgtcttcttgctgatcttaatggaaaagcttttggctttacaacatgagtatgatgttagctatgggatttcctgtgttttcatgatgttacttcgggtcctttcatttcaacttgaagaactccctttggcatttctcttaaggcaggtctagtggaaataaactctcttagctttcttttctctgggaatgattttatgtctcttcatttctaaagtacagcttttacagactcattattcttatgtggcagttttgtttttcttttagtactccaaatacatcattccactccctcctgcccagcaaagtttctgctgagaaatctgcttgtagcctttgtgagtacccttccatgtgatgagtagtttttctcttgctgctttcagaattctcactttgtctttgattttgacaatttgattttaatgtgtctaggaaaagtattttttgcgttgatcttgcctggagcatttgagcctcactaatctagacatccatattcctaccaacatttgggaagttttagccactaatgaatgtaatgaatataaaatatattgacatactgaacaacatgaaaatcaaaaacatttgcatggtaaaaattcaccataagttaaggcaaatgataaatgtcaaggaaggaataaaagtatttgcaactcagatcataaacaaagtacaaacttctctactttgtaaagatttgacagaaatcaacaccaaatgcccagtgaaaaattagcaaaggaaatacggtttaccgagaaagaaaaacaaatggttattaaacttatgaaaatatgtccaggttcatctataagaatagattgaaaatgaaaacaagtatatcatttctcaccaattagatgtacaaaaatccaaagtttgaatgtttttgaaaggatgtgtgaaaaatacactttcagactttgctgtaggattataaaatggtgtaactactataaagggaaatctggaaatttctacaaatccacagaaacaatttaccctttcaagcagcaatttcagttctggaactctatcccacagatactttgtacacatatgaaatgagaaatgatgttagttattcactgtaacattgtttttcacagcaaaaaagaaagaaagaaagaaaaccctggaacaactcaaatattccctgataagaatttatttaaataaaccatgatatttccacatagtggaatattatgcagttgaaagaaaaaagaggaaaagcttcatgcactgatatgaaaaaaatctttagtatgttttattaattggtaaaattaaagctaggagcaggacagtgagaaaggaaggaaattgataaaaatggaaggaaattatgtatatgtatatttgtgtttgtataacatataatgagtattacatatagaaacactgaaaaaataaacatgacactaataaatataatttctcatagatggggaacagggtgaaggaggaatagatgggattgggagacagacatctccgctttacctttttataaagtttgacttttaagtaatatagctattttacctaccctcaaaaatattaatttaggaaggaagagataaaagagaagaagaaaggaaggaggggaagagaggaagggaaagcgggaaggaaataagtggatctagaatatttgcactggttttgccttccctcatccatacttccttcacaatgtaaaatagcaccagtgagtcagacacatgcttgataccacttgggaaacaaaagaagaatacctgagactcctatttctgtcatcaggagctaccactcttctcagggttcttcaaccttgcattgttttaggtatgcaactaaattgcaactaaattattgattctgctggaaggttatatgagtttatgcactaaatggtttcatcatttatcaccagccctgcagtgagacaccatgggcatatatcagctcttaggaaatatgttcacacatacacactgtggcatgagctttttctaagtcaaagctgaggcctcacaaaggatgttaaccttctaggtgttttaaatacatccatctgtgagaagacttcaaaatggattttgcaaaaggtaattggaattaacagctttttgtgatttggagcttggcatagacaccaaacaagaacaaaatgatcatgttcctaggaaattagggccactgtccatagctgttaggtctaaatggagtttgtggggttgagaatagtgcaatataaattgatatggttatttgtgtggtgcagcagcaaggcagaagtcagggaatcttccttggttggaggctttagaaatctccagtataataaaatctggtataagcactgaacaaataaagaggggggcaaccttcctagagaaatgaaatgaatgcaggtccaaaattcaaagctcaggaaatctgactcaacatctggttgccttcatccattttcaagtactcttattcaataataaggcaagaagaaaaatatacctttataatacccacattcttgctgccaattctgaatctcagggcacaacatcttatattcatttatttatttaccaatggccaagcattatgctctagtctaacatcgtttctgaagtattttgaatctacctccagtgcgaaggtaaacgagtgaatttccactcctccaccagtagatataagactttaggccaatcatcagcattttctcatctaaaagtaagagaatttgggttggaagctaacaagtttttcaatcctaggaattctacattatatgtatactctgttgcagaataaaatgcttcataagcctaagtagaatcttagaagctaggagctgaattctgaatcatttagtggagtaattgtctctaaaaatgctaatggaatttcacaaatgcttcctgccacacccactccttttcagagactagaagatgaggttgtgaatttatggtgatagagcaaacacccaaacacacagcagtttaattttcctttattattatatttttaatttactgtggatgactaacacttattagtattcttttctgctgccacgaacactgaaagcttctttctgtctgggtcttggcaaagtatgaaagtaaataattctttaaaatatacatagtcagtccaagaaaatcgggagacctcaattgagtttggagtcactgatgtacttcacatttaccttagaaaactgatctagagtatcaaagaaattaaaaataattaatttttagaatcacaatgcagtataaatcattcaaccaaactccacactctagatggccattaatttgcaagtgaagtaggtcactgggactcttaatatataccagggattttgttttgttttgttttttgtttttttgcttttttgcttttttttagtttttttaattttattttcaatacagtgggtacatgtgcagatttgttacatgggagtattgtgtgatgttgaggtttgggatatgaatcctgtcactcgaccaagccttttgaattgtgaagaagaaatctttcaaacatcctgccagctacccactgctggcaatatgagttggggagagtaggggagagaattcaggtaggtaggaaagcaaggctgcataataacacttacacttttacaaacagtgctctaaataaattcagagaatttcattttaacatgactgtcacgttttgaagaaaccttaagaccccaggactgaggtagctagggaaccagtttttcaatagtaacattattcacactgatagagggaagacagagacttatcaaaaagaaaggatagagattacccagaaagttgaaatagaaaacagataaaagactttcttcatctctaagaattactaagaaaagggatgtttgcaaccatggggtcatattcaacgtattttaataatcaatttgcttgggcacaaaccaatgacattttctcttctggccatgaccaaccagaagatatattcattgtaaacagtcaactgaataccagtgttctacaatcctgccaggaaaaggaacctgtcctcacactaaatccatttttagtttcttttctacttgcaattttcattttactaaagaagaaatgacaaaaaaaaaaaaacagaaaacagaaaaaacacccagaaaacattacccaccaggaagttaaggagtttgtgttatagaaaattctcagagaaactttgcactatgagtcctattaattcatgaactcctgcagggaggtaccatgactactacagctcctagaagaacaattcccagaagaataaatgcagtcagtgttgctgactcaccgcatgacagaacagacacgacagcctaagtaagagccttggagttatttttcctgcttgggattcagattcaaaacaaatgatgatgatgggctcctctctgcttttgggtggacatgaaccgagtaggaatatcaaacttctgaattcaatcacaaccatcacttaggctaagaagaatagaagaataaaaaggggaaaaggacacaagagatgaactatttcagcaaagaggggagtaattcccataccagcattccagccatatattactagcatatggtagaaagatgagatttattaaacaggaatgaagaacatgtagccaggccccaacatgagccaaactgttaccattgctagaatttatataactatgaatacatgtagtgacctgttggtcctccagaacttcattttgtaagaaggaagaagcagctccatggaaaaaaataaaccgaagacaaaacagataggcataacaaactttacttaagagcaagctttaatctttcaagaggaagagtaattcagagtaaatcattctatctgtcactctcactaaattaaaagaaaaaatggtttataaaatattaacagggaaaaatctaatttacttacatctagcattaagaagaatatcaaaatatgaattaaaaaaattaaaaacctgaaaaaaaaatcgaggaagagacaagatggacaaataggaacagctccagtctacagctcccagcatgagcgacgcagaagacaggtgacttctgcatttccatctgaggtaccaggttcatctcactagggagtgccagacagtgggcgcaggacagtgggtgcagcacactgtgtgcgagccgaagcagggcgaggcattgcctcacttgggaagcgcaaggggtcagggagttccctttcctagtcaaagaaaggggtgacagacaatacctggaaaatcaggtcactcccacccaaatactgcgcttttcccacgggctaaaaaaacggcacaccaggagattacatcccacacatggcttggagggtcctacgcccacagagtctcgctgattgctagcacagcagtctgagatcaaactgcaaggtggcagcgaggctgggggagaggcgcccaccattgcccaggcttgcttacgtaaacaaagcagccaggaagctcaaactgggtggagcccaccacagctcaaggaggcctgcctgcctctgtaggctccacctctgggggcagggcacagacaaacaaaaagacagcagtgacctctgcagacttaaatgtccctgtctgacagctttgaagagagcagtggttctcccagcatgcagctggagatctgagaatgggcagagtgcctcctcaagtgggtccctgacccctgacccccgagcagcctaactgggaggcacccaccagtagggtcagactgacaccacacacggccaagtactcctctgagacaaaacttccagaggaaccatcagacagcatcatttgcggttcacgaaaatccgctgttctgcagacaccgctactgatacccaggcaaacagggtctggagtggacctctagcaaactccaacagacctgcagctgagggtcctgtctcttagaaggaaaactaacaaacagaaaggacatccacacccaaaacccatctgtacatcaccatcatcaaagatcaaaagtagataaaaccacaaagatggggaaaatcagagcagaaaaactggaaactctaaacagcagagcccctctcctcctccaaaggaacgcagttcctcaccagcaatggaacaaagctggacgaagaatgactttgacgagttgagagaagaaggcttcagacaatcaaactactccgagcttcaggagaaaattcaaaccaaaggcaaagaagttgaaaactttgaaaaaaatttagacgaacgtatagctagaataaccaatacagagaagtccttaaaggagctgatggagctgaaagccaaggcttgagaactacgtgaagaatgcagaagcctcaggagccaatgcgatcaactggaagaaagggtatcagtgatggaagatgaaatgaatgaaatgaagcgagaagggaagtttagagaaaaaagaataaaaagaaacgaacaaagcctccaagaaatatgggactatgtgaaaagaccaaatctatgtcggattggtgtacctcaaagtgatggggagaatggaaccaagttggaaaacactctgcaggatattatccaggagaacttccccaatctagcaaggcaggccaacattcagatacaggaaacacagagaacgccacaaagatactcctcaagaagcacacctccaagacgcataattgtcagattcaccaaagttgaaatgaaggaaaaaatgttaagggcagccagagagaaaggttgggttacctacaaagggaagcccatcagactaacagcagatctcttggcagaaactctacaagccagaagataatgggggccaatattcaacattcttaaagaaaagaattttcaacccagaatttcatatccagccaaactaagcttcataagtgaaggagaaataaaatcctttacagacaagcaaatgctgagagattttgtcaccaccaggcctaaaagagctccagaaggaagcactaaatatggaaaggaacaaccagtaccaaccactgcaaaaacatgccaaattgtaaagaccatcgatgctaggaagagaccgcatcaactaatgagcaaaataaccagctgacatcataatgacaggatcaacttcacacataacaatattaactttaaatgtaaatagagtaaatgctccaattaaaagacacagactggcaaattggataaagggtcaagacccatcagtgtgctgtattcaggaaacccatctcacgtgcagagacacacataggctcaaaataaaaggatggaggaagatctaccaagcaaatggaaagcaaaaaaaggcaggggttgcaatcctagtctctgataaaacagactttaaaccaacaaagatcaaaagagacaaagaaggccattacataatggtaaagggatcaattcaacaagaagagctaactatactaaatatatatgcacccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcacctttgcaccaagcagacctaatagacatatacagaactctccaccccaaatcaacagaatatacatttttttcagcaccacaccacacctattccaaaattgaccacatagttggaagtaaagctctcctcagcaaatgtaaaagaacagaaattataacaaactgtctctcagaccacagtgcaatcaaactggaactcaggattaagaaactcattcaaaaccactcaactacatggaaactgaacaacctgctcctgaatgactactgggtacataacgaaatgaaggcagaaataaagatattctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagaggagaactgaaggaaatagagacacaaaaaacccttcaaaaattaatgaatccaggagctggttttttgaaaagatcaacaaaattgatagaccgctagcaagactaataaagaaaaaaagagagaagaatcaaatagatgcaataaaaaatgataaagggaatatcaccaatgatcccacagaaatacaaactaccattagagaatactacaaaaacctctacgcaaataaactagaaaatctagaagaaatggataaattcctggacacacacactctcccaagactaaaccgggaagaagttgaatctctgaatagaccaataacaggatctgaaattgtggcaataatcaatagcttaccaaccaaaaagagtccaggaccagatggattcacagccgaattctaccagaggtacaaggaggagctgctaccattccttctgaaactattccaatcaatagaaaaagagggaatcctccctaactcatttgatgaggccagcatcatcctgataccaaagccaggcagagacacaaccaaaaaagagaattttagaccaatatccttgatgaacattgatgcaaaaatcctcaataaaatactggcaaactgaatccagcagcacatcaaaaagtttatccaccatgatcaagtgggcttcatccctgggatgcaaggctggttcaatatacacaaatcaataaatgtaatcaagcatataaacagaaccgaagacaaaaaccacatgattatctcaatagatgcagaaaaggcctttgacaaaattcaacagcccttcatgctaaaaaatctcaataaattaggtattgatgggacgtatctcaaaataagaagacctatgtatgacaaacccacagccaatatcatactgaatgggcaaaaactagaatcattccgtttgaaaactggcacaagacagggatgccttctctcaccactcctagtcaacatagtgttggaagttctgaccagggcaattaagcaggagaaggaaacaaagggtattcagttaggaaaagaggaagtcaaattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacagcaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgttcatgggtcggaagaatcaatatcgtgaaaatggccatactgcccaaggtaatttaaagattcaatgccatccccatcaagctaccaatgactttcttcacagaattggaaaaaactactgtaaagttcatatggaaccaaaaaagagctcgcgttgccaaatgaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaacgattccctatttaataaatggtgctgggaaaactggctagccctatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaccatcaaaagcaatggcaaccaaagccaaaattgacaaataggatctaattaaactaaagagcttctgcacagcaaaagaaactaccatcagagtgaacaggcaacctacaacatgggagaaaattttcacaacctactcatctgagaaagggctaatatccagaatctacaatgaactcaaacaaatttacaagaaaaaaacaaacaaccccatcaaaaagtgggcgaaggccatgaacagacacttctcaaaagaagacatttatgcagccaaaaaacacatgaaaaaatgctcaccatcactggccatcagaggaatgcaaatcaaaaccacaatgagataccatctcacaccagttagaaaggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcaaaatagcaaagacttggaaccaacccaaatgtccaacaatgatagactggattaagaaaatgtggcacatatacaccatggaataataagcagacataaaaaatgatgagttcacgtcctttgtagggacaaggatgaaattggaaatcatcattctcagtaaactatcgcaaggacaaaaaaccaaacaccgcatattctcactcataggtgggaactgaacaatgagaacacatggacacaggaaggggaacatcacactctggggactgttgtgaggtgaggggacgggggagggatagcattaggagatatacctaatgctaaatgatgagttaatgggtgcagcacaccagcatggcacatgtatacatatgtaactaacctgcacattgtgcacatgtaccctaaaacttaaagtataataataattaaaaaaaaattaaaaacctattcttttggttgggtggttgcttttctggaatgagcgaagtggtactcaaatgccaaagctatttgaaggaaataaaaactatttggctaagacttcagaggcacagtcaacaaaaacgaaaatagtcaaatgggactatattaaactaaaaagtttctgtacagaaaagaaaacaatcaacagtgtgaagagacaacctgtagaatgggagaaaatatttgcaaactattcacctgacaatggactaatatccagaatatacaaggaactcaaacaattcaacagaaaaaaacaaataaggtgattcaaaagtgggcaaaatatctgaatagacacttttcaaaagacttgcaaatggccaacaggtatatgagaaaatgctgaacatcactaatcatcaaaaccacaatgagatattatctcaccccagttagaatggccattatgaaaaagaaaaaataacaaatgatggcaaagatgcagagaaaaggcaacttttatacattgttggtgcaaatgtaaattagtatagccattatggaaaacaatctggaaatttctttaaaaactaaaaatagaactaacatatgatgtagcaatcccattactgggtatctatccaaaggaaaggaaaccaatatatcagagggatacctctaccatcatgtttattgcggcactacttataacagctaagatatggaatcaaccttaatgtctaccaacagacaaatagataaagaaaatgtggtatatacacacaatgaaatactattcagccacaaaaagataatgaaatcctgtcattctcagcaatgtggatgaacctggaggatattatgttaagtgaaataagtcaggcacagaaagataaataccgcacattctcactcataagagggagctaaaataaaaaattcagctcatggtagtaaagtagaattgtgggtattagagattgggaaggatgggggaagaggaggatgggaaggagttggttaacagatataaaattatagctagatgagaggaatgagttctggtgttctgtagctctgttgggtaaacatggttagctataatccattgtgtattttcaaaaactagaggagaggattttcaatgttcaaaacacaaagaaatgacaaatgtttgaggtgatgtatacgctaattaccctgatttgatcattacacattgtatacgcatattgaaatatcattctgtaccccataaatatgtacaatgattatgaatcagctaaaaaagaaaaaacctatctgaccaggatatttttggttattattatatgtcaacaataatattaatgatactataagtactgagcacaatgatccccaggaaattagtttgaacattcacccagaaaacaaaagtatcatatatttgttaaacatcttacctagaaattctttatttggaaatattcctgggcattatacaatgttgaagatacacatttattagtcatcatcattggaatggttttcactacgatgtcctattaagagcaaatattctggacatacatcttcccccatttaactaattagcataagaattaaaatataaattttatatatttcactcatctcttatagtagcatgcatttttccagatgggtatatctgtgattaatctattcagtcacacaggaatgttactaggttttctacaaagacatataataaagaaaaatataccttgtgataaagtaaataaaaatgatgttatttaatacaataaaaacctaaagttaataaaattattagttttgttctcatttgatatgggaatgacaaatactttattcccagactattttatccttttataaagatttttgtctttgccaaacatctagatttaattcatgatttgaaccttaacagttatttaatttaacttacttgattaaaagctatttttatctcatcttaatgttttgatatctgcatcgattatatggcttttaaaaaaaacctgacttatggaaaattcctgaccctaaagttggtttcttcatgctttacaagtagaatccaaatgaaccaggtaaagccttcaatcaatccagctgcctcaggaaacttcactaatagaagagctgccattatatttctgtatatttcattaaaaaactgattaattatactttttaaaaagcttgataatccaaagagtgtgtcaattttcattctgaacattattcaccaacaaaactaaatgcttatgtgcccaatttcagacatcataaccaatgtattattccttttacttttgacatcttctccatggagtgagtaaccactactgttttgaactgtgtggggtcgtatggggttgtattatacaaaatttataaaaacagtatgataaacaacatgactcacttctggtttagtatcatgttatttggtcaccttgattccataaggaccatccgaactttcagtcacaacttgaatgacttattttattgggtattctacttagtcaaaatagcatatgcctgatctcattattttgaaaactatacttcagggcaaacttaacactaaactctggctaagaggtaactaagaaatgttactttggtcttgtcataaaaccatctgaatagattctctcctcaaggtcactctctcaggagggccataacaccctctgccgactatgagtcaaccgaggatccttagttcctggctatatcctacactatacaaggtccaagtagagaacacagaggagaatggctctgggatctttaatccaagaaaagagaagaaggtaactttatttttgcctcattctgtaacgccatccaaaatttccagaagagagaaggttcatgagggttctgcttctgtttgccctgagttatccacaagctgctttcaagggtgagggttgggcatccaatccagggagatgagacgtacgtcaacttcatttgaagaggatgttccatgggcttactttgaattattgtatgaaaaagtccagtcatgtactttttagcctccataataatataaaattttatactccaataatcagggcctctgtcactttcacattatgcattaaataatgtaactctgtgttcaccatttaaaagaagggcaagtcctaagcaggagagtcaagttggcatcatgccccctccatcctatcacctccttccttaagaaaatagaagaaacttaagaaactgtaacttttttgaacataataaataccataaacttatttgagatcaacaatatgcaagattgagaaggatgcaacaaagatcacaaaagtgaacacagatggactttaccctcaagaagcttttaaaatcaccttttccttaacccttacattgccatcattttagtctttgtgttgctccctattaaggaatcatggcagcttctcacctaggggtcacgtggaggcctcggagctggacatttcctaacatgcctcccttcatcctaccatagttgctcaccatgtgtccagtcctttgggggccatacatggttacagaccccctgagtctctatgttcccccatgacattggaagaaatattgttctcctgatagaaggtcagttcctaaatctgttctcttcgacccattcacttctgcctagccagagaccttgccataacaatcagctcttatctctcttgtgtcttcaaccactccctctaagttggctcttttacatgagcatttaaatgtactcacagtattaaacaacaagaacaaaaaaaatttctcccttgaccctataacgtctagaggccacctaaaactgccaggtttacaggtgatccctcacagcaccagtagtacctccacatagttcaactccaaagatatgcctggttgtccaaaaattgttctgcaacatggtggcaatatttactggaatgtagagtggcagtacctaataacagtggaaaatgtttaactaaactctgttgaaataaattatacaaccaaagctatgatataagaaatgggtaacctatgtggataataaagttgatgctccacccgattcggtgaatctcacattttcatagtaactagtagtatttcatagactcagtacacaatggatgttcacattaggtattaactgatatcacttgtaaatgatatccatgtatttatttttacaagatggcaacttagtttttaaaatataagtgaagtggtagggcaatcatgttttaaatgtaataaaacatctgtatcggtacttagaaaatataaagcattattgaaaaaaattctctcacttgtaattggtcattatgtgctttctaaagttttaatggctaagactatctaattcagattagtcaaatgcagaataaagacatcctcaatttacttgaccctgcagaacctcacaaaatacaatcagcatctctcaggaaatatgttgtttcagagctggaggtcaagacattatgatgagtacaaaccagagaacataattactgaatctggttcccaatggtggacaggatatactaaagaaaaaccaaatgattcattccacaagtttatccctgatgttgccccaaaatgctttgctttacatgaagtaaaaatctcaccaggctgcaaaggaactctcatccatcatcactttgcttgttaaatcttactgaaataacatagaatgtcacagtggatgagaaacaataagtaaggcaatattaccactttaaaaatccatacttcaggctgataaagacattatatgtatatgtgtgtataaatacatataactatgtgtgtatgtatgtgtgtgtatatatatatgtatgaataagctctacacatataatcacatagattagatagatacatggatggatggatggatggatggatggatggatggatggctagataatacttaggatgcctcacaacagttcctaaaagccattatatagaaaaaaacggacagtattcagtagattgaagtggcagatcatattttctattaccagaaatctacacagtccagagatattttgaaaaaacttccccagtgtactgacagaatgtggttctcctattcttgtgtggggtacactgttaacataaaagaatttccaaggtctccctctggaagtagccatctttgtgtgtcaccgtcctttaattgatccatttcataggcagtgctggaatggttatgagtcactgctgtgtttggcatcaccagggtaagattcgccaccatgttccttcctcatcatgaggtctctgagtgaatctgacacagaaacaccttcagggtgtcatgaacaaaaaattaattgcatttattatcataatggactatgtaagaaggtcattgaagacaccaaataatgaggataattatttttaaaaaactagtaattttgagcacctactatgtaccagatacagggcaaagaactatatgttcactatcttgtgtctttcacaatataatgctataatctatgtattatctctatttttcagtgagaagcctggatttacacagcttaaataaaacactcaaattaaacagccagttagtgacagaattgctatttaaattcacgactctttgtgtattttttctctgtatttccagattcaggctgtttagtcacttgagatctagaaataagggtactaggtagacacaattccattgtattataataccaacatcaatataatattcagtgcttttaaaaaagaatatgtttcttcttaggtgaaataagtgaattattgaccagtttactgattcagtaactgaatcacatactcattcacataagattttacgtgaatggaggggaaaggagtaacctagatcttgctgttgtgtgctcaattctttgctcacaacttagtatagaagatttaagttggaggttatgctttgtagtaaacaacattatttacagataagacatgaaactattaaagaatggctcctgccacaatgcttggactacgtatctttaactcatctccagaaaggtcttctacatagcatgagtcccagcctggttgtcataattcaagtctatgggagggcaaacgatggattatagtgagggcctgagaaacagcacagaatccacagtctctcttacatcttcagcagccatgtgcaacacagaccaacctagatggtgttgtgcatgtgaacttttgcccacagacaaaaggttgagacccagagttctataggaggagcaatagcatataaaaattacatagatttaattctgagcttccaaagatgttaataagggtaacccccttatgcctactgacaccccccattgccatatagtgccaccagtacaacataatcctttggaagtctcccattctaaagccactcataacagaaatttgaccaacgtgttgtcccagataaagagcagaggagaaaatgtacattcttaattctgtcagctttataaatacctcataatgcagaaactgatagtctataattaggttaattatttatgggaaaataattgggttaatgagatatttctttatgggaaaattcggttggtgctgctaaatagaaaaaaaaatcaaagatcttaaagacatcagaaacgagagcaggaaaaaattaaattcttacatttgggaaattgcaaactcattgcccataggaaatgacatctggaatgcaaaaataatatattataatcaactgaacaccagtttgcatctatcatgttaataagtatagctacctatgcagaacggtataaagcaagcaacatttttgttaatccctttgcaacaacccattcaaaagatctgagattatgagatctgaataaaacaccttactttcataagctaatgttagctatacttagattttttctgcaaaaattattatgaagaagaaaaataatttgacattacccaaaattgcatatttctaaaaaaaaaaatatttccttccaactcttatccacaacataagtaattttaaataattataattatagtgttgatataactttatattctccttttcagttaatgttgtattttgttttggcattaaattatttaagagtaactaacactttttccaaacaaaggaatggttctagtaacaacagccatattgatctgtcattttttcacttttatcccttaagagctatgaatccattttctcctataaggcctactggccctttgtttttctttagtatctttagatactagatatattccagattaccactcacaagtctatatcaaacacattcctgataaactcaaccctacacttaaagttttcactttcttttctttatcctaccacctcaaaaacataatgccaacattttataaatcagctcatattagactacaatctataaatatgcaactattaccttccctttatattccctttttaagagaattaattaactacaataaaatatgaatgtactgtcttacttcatggccctgaaatttgatttatattaactctaaagagaccctgatcccacaacacatgatccatcatcaatcatcaccttactcctcgccatcttgaatagttactattctttctggttcctttccttttctcaccatacatgaagagaagacctctggctcataaaaatattctactctgattacccctgcagctaccaaccctctttcctttttgctactaaacacaaacacacacacatacacacacacacacacaccacagagagactgttgaacctttgatgacttcatttcttcatctcttaatcatttcttccaccccctcaatctgacttctgttcacaccactctgctgaaatctctcacaaagatgacatgagcaccaacttgccaaacaattgatcttttctttatcttcatgttgtttgacatttgtatatcttgtggcaatttaaccacattctcctgaaaatcactccttttgttgttgttgtttctaggccactgcatagatttcaagtttcctatcagctctgttgactgtcttttctctattttctaaaagtgagcattacccaaacaagtttctgtcattaactctcatagtttcttactttaagcagtcctatcctgaactgatcactgcaagagactcagtcaacccatttccctaggcggcttatctggtgacctctggctccttgagactgtttaagttgaggtttacttatgctgactgtcatgcttccgcttttgttccagttactctacttcacacttgagggtttgatgaagtttttctcaggaatcccatgcacttgcttttcttgaatgcttttcaatttgtgcctgggtttttaagctgatggtttctttcctcagcttggtcctccaggcactatatatggcagatatacgtcacagtttttgacctctgcatggaaacctttcctgtttttcaggatggatgtaggttgtgtgtgtgtgtgtgtgtgtgtgtgtgtgtgtgtttactgagaatctgcaataaataaataaataaaacatgtgggctcaaatggccattcagaattgaaattccacctcttactttccaactatcctacttttgaccatttttgcctgacacttacatcaattccacagccactagatcagtgtttctcaaacaacctgcattatcatcttcaagagtggtgtttatgaaaatgcagctcactgccttttaaatccatttccactgaaacaaaatctctgaagacggagtcctggtatgaagccctcccaggatattataacatgtttccccaagagattctgatacacactaaagttggagaaccacagcaccagactgtaagacccctaaagtgagtgcactcaaggtctgtgcatgctctactatccaggaactacacacacaggcccaactgattcttcctgaaacatggtctgaagctcatggcaaactcctggtacaaaaaattattactaccaacagcaagataaagtccttaaaccttgttggtctgccctttaaggtattccacaatctgactttcatccatcattttagccttatcaccagttacttgatgatattaaccttatgctcacatgttccacctgtgattgagaggccttggttaacgttcatatgaaaactatgatggacactattcatataatagtttacaatttgactgaacacctaagaaagttctgtaagtttcaggaactcacaaaaatcaatgagcaagtaactgtaaaccaaatatgagccttctgagagcatgccttctctgtaaccaaaggctggatatctttcctccagtgaatgtgcttgctgaagcagagattcaaataaagaattgaaataatccttacaggctttcaccttgttggattgcatgatgtttggaaaatggttgtcctctggaattagattttctggatttaaatctcagctccttcattgaccttggataagttacttaatcccttggcttcagtttcttcatttattataaggacataatgagaagacttaactcataaggctgtttggggaattaatgagttaatagatatgaaacatataggacaatgcctaacacacatagtaagtatatgtggtacacacactcatactcacactcacacatgcatatacataagtgggtatgagaaatattaaacttttatatttaagaaatttaaaatactaggggtacattcagatgtaaataaaaatctgtgactcagaaagtttggtctttggtcattcaagaagagatttgggtgtcatcagtatatacatgggacctgaagccacagattcatatgagctcacactgagagatgtaaaggtaaagaatatgagaaacttcaggatagaagctaaaaacagaaacttagtggacttggcacttcatcaattatttccaagcattctttacaggtctaaaagaataatctacaagcacagaaaaacatcttcttatggaaaaaagcattgttatgcattccagaggttacatgtagagccatgaaaattatttatactattgctttttttagctgttcatcaaattcttctccaatatgtccattgcattagaacaaattcatgttttcaagacaagtgaagcagagcttactgtactttgtgaagagcatagatgcactaacaggagaggtagtgggtctgagtaactccagataggagttagttgctacaaactttgtgtacctatggaggatgcttaccatgtgctcaaagtgaggaggtccacttggcagaagggcaggaagccacatatgttgcaccaaggtattgacaatgcaaggacagctcttcagaaacaagagctgtgtagacagtgggtgatctgcagagtcagactcacataccttttaagtgggcattctctagagtaactcttcccctgggataatgatgggaaagaaccctgcagaacttcactcccatggacagtcttgtgtcaggtgggcagctgggttttgaggtttggtttggcccataaagctgtccagttcctaagagagtattgcagccctgctcatgtattatatacctatattactgcctggcgaagtttatactcccacatcttcccaccacatcttcctactcattgctgcatcaacctgcagcaacggttgggttgcctagtaatggcttttacccactgcgatagttaacactgagtgtcaacttgattagattgaaggatgcaaagtattgatcctgggtgtgtctgtgagggtgttgccaaaggagattaacatttgagtcagtgggctgggaaaggcagacccacccttaatctgagtgggcactatctaatcagctaccagcacagctagaatataaagcaggcagaagaatgtgaaaacatgagactggcctagactcccactctacatctttctcccatgctggatgcttcctgcccttgaaaattggactccaagttcagttttgggactcggaatggctctccttgttcctcagcttgcagaaggcctattgtgggaccatgtgatcatgtgagttaatactatatatatataggatatataggagatatatatatatatatctcctattagttttgtccctctagagaaccctgactaacacacccactttaggggatgaggaataagatgcatttttaaaagcccagaaaaggtagggaaattctcagcaagtgttacttttagaggaattatttctaactcatagaataaccttgtattagtctgttttcatgtggcgataaagacatacccaagactgggaagaaaaagaggtttaattggacttacacttccatgtgtctggggaggcctcacaatcatggcaggaggcaaaaggcacttcttacaagttggtggcaagagaaaatgaggaagatacaaaagtggaaacccctgataaaaccatcagatcttgtgagacttattcacgaccacgagaacagtgtggaggaaactgccccatgattctaattatctcccaccaaatgcctcccacaacatgtgggaattatgggagtacaattcaagatgagatttgggtggggacacggagctaaaccatataattcccccctgggccctccaaatctcacgtcctcacatttcaaaaccaatcatgccttcccaatagtccctgaaagtcttaactcatttcagcattaacccaaaagtcaacagtccaaagtctcatctgagacaaggcaagttccttccacctatgagcccgtaaaatcaaaagcaagctagttacttcctagagacaatgcaggtacaggtagtgggtaaatgcagccattccaaatgggagaaattggccaaaacgaagtggttacagggcccatgcaagctcaaaatccagcagggcagtcaaattttagagccccaaaatgatctcctttgactccatgtctcacatccaggtcacattgatgcaagaggtgggttcccatggtcttgggcacctctgctgctttggttttgcagggtgcagcctcccactggctgctttcatgggctggcgttgagtatctgtggcttttccaggcacatgcttcaagctgtcattggatctaccattctggggtctgaaggctgtggccctcttctcatagctccactaggcagtgccccagtagggactctgtgtggaggctccaaccccacatttcccttccacacttccctagcagaggttttccatgagggccctgcccctgcagcaaacttctgcctgggcatccaggcatttccatacatcttctgaaatataggcggaggttcccgaacttcaattcttgacttctgtgcatctgcaggctgaacaccacatggaagatgccaaggcttagggctgctgccctctgaagccatagcacgagctgtactttggccccttttagtcacagctggagtggctgggatgcagggcacctggtcactagactgcacacagcacggggaccctgggcctggcccacaaaaccattttctcctaggcttccaggcctgtgatgggaggggctgctgtgaagacctctgagatactctggagacattttcctcatcgtcttgaaggcttaacattcggcctctcgttacttatgcaaatttctgcagccagcttcaatttctcctcagaaaataggtttttcttttctatcacattgtcaggctacaaaattttttaaacttttctgctctgcttctcttataaaactgagtgcctttaacagcactcaagtcacctcttgaatactttgctgcttagaaatttcttccaccagataccctaaatcatctctcaagttcaaagttccacaaatttctagggcatggcaaaatgctgtgagtctctttgctaaaacataataagaatcacctttgctacagttcccaacaagttccttatctccatctgagagcacctcagcttggatcttattgtccatattgctagcaggctttgggtcaaagccatttaacaagtctctaggaagctccatactttcccacattattctgtcttcttctgagctctccaaactgtttcaacctctgcctgttgggcaattccaaagtcgcttccacatttcaggtatcttttcatcaacactccactctattggtaccaatttactgtattagtccattttcacattgcttataaagacatacccgagactgggaagaaaaagtggtttaattggacttacacttccacatggctgggaaggcctcacaattatggcaggaggcaaaaggtacttcttacacgtcagtggcaagagaaaatgaggaagatgcaaaagcagaaacccctgataaaaccatcagatcttgtgacacttattcactaccatgagagcagtatgggggaaagtttaccccatgattcaaattatctcccaccgagtccctcccacaacatttgggaattatgggagtacaattcaagatgagatttgggtggggacacagagccaaaccgtatcaaacctcaatgtcaaagtcttcttgatatgcagtgaccagggaaagaaggaacagatgttaaatacatgaggaattttccagttattttataaataaatatacctaatgacaggaagaaaaccctaatttccagtcccatttgacctttctcattttactctgaagccattagatcagcatttgaatttgaccacaaaataaaatgtggctaagcaaaagcactataaaattccaaataaattaaacaattaccccacaaccaaataatactgcatggaaatctttcactttgataattaagaggtaaaattaaaatattacatgataatatcccagtacaaatggtcgcattttcaaattcccatggtggtacaatatatttatcatttatcaaaatttgaacgtaacacttaattatataattaaactatggggtcttatataaagaaactattgggtctgattggccctagtctattttgaaacatcataatgcatataacatctttttagtttaattttccaaaattagttttatttaatactatgacaattgccaagttggtatctgtttttcccatgttctttgtgattgttttaataaaatgctccccctaacctcaactgtctaagtactcagaacttcctcagattatttcttacaatatttcagctctcagggctgtccagaaatattactacatcttcctagttcattcacactcctgcttacagatgattatttcacaactctccttaaatttttaacagcttctgctctatcctcacactcagttgatagcctatttctttgaaaaaaataatagcaaatcagaaaacaatttttctctgcagcccccatcacatttatcaaatcctccatttatgtgcctgatatcatctcttttctcctcttcaagtatatcactccagttattactgtctctgttgcatcactaatttcctcctcttctctggattcttcccatttacatagcaacctgccataatatgtccaatttaagtcttaactactatatatcttatttctctgcctaaattctttaaagtaaaactcctcaaaagagttttccaaactcatgatattcagttcttgccctcccaccatttcttcttgaatgtactcctatgtttttgtttatagtactccactgaaacagctcttctcaagatcatccaaggtcttctcagtgctaaattcatttgtcaattctcagttctcacttaagtaatcagcagcattcacaattaatcatgcattcctttgtaaaacactatcttcattgacttccaagcctttcctcactctaggttgtatttctgcctcaccagctgctccttctcaaaagctccatttccttttgaatttccaacttcaaaacattagagtggcttttcctatttatctatggtaactcctcagttttaaaatcatcaatacccaaattagatttgtaaaaccaacctgaactcaagactaccataaccaactgcctatctttccactgatatatctgaatgaatgtaccaaatttaacatgaaaatcttgatctctccctttccatttcagtaaacagtatctctatttgcacagtttctcagaccagaatttatatagtcatttttgactttccttttccttgcaactgatctcaatcaagcagcaaacttgtgaaatctaccttagaaatatatccagatcttatctttctcaccgtaaacacagctaccaccctagtccaagccatcataatctcctgcctggaatactgcatttatcttctatagtagatgctactgacggtcttctcagatcccctttattgggcaggtacacccatcttccagaggttgtactgactgctaaacagctcatagctgtactcctgcagaaatgtctttgaaagacccaagcggggagacaaagagagaaagacagagagagagagagagaagagtgattcaattagatagatagataattatttattacctatctttcagaatgtaagctctgtgaggatagaaatgttatttgttcactgataaattcccagtacctagaagaatttctggtacacaattggaatcaaaatatatttgctgaattaaggaatcatctagtttatcctgctcaatgctcaccttatcttggctctctgccaatatccaaatgagaaacagaatttcatttacggaaaaggtaagtgctcagaattaaatgttaaagaccgtcttcctaaataagaagatgagggctatggttttgctattttgagttaaaagagccctttaatatcccaaatatcctagcctgaaagaagcaatagtttgagaaagagaaatagttgggggcatggttcttttgagttaaaagggcgtttgactatgattttacctccattagcttcagaagatttggtgctcaatttaataaagcttcaagaacagcctaaattgtaatacatattcaacatttgactcgaatagtgaattgcatctatcagatcatccagacatttagagttttgctaaaaaaaaaaaaaaggttgttgacttactctcccaaatccagctatcttcagacaataaaaaccaaacttaaacccgaggtcattagcacaagtcacagatgccaaaacaacactctaaatatcaagcagaaaatattttacttttattctgccataatctacttattttttttcatagtaagtgctgaagattacatagaaattttattacatagattttttatctgagtatttattaccacttctaccaaatctttgttcctttagaaacaaacagatggctaaaaaatgaaatgggaataaattaacttgatatgttcaaggcagtcttaatatatcaataaaaaccctccttctaaatagcaaccttatgtgtctgtctgaaacaaaatggcacacttgtattttttattgggagtcaaactgggctggccaacaaggcaattttgtgaaatatgtctttcaaatgaatatatttaaacactagccattaacagccacttcaactaaataaatacttatttagactctctctgtgctaggtggtagggtagggcttaagattaaaaaacgaggagctgccgagaacaaagatgcttattggattcaattgtgtgtgagacattgttctaggtactactgatgcagtgatgagcaaatagacattattcagtgaataaaagagactaacaatttaatcacatttacattaaattatacatttactcatatctgataagtacagtgaaagaagtatgcagcgtatgtatacttctgcagcatatatagaagatagttctgacaatataacagtccagagaagtcttctaaactgaagtgaatttacaaagatgggaaggatgaggagggattcactaggtaaaggggagagaaaagcagaagcatgtgttcctggcagagagaacagcatgagaaagtgccctgaggcactgggtggaaagtcggtgtacaagaagctgagggagtgaaacaggcaggggatacttcaggataaggcagaaaggaggctggagacaaggtgtgattcagattattgagcccctggacaatcacacaaaaatgacgttaatagtcttaagaacaatgggaaaccgctaactggttttaaggcaagggtgtgtggtgagtgataaggttggacttctgtttcaaacaggtgactgactgcaatatggagaacagattggatgaggggcaagagcagatgccaggaaatggatcaaggcagctatcactgtggttcaggaaacaggtaatgccagcacagacaggccggccccgggaaagatgaagagagagggatagatgcagcgcataactggaaggtgaaatcgacaggccttagtgatagggtacttacagcaactgagggaggaagatgaaggtgaagaattggatgactgttgatattcatagttttaagggccacaagagaaaaatcaggtcgcagtaagcaggctgtgaggggaaaacagaatttcagttttggatattttggatctaaaatgcctctgaaacactcaatggaagatattgaaaaagcggtaggatatacaggtctgagttccagaggacaaatatgggctgaatatacaaattggcgagtccttagtatataagtgatcattgaaatcagaggcatgggaagtatagtgtaaggcaataaaaaggaggaccacgcctgaggcattgccaacacttaatggtcaaatagaagttaaaagggagataaagaaggagaagccagagatgaaagaggaaaactgggagatagttgcaatactgaaccaaggaagaggtcctgtgaggacatggtagcagggagagactatgtccaagtagtaagattaggaatgagtttacttcttacctagaagttggaaaagatctgcaataaggcatattaaactcctgagattgggataacttatccaaaactgtaaccctaagtcagtaaagatgatcttgggatgtatcagtcaagaagtctacagaataatactgtccaaaagaaacagacatatgttataaatataatatggatgcaacacatttgttttaaggattacaaaaagaaattgatttggatagagtgcagtatcatctgaccttaagcagcgagtggcagagagtcaatgaaattcattccttcttccctgggcccatagctagaccacatttcttttgtatagacatgtagatgtaaggtaaatggaagcaacataagccacttctgggcctgctcataggaaacatctctgggttccctattcacatactgatgggagagaagtctgaagtttgagaggaaaatgaagccacaggtgcataggaagaaacccaggtgtctgggtgaccaggtggaaggcagctggtgaaccagaaacatcaactgacttagcatgaatgagagataaacttcaattgtttgagcaactgggatttgggtatttatctgttacaacagttagtattaactactctaactgatacactgaagctggctacgttggaagcaactcagaggggcagcatttatctcacagaccatgatcaccttttatctctcattgattcactagtgaaccatatttctatgatacagacagaatgatcaaaaccaaatagcagttaatttgctacgatgcattttcttaaatctgaatgggttagaataattcaaggtggttctgttttcctgtcaaacagtataatgttttcaagtaaattacagttaagccatgccttaacagaggagaaaaacaaagttctatgttatttctttgattgacagtttattaaaaagcaaactcaaattttgtcatcaatattgtgttacagtgatttaaatagtaattaagcaaaatgtagttctctcaaattgaaacagaaaactccagatttttaaaatatgtgctttttgcttagaacagcactaaaatttatttaaaatatgtgtttttatataacaacatgcaagtgctcatatgacagcttggcagagatgccgaggaatctttatagaaaacctggtatgcatatttcatatgcttaatcataacttcttctttaagtctttggaggaggaaacaaagggccaacaatggtataataatggaacttgaaaagttctacaggtagagagaagaggcaggaaaaaagaaatgtcaaatgcatgaaagtattattaacatgattgagaatttctctgggttctcaacatctttcaggtttaatttcagtatctgatcagtaatttgatgactgcaacttaatttttagctctctcccaggtaggaccagctacatgatgtaagagcccatctaggtgtggaacccatgtgaatgtatagtttgtatatccatgaagctgggcctgcactcatgtcactctcaaaacaacaacaaaaaatttcaaaataccatagacctgaggccaagtttcaagtgtgatgaatggaaatatttgattgctgctgttagagtttttgtattaactgtagccattaatcaatgttgtcctataaaaactctattgaagtataagatcttaggtttcctgactttcttttttattgtgtcatatagataatcaaaatgtagctagaacagaaaggtctctaaagcaaaatgatgcaatattctttttgaccttgctgcagcctgaatgtattcccccaaaactcatctgctgaaacctaatcaccaatgtgatgatattagaaggtagggcctggggggtgattatatcatgaaggaggaaccttcatgaatgaaattagtgcccttataaaagaggccccagagacctgacttgtctccttccaccatgtgaggacacaggtagaatgcaccatctataagccagaaagtgggccctcatcagacaccaaatttgctggtgctttgaccttggccttcccagcttccagaactgtgagaaataaatttctgatacttataactacctagtctatggcattttgttgtagcagctcaaatggacttagacagctctaaacttagactgcacaaaacaggatggtgtgcactgctgattgagatgggttcctattctagagattaccaaatattggcaagcttacagtagaaaagtatcctggtgagaaaaaagttactggaatttctcaggcaagttcaaaggacatattttttcatgtgagatgcccaatctgtctccatgggcaggagaggacacatttccttgacagtctttgtagatgagagtgataagagagattagatttctaagacagggctatgtctataaacagagaccatccttttatttgctttcccatgaactcaactgattccactgcacaaagtcataggcaggatggcaagagactcttaaaaacagctttgtggtatctgcaaaaagtaaagggtgatgacttgcactgtcactgaacatccactgagcctctagaccagcttacttgtcttggggctactatcatggggaaagagtattagtaaaagatgacacagtggtttggctaaatagagtcaagacacagaccatcacattgagctttaaatttcaaagatgtaaaagatatgtctgtgcctatgggtcccaggttggtgttttaatattgttaagtttgaaaacatttacactgatacacagttaagacttatatgacttgtctatggagcaattctaaagttgaaaactataaacagggttttcatttttatgactatgtaaagattattttctgcaaagtgaaatagttaagattacatttccttttctctgattcctatgtcagaattagtaggccactcagagaaggatgtttctagcatcaatttacaccctcaaggttttccaaaacctcattcacactctctaatctattaatatactctttccaagagattttcctaaatatattttatctattttctttcatttaatgttttcattaaataaactttgttttgctttgttttcgcttctgttgaagtgatggtaaatacctggcttcatgccacgtattctagtatggggctgagaacagatgtggtaagtagagaaggataaagctgggccctctacattgtgttagacccacaaatgctcaagatttataccttccctgtatccacccttttgcaatgtgactttgtagttcttctcatcaacaaataacagtctgttgcgatatcctttgaatctggactggtcttataacctagtcaagcaatgcaagaatgaagttaatgtgtgccaattctaaacctagactttaagagatcttgcgtttatattatttctcttataatcctgctcctctactaagtgacaatcccaaactagtctgatgagatttgcaaggcctagtggcccctatcttgctaactgacacccaaccaacctgcagaagcagagctgatcaactgattggttgagcaaagacacaggaatatgcccatataagcccagccaaaatggctgactaggcagaatagtaaactaaataaatggttgttttaagccattatgatttaaagtggctcattgggcagcaaaaactagtgcacatgctcttgatcaaaatgctgattacatctatgtttctcatttcaatgtccatcagcattggcttatctgaaactggagccttgttagcttctgccatgttattagggcttcttcttgggtgtagctccctctacaaatattctctgcaataattgactttgttttgcttcagtaatcaacaccactcactcatatttcatcttccagaaattcgataaaatctcttaccactgatggccttttccccattctctttattgttgtgcattatacagatttagtttttctactattttaatgggtattaggaaaagtaaaggaaaacaaaaaccatgtgttctgtcaacatcttgaactaagttaatgagtatttattgagcacctattgcatgtaggctatataaaatattagaaacaacatttgtttataaataatgttaaaaagcattcattttagaaaagcatgcttcctaaatttcatactcaggaaaatttgttagtgtaatccctgtatattttagaaattaatttaactgtttttatttaaaaattgttttcacacttttattgcatattcatttatgtattaccgtattccagaaagaatttacatgttggtttttgaactaatctagacaacttcttccctcattgttaacgaatggtaaatttaactataattatatttcagtaaaaaataatagaatcagtatattgtaaatacccaattatttggtgtaagtagtgattaaagaaaaccagacaatcatactcagtcattcatgcattagatactttgtattgacaatacacaagatactttctggtaaaatagatgaggacatggttaaaagagcatatttttattcataatataaatattatcaaaggcacaaattttagtattggacagttcactatggttacatttaaaatattactcaagtagggaggctgaggcaggagaatcgcttgaacccaggaggcggaggttgcagtgagccgagatcgcaccactgcactccagcctgggcaatagagcgagactatacctcgagaaaaaaaaaattactcaagtaaattttgtgttcattgtgaataaatgcatgacatgggtaaaggcactttcaggcatatccctgttgtctaaatgaaataggaaattactatacactctgttccaaaccatagtgtagtccattgcctctctcttcaggttgtgttccacttccaccagatgaagagctaaataataaaagctcatgtttccacataaaaaggcatcaaagtccaatttctggctctgctataaactgtgtaacctggagtaagtcacctaacttctttgagttctcagtgtcctcatatctatcaaataaagaggatgaacaaggtgatctctaattctctcaccaatctctctcctacattattatcaaaatattctccaattataggctttggagacacctagatatgggttagagttcatactctgccacttattgccgtcaacttatttatttatttattattaattttttttagacggggtctcgttctgttgtccagactggagtgcagtggtgtgatcttggctcattccaaactctgcctcctgggttcaagtgattctcctgcctcagcctcctgagtagctgggattgcaggctatagtcaacttctaacaaatatcaaaacctaaattgtattatctatgacacagagataacctgacgtaactatcatgaaaaaaaagacacaatgcaaaaattgctcctaacccagtgcataaaacacagcaagcactcagtagatgctagctaatattaattagtgttatactacaacatcctcaatatttttctagatgctaactggacgtttccattaacaggtagatcactactttgtgagaaaatcctttcattctaggacatcttaattattaaggctttacatacacataatacatatacttaaaatgagcttaaatctgactccttgtaactatatactctaccatttagtagtttttaacctggagtccacaaagaattcaggagattggtaaacttgtatgacaagtttacatctgtatttttactaacttgtaactgaaaaataccattttcttcaattatgaatatagttaccaaaccactgtagtttgtgactttgttgccagtaaaaatcatagataccttcttatctcattagacttcttgcaagcacttcaaaattaagtatgttagatatgtgatctgctggatcttatgatttaatacattaataaagatgcacatatataactataccaaatttttattttaatatttgtataatttgttttaatacaactggtttcatttttaattctacaattttattttgtgcttataaacattatacaggctgagtgtggtacctcctgcctgtaatcccagcactttaggaggccaaggcaggaggatcacttgaggccaggagtttgagacctacctaagtgacatctcttttgtagagaccccatctccacaaaaacaaaattttaaatgatccaggtggtggcccacacatgtggtcctaactactagggaggctgagacaggaggatcgcttgagactgcgagtttaaggctgcactgagctacaatcacaccactacagtccagcctgggtgatatagcagaccctgtctccaaaaacaaactaaaaacaacaaaaaactattatacagttgtcccacagtattcgtgggagattacttccaggacctctggcagacgccaaaatccatggatgctcaagcccctgataggaaatggcatagtgtttgcctataacccattcacatcctctcatatattttaaatcatctctagatttgttgtaatgcctagtataacgtaaatgttatgtaagtaattgttataatgtattgcttaggaaataatgacaagaaaaaaacatccgtaaatgtccagtgcaaacttttctcttaagtttttgatccatggttagttaaatcccaggatgcagaacccatgggtacagagggccaagtgtactgagaaggcattcataggtgtacccttcttactgaaaggattcaggatttacacccactccatacacacacatagaagattagtaaactctgctctgaagtaagctcacataattctactcctcctccctgacgaaactcttaaccactgaaaaacaaataagaccttggaatgctctaaatgtttgtgtcccttcaaaatgtatattctaagacctaatcactaatgtgataatattttgagatggggcacttgagatgtcattagtggccctataaaagaggtccaagagagacccttcgcccctttaaccatgtagacacaactataaggtgccaactatgaaccagaaagcacaccctcaccagacatcaaatcttctggcaccttgatcttggacttcccagcctccataactttgggagataaatttctattgttcgtaagctactgagtgtatgctattttgttataacagccagaatggataaagtcagatctaattgccagatgtctttcttttctttctgcctctacttaacatctctagttgtgcatgcctacaggcatatctcatggaagactaacgtgcaagatgagctatgaaaaaaagtagtctatcgttcaaaaatgggggaagggaaaaggaaaaaccatcgaataccagaagcagtaacaggaagggtaaaaaaagaaggtagctggatggagaagcaaagttaaaatgatttttatcagacagagcaaatgcatttgtagaaagaagttaggagccactggagaagaaaataatcaaaatagagagaagtgatgaagagaggaccatagtgctggaagaaaggtcaggggatgaaagtaaaaagtaaatagctatagaggagtgcatatcctttcaggacactaaggtgggacatttctcttcaggcttccttaatggcctcctgtcttggacagctgcaatgcatattggtatattaaagaccatgaaaagtactgctcaaaagacaccttttgcttaacaactcatcctttccaagcttctttgacaatagaccttcccttctcataataatcattaatgttctaagagctactgctctgaagaacacactctgggaaacttgtaatttttcattgtacaggatattccataggtggtctgacaattgtttgagcacaatgaactactgctacctttcttgtctgagcaataatatttcaattaatgttgattttctttccctcaagaaagattcaatttagaagatttttagatagacttatcacatatttgatacagtacttgcaattaactaccatttttatgagaatgaggtctttctgtacttgcgctactgctttttaaaatttttttcttaaagcctaaataagaaattaacctttctttcctgttagattgtgtcttgttatttctggactatcttttttttttttaatttttgagatgaagtcttgctctgttgtccaggctggagtgcactggcatgatctcagctcactgcaacctcttccttccaggtacaagtaatttctgcctcagcctcccaagtagctgggattacaggtgtctgccaccatgcccagctaatttttgtatttttagtggagtcaaggttccactatattggccaggctagtctcgaactcctgacctcaagtgatccaccctccttggcctaccaaagtgctgggtatcatgttatttttaaaccatagcattgtcacacattccttttttattatatctgctcgattcagtctgacaaagactactattaggtatccacccaatatccattcttttcttattccttgctaaacaaaaacacctatgttattggggctgggagtgtgctcagttaatataaatttttttcagattaacttgcatctagacaagttcttttcttcttactttacaactttaagttcatgggtacatgtgcgggatgtgcaggtttgttacataggtaaattgtgccatggtggtttgctgcatagatcatcccattacccaggtattaagcccagcatccattggctattctcttgatcctctccctcctctcaccctcctaccctctgaaaggccccagtgtgtattgtttccccactcccaatgtgtccatgcgttctgatcatcacttataagtgagaacatgtggtatttggttttctgttcctacattaatttgctaaggatagtggcctccagccctatctatgttcccacaaaagacaggatctcattctttatttatggctgcataattccatggtgtatatgtaccacattttctttaccaaatctgtcattgataggcatttagatgtctttgctattgtgaacagtgctgcaatgaacatacacgtgcatgtgtctttatgacagaatgatttatattcctttgggtatatacccagtaatgggacttctgggttaaatgatatttctgcctctaggtctttaaggaattgccacactgtcttccacaatagttgaactaatttacactttcaccaacagagtaaaagcattcgtttttctccataagcagcatctgttgttttttgacttcttaatcacagccattctgactggtgtgagatggtatctcattgtggttttgatttgggtttctctaaagatcagtgattttttttttcatatgtttgttggccacatgaatgtcttcttttgagaagtgtctgttcatgtattttgcccactttttaatggggttgtatttttcttgtaaatttatttaagttccttataaatgctgtatattagacctttgtcagctggatagattgcaacaattttctgccattctgtaggctgtttactctgttaatattttcttttcctgtgcagaagctctttagtttaattagatcccatttgtcaatttttgcttttttttgcaattgcttttgtcatttttgtcatgaaatctttgcctgtgcctatgtcctgaatggtattgcccagattttcttccaggatttttagagttttggtttttatattgaattctttaatctaccttgagtttatttttgtatatggtgtaaggaaggggtccagtttcagttttctgcatatggctagcccgttgtcccagcaccatttattgaatagggaatgatttccccattgcttgtttttatcaggtttgtcaaagaacagatggttgtgggtatgcagtcttgtttctgggttctctattctttttctctggtctatgtgtttgttcttgtaccagtaacatgctgttttggttactgtattcctgtagcatgtagtttgaagttgggtagcatgatgcctctagctttgttctttttgcttagcatttcttttaactttaaatatttttcaggagttgatcagcatcactctgttttgatgcaaccccttgttaaaatattgggcagaacacagccaaaggaagaatgctgtggcatatcaatgctttggagtaggtttattcaatcaatcttctatctatataatttcactgaactatttaccaagattttccacaacacttagattgctagtagccctgtaattccaaatatattatttccatggtttttatttttcccttttttttgaatctggaaatgtctttcattattgtaaagaataattttcctgctgctaacactgaggcagactgaaacatacatagaagtttaaatcattgcttatgttattctttgaattatatacgttctcactgaacttaagtgtgtgtgtgttctcaaagatgatatttctgaagtgcctacaaatgtgaaccaaacttcactaaaccatgctatgtgacttctgtggccactattaaaaagccacagtcattaatatcagtataaatggtaaatatatatactgatatataactactataaataattgcctccaattattagtcataattgcaatattggtatctacattcacattgtttataatcaatgaaataaaattgcgttcaggatagtgaaattgtgtcataaagggctgtttggttttttggggtttttttgtttttagctgaaagcaggattatattttaactcagtaatcccatttttggaaattagcaatctctccatcctggtacaactctgctcactccagtactcacagtgagatctcggaagctaggatggttctaagatccctgaaggtagaattttaaaattccaaaatgatgaagttgctgctgtacactgctacagttgcttcctaatgtttggctccttaagtaggaaatacagttcaccgctaagccaaagcggttcctaaatagactaattcattcacaataatggaagcttaggttcattacatgaaggattagttacaaaatggcaatgctacactcatcaggtttttctcaagatctataaagaaagcaatgaacaaatgattaactgtaacttataactcttttaatgtgcatattccaagttcataataggaggcattatatgttaatcatatacagtagtttcaatgaaaatcccttaaaactattctcaagggatataatgcagtcaggtaagtttaaacctataaaaggaccactgccattgacttctacaaaatttgagtgtcaaacttactgctatcaaagatatgtaatgccacagaatacaaaagccaacgagagaataactcaatatataacccaataataatgcatgtaagcacgtgagcaatagaggaaaaggaagggaaaaataggctactcgttggaaacatatatagtatctaggttcagataggtctgtttttctcaaactataagatactgagtagtctaagaagaaaaattaccaacaacattgtttcttataaaatatatttaatatatttaaacacacatctataattgttattatgcaagaatccacattgaaataattgcaaaacaagtgattgggtgtatcatgaatgcatgaagtagaattaaatgtcaaagcttcatataaatattaattttaatgtcaatgctaagtatctattagtagtatttaccaactaattttactggtatacactgcctcttaatcatcactgctccatgttatgcaacttgtcatcatttcatccatttttgtcttttttatgtacttaataaaaataaaatgacttaatctatttaatttgtattattgttttggtcctgtaattaagttagaatatgaatgaattttttaatcatttcttgaagcaattaattgttgcagaccatttttttgtattctttaatcaaagtgcatattatatccatgaactatcgtatatgttctaccaatatataattatttaaaaagtattccatggtcaaataaatttgggaaatgtgtatttcaaaaaattttctagtaatttctataattacatggtatatttcagaatggtgatggaataattgaattatagaatttgcaagctaggtggaactcgggtatagtctcctcacttaagggtaaaagtgaagccaggagaaatgagatgactaggactcagttttctggtttctaattctgtgctcttctacctggctctttatatcctgatatcacaaacatttaaaagaaagaaagagagagaaaaggaggaaggaataaaaggagaaaaaaaaaaaaagaaagaaattgtatccaccaagaataaaaatgttgcccagtagtactgttgtggaattgaaagattagatgaaatgtgtttgctactcagccaaagtatttaacgcatcatgaaattccataaataatcagttatacagaagagacattaaggactatgaaatgtaccctagaggtaaactgtagaacctaacaaagaatggataatgggtcctcagcacagattagtgacccagcttaagcaaaagcaaattaaggctgaatttcgagaatagtttaaaaattaattaactctcacacttaggagattgtttgaatgtataaaactcactcatgtgggcttaggcctttattaaacctttattaaaaggttataggactattttatagacgccaaagctaggaaggcaactaagccccttgcgggattagaacccatctagaaagctaccaagaatgaagacaattataattatcagctcttttttcgtggagttcatagattctcatcgtgtgtctctttggatatcagtttcatactcttttttataggaaaattggcccccctatttcaagctccagtaaagagagactggaatcaatgtgccccaaatcaaaattcctcagagacaacctgttcttccatcttgggggtgggtgacagaaagcaatgtagtggcaggaccttctgccccttccacagcaattacgaaagtaggctgtcttgaatgacgtcatcaggggattctctaagagtgtaacaggatgcagagagcaagctttggcaaagacacctgtggcttctttaaaactgagtatctcttggaaagaaggaaacttccagcaacagaacaagtaagaaaacatggaaaatatactgaggcagagagtagaagggagaaatccacacttggctcttgaaggattatagacttgttccaatccttaggttgcagccacagcaagctttgctttaggactcttcggtgagcccagggtaagtacatatgggctaataacaagagcttgcttaccccctttactctctggacgtgcttcacctgatcctggtcacccttttcagaattcctgctcagcaacttactgctaagtctacttcttgccttcctgtggacctaggacattgatattatctgcaataactgccatttaaatagacataatcttggagataatctaaccaatcctgataagctgaaacaatatatgttttcacatgggagaggccttggtttgaatccttaactgatgcttagaagacatctaaccaaaataaatttacttaacctgactcttgatttctcatcaagataatgatttgctcaatgagtttttaacctaaaaatataggataatttaagtaataataataactcaaaacaacaactagatttctggtctatatctcctctcctaaaccctgatcatcatttgtacagcaagtcatgaattttgggtcctttcacttaaaacatgtacctttacattgagtacctacacatgcaaagcattagcctagaaactgcatggaaaacaaaaatttaccaatcacaggatcctgcccaaaaggaaattacaaagttataatggacaatacatagaaggaaggatggaaggaaggacggatgggagggagagagggagggagggagggaagaaggaaggaaagaaggaaggaaaggagagagaagaaagaaagatttgaaaattgtctactgcgcactatgctttgtacacacataatcatactcttcacaagcagtcttttaggtaggtattattgttctcattttatgaataaaagaacagaggctcagaaagattaagtgactctggggaaatatttttaaaatggttcagataatgtgctgcgatgtgattacagtagaaaaaacattacttttaactctgtagttcagggctttgtgaagcagatgaaatctgagccctctatactgggtgggatttaggcattggcagaaacaccagcatgagccagggttctgacagcagaaagaacatagccatgtccaggactaccaaacagttagatcatttcatagtattatacacaaaggggagaagtcttgggaataaggttggggccagatgacggagaacctgaatgcccagctaatgttttgtaaaattactgtgggtagcagagaaccactgaagatgagtgaaaaacatgatgccatcagatctttggccagaggcaatgtctgagaaaaaatttgcatggggagcatatgacaattaccaaggcaggaggtaacagggagtttgatttaggattgtggccacaaaaatggacaaatgatgaaggtgtgaaagaaaatttgcagaggtagaatcaacagatcttgatagtctttaaatatatttttaaattttaactacttttattttgaattattatagttacatgacattagattagacagtcaagagaagaaaaagtcaaagatgtcctggatttgggcaataagacaccctcacggtagctgggagtgaataaggaaccagacccttttctcttctactctatgggctttctgtttaacaggaagctaattttgttactttttatgtgaacaaataatgaagcatattgttttcataaacctttgtaaaatctgctgcattctctgacatgtttgcaaataatgccacattctccagacagtttatgtgcaacatgcttcacattactaacagagaaacatcactaaaataatattctataacaaaattttgaaggtcattccttaaaatatgatttttaaaatggaaatacattgttgagaaatgttaataatttgagacttacacattagacacacatatatttttactcactaccaatctggattttattattcatcttcaagacatttggaacagtggctgtcaactccagcggcacattagaatcacctgcagagctttaaagaacgccattgcctgagtcctaacctgagttctggtataaatgacctaggagcagcttgggaattgtgtgtgtgtgtgtgtgtgtgtgtgtgtgtgtgtgtgtgtgtgtgtatgtgtgtgtgttttggggagggggcggttaagctcgctagatgattttaatgcgaaaccatggttgagaaacacccagcaataagaaaatttattgattatgttagagataattcactagtttatcttaccatcaaaaagactatttgctacatttatataaattagacacataagatcccaaactagtcttgccctaatattaaatatgataaaagttatatcaagaaggagagcttggtgggctcagtggtcagaatagagggaataaatgaacaacaagatgtgaagcaggctgacttctgaaacactttgcttattcttttcgcttgattcagcagcaacttctggactattacagcagtgaaagctctcctttgctcctccctagtcactctgcaaacactcatttgctggctggctgaccctatcatgtacatcccaagttcctccactcatcctcccagcggcagcggtgacctccaggtgcaaaggccaagataaggcttttggtcacattggaactcatagaaactgggaggggagagctagctgtctggctctgtttctccatgtttgcaggaatgctgaatgatctgctcattcccagatctcttctctttcctgtcatacaatgagtaaggtgctgattagctagctccatggcttaaggcactgtcaacagaaatcccatattaaatgtgcctgttgcctaggcagagtgaagcatttctttctattgctcatcatcgataaagagaaaactgctacgctttctgtagcaggcaggactgtgagggaattggacaaggtagcagccatggggaatatttagagtgcacagcagtaagatgatctctagcttttctgcattgctcactgctattccattaaaaagatttttttccagcctggctctggtcttcattcattttattacttttccatggagtcctcctcaatgttccaagtagaattctatctatttctcaaagcttagttaaaatactgttttacttatctgaccataccaacttaaataatctttctctcctctctcagctttggaattagatatttttgcacttgtcattcttcttcactatacttaagcatcccaagacagaattttgcctttgtccaatgtatatacaacatggcaccaattgccatccagtgcacataacaggtattcaacaaatctgataaatgaattaactaatatagatcactctaaatctcatcaaataattcatgaacaactggaattatttcagtattgaaataactagtaagtttggacatgagagaggtgaaaggctcaagagcctcccctggaatggatatctaaagaggtatttaattatttgacataaataatggacttgtatctgaaacaaatatgaatattctcacctaactttatcttatgggattgcagttgtttttttccaactctttaatagtagcatatgttcttttctgaaacactatttaaataagcttgatttatgcaagtcccagaagtcactccttgtaattgtaccactgaaatcactataattcttggtttaaagaagttaatatattttctgccagagtgacaagagggtcatcacttatctctgagccctccatgtggcacactcaagaatgacttctccatctccaaggactgacaagctgtatgtttatttatgagaccttaatccaaactatccttgtttcctgattgctgggggagctatgaggaagagattttaattaccaaagtcctcaacagttctaagttacttaagagtcatcttaacattgctttcattgcaacccatggggttttagcctatttaaaattgctttgcttttacttcacaaaccttgtttgacccaaatcaaccttgtttcagttgataagtttcacaaaatttgaagaagtatttggaaacttttttcatttccacacatcctttgaggttttcctaccctacaaagtacctagcagagagcctttcagatatccagtactcaggatacttggagaaataacaaatgaatgagggaatggtctttacattttgccagtagaagtaattgagatctgaatttgagatatgttggtatttagtttcaaaaatggaaacatgatggaatttttggctgaaaaacttcctttgaaatctatctaaacatcttataaataagatatgcccttgcctttgttcataggtatcttgtgatacatatgtccaaatctttcaactaggttataaattactgaggagtctgggtgtggtggcgcacgcctgtaatctcagcactttgggaagctgaggcaggcgggtcacctgagctcagtagttcaagcccaccctgtgcaacacggtgaaaccccgtctccactaaaatacaaaaaattagccaggtgtggtggcgtgcgcctatagtcccagctgctcaggaggctgagacatgagaatcgcttgagcctgagaggcggaggttgcagtgagccaagctcgcgccactgcactccagcctgggcaacaaagtgagactccatctcaaaaacaaaacaaacaaacaaaaattacagaggaattatgtttattgctcagcacagaacctagcacctggtagtagatgttctataaatgtgcatggttgatctatttctacatcgtgcaatatttcaccttcagacttgtgtctccaccatcatatagtctccttccagatagaacctgctggattggaatttagtgtccaagatcagaccaagctatttacgcaaacataatatcaagaccagctcattggaaaattgcaaaacagcaaagaatgtcctcattgacccttttcctcacaattttcttcttctccatcaggtaatcattgatcccttcttgctttcataaaggatctgatctactcaatacaaaggtgtattaagaaacaaaagcaaatgtacataaatgggaatgcatcgaactaaaagcttacatctgcaccacaagaaaataaccaacagtatgaagaaacagcctatacaataacaaaaaatatttgcatccgatatgaatattcgcacctgatatgaagttaatattcaaaatacagaactcaatagcaagaaaataaataactcattttttaaaaaggtaaaggatcggaatagacatttcttaaaagacatacaaatggccaacagatatatgaaaaagtggtcaacatcactaatcataggaaaatgcaaatcaaaaccacaatatcacctcatacctgttgaatggctattatgaagaagaaaaaaagataataaatattggggaggatatggagaagagggaacccttgtaccctgttggtgggagtgtaaattaatacaagcaccattcaaatgagccaccattttagcaagtcactactgcagcaaaactaacagctgtaaagtctatcggaggactatgagcagccctataggaaaaaaaagaaagctacactggtacttccccattgatcacaggcaaagcgtgaactctctgttgaattgattttgcttagaagaaatacaagaaaggtttcccagaacacctttgaaagttggtgccttataaatggaaacaaagaaatcacttaaaagaaaacttgtttgtttcaacagacaggtcgttaggctgcttcttgctgtgtagatcacaatggtgaccaagtgctggcggtgaatgggccacgctgcattcattatttaccaacaagattaaaggaatagtgactatgacattattatttcaaactctaattttctaggattaacagggaaggtcagcattaaaaacactttattttcttacattcacttttcttttaatcatgaccagtcaagataatgtgaatgagatatctatttctgtgtaatgaattatccccaaatgtagcatcttaaagcaacaaatatctcttacctcacacagtttctaaggatcaagaattcaggagagcttagggtctctcaagagattgcagtcaagccgccagctgaggctgctgctactgcaagtctcaactggagctagagaagcacttctcgagtcactcacatggttgttgacttgtctcagttccttgctgactgttggctggaggcctccatattttaccatgtggccttcttccataggctgcttgagtgtctttgtgagttgacagctagctgcctccagagtgagtgattggagaaagagaaactgtaaccaagacagaagccacagtttttataacctaacctccaaagtggcacatcataactcctcctgaattttcttggccacagagatcaaccctgatacaatttgaaaggagatgacccaaaaatctgaataccagaaagtgcagatcactggaggccatcttggaagctggttaccacagaatatttctttagatgccaattctctatgatgtatctaaagaatctgatgttccaaggatagtttattacccccaccaagcagtagttcctaacttttttgggggtggggcaggggagtaacataggttccttttaagtctctaatgaaagctctgaatatacttcccaagagaatgtacagttgaccctctatattagtaggttcttcatccacaatttaaccaactggggattaaaaatattccacaaaagtaacaatacaaccacaaaaataataataaaaatcattgtttataacaactatttacatagaatttacatattattagttattagcagtattctagagataaagtgtatggaagaatataggttaaatattaacactataccattttatgtaaggaacttaagcatccactgggttttgtatctgcagtcttggtatttggctctggaatcaatcccctacagattccaagggatgactgtacaaatgagtcattataattttgtacataatttccaagagtccaaggagtccctaaagattttctaataacttcaggttcagaaacactgtcgttaatagttaaccttcatcttgcaatccctaagcacaaggacatagctgccattgggaacttatagtaggacatacatttagataatgaaagatagacttatttaatgaaaaaggcatagttggcatttttatttaaccagaaattcaaagagttttgaatagaacatggccattttctaagccagacttgcaaaaaattcctgtatgggaaactcaaatgcttatttatatgttgccgtctttgaaagataaagaattcctggggtgctgattttttcagggcaaagtaaagggagatggaggaattctgctatggagaactcctatgaacaaaaatgtagtgtttcaccataagtgtttgataatatatgagagatatctatgtttaagaaactgtggtcaataaaattgagcctaatttgatatttttgtaagacctcttcccattctttctttttcaggttttcattttgaaatccagacgttaaaccactgtcttagtccactttctgttgctataacagaatactataggttgagtaacttacaaagaaaagaagtttatttagcttatggttctggaggctgtgaaggccaagagcatggtatcagcacctgacaaaggcacggcagaaagcatcatacggtgagagcacatgaaatagagagagcttgcttttatgccaaagccactcttgcaatagctaacccactctcatgataacagcattaatctattcatgatggaagaactcttatgacctaattacctcttaaaagttccactctatcagcactgctacattggggattaagtttctaatacaggaattttgggagatacactcaaaccatagcaaacatagacactctgctccagcctactagctacttttactgagttattatctttcttttccactaaaggtaatttttaaccaagttccccaaacatgaccttcctcttccaactggccatttagaatttcagtagatcctatgttctggtatcatttaatgaaagactttggacacagagtgaaagtttatgatactctaggactatgttcccttcctatgcattctcatagcatcctatatgtgtgtacatatatgtatatataattatatatactagtactatatatatacagatatatagtatatgtagatatagtactacatatatgtgtatatatgtagatataattatataacaagtacatattatatatactagtatataatttatatataatcctatatatacatatgttatatatagtatatatactagtatatataatatatacatatatgtaatacatatgtgtatataattatatatattagtgtatatatacatacatatagtatatataattctatatactagtatatatgactagtatatagaattatatatactagtactaggatagtactatacaaattagacaatttgtacaaaatggactatataatattctaaattagtaattattattccatagttctatatggaaggaaatacaaccatgaatcttacagggctgaagtaaaatagtaagagatcatggactgagttgggaagactggctttgatagttcttagctgggcaaactaggctcagtctctggtctgttacctcatcagttaccccatacaaaatggcataatacattatatgaccactttatagaattttggggggtccaatgggacaattaatgtggaaaatatcttgtaaaccatgaaatactagactttttatgtattatcattattattaaatgcactgtttagttgacagagctgctatgcaacaagataaataggtaatttttgtgtttaaaaagtgtctctcagagagaaatctatgctcactggtctgatggtgtcagaaaaaaaaaatactttcgcatggtaaatagccatttctgttctgaaggctaaattctgtgtcctctgtcattataaaaccagttattgatcttgacaagtacagaaagtactttgcagaaaatagatatgacaaggtccctaagtactaggtttgcatctaaacagagatagaagacttggcctcaataataaagctcacccacttccctgaaagtatggcctaaccccgaaggtttggaaatctgtgaatacagaataaaaggtaactaggcaaactcatgagtttgtctctacacatgtcagtaaaaacgtgggtatactcatgcatcacagccccttatcataaatggaaatttggaaatggctcatatagacactttgtgggatgtagtagcattgacaaaaatagaacctatgtttctagccttaaaacaataaaaagtaactaatcttttacacaagagtcaactttcagcaagccacaagctgaattatgggataacacactgattatttgataagtgtgctgtttttattccctctaatcaagtacaaagatcttgttcaaattcccatctcaatgtgataagtgtactcagcaaataattaaacatagagtaaacaaaaaacttcataaatctcttttagaagcaactttacattttgttcccaaaatgatctgcctgcctcagtcttccaaagtgctgggattacaggtgtgagccaccacacttggctaccatttgaattttcataaggattgtattgaatctttgggtagtatggacattttaacagtattaagtcttcccatccataaacacaaaacgtctttcaatttatttgcatcttctttaatttctttcattaacgttgtatagttttcagtctttcaccttcttggttatgtttattcctaaatattatattttttgatgttattgtagataaatttttttcttaatttccttttcagatagttcattgttagtgtacagatacaaaagtgagtttaacatgttgatttcatattctgcaagtttactgaatttgcttgtttcaacagatttttgtagaaagagggttttctacatataagatcatgtaatctgccaagagaaatagttttacttctttctttctgatttggatgcctttgcttctttttcttgcctaattcctttgattaggacttccattactgtgttgaacaaaaatggcaaaaatggatgtccttgccttgattaagaccttatagaaaaagctttcagcttttcatcactgagtattcagttagctgtagacttgtcaaaaatatggcctctattatatgtaggtaaattctttctatacctaatgtattttagagtttttgtcatgaaaaggtgttgaattttttcaaaaacttttattaagatgcatctattaagatgatcatgttatttttaatcctaccattaatgtgatgtagtacattaattgatttgagcatgctgaaccatctttgcattccagggataaatctcacttgatcatagtatatcatccttttagtatttttagtacgctgttgaattcagttttctagtgttttgttgaggagttttgcatctatatttatcagaaatatttatcagtaattttctttctttgagtgtctttttctggctttagaatcaaggtaacattggccttaaaatgaatttggaagtgttccctcttcttcattttttgggaagagtttaagaaggattggtgttaattcttctttaaatgtttggtagaatttaccaatgagggggccaggtgtggtggctcatgcctgtaatcccagtactttgggaggctgaagcgggcagatcacgaggtcaggagatcgagaccatcctgcctaacatggtgaaaccccatctctactaaaaatacaaaaaattagcctggcgtggtggcaggcgcctgtagtcccagctactctggagactgaggcaggagaatagtgtgaacccaggaggcagagcttgcagtgagccgagattgcaccactgcactccagcctgggtgacagagcaagactctgtctcaaaaaaaaaaaaaaaaagaaaaaatttttaccaatgaggccacctgattctgggttttctttgttgggaggttttttattactgatttcaatctcatttgttattggtctattaaggttttctatttcttcctgattcaatctttggaggttgtgtgtttctaggaatttatttcttctgggttatccaatttgttggtgtataattatttatagtagtcccttatgatccatttgatttctgtagcatcaattgtaccatctctttcatttgtgattttatttatttgagttttctctcttttttcttagtcttgacaataatttcttggatatgacatcaaaagcacaaacaacaaaagtgaaactagacaagtgggactacatcaaactaaaatgcaaccaggaagcgaaggaaacaacacagtgaaaaggcaacccatggaataggagaaagtatttgcaaaccatacatctgataagagtttggtatccaaaatatatttggaacccaaacaactcagtatcaagaaaacacataaccctattaaaatattgacaaaggatttgaatagacatttctcaaaagaagacatgcaaatggctaacatgtagataaaaaatgttcaacatcactaatcatcagggaaatgcaaatcaaaaccacaatatcacctcacatctattagaatagctgttatcaaaaagacaaaagaaaagaagtgttagtaaggatgtaaaggaaagagaacacttgtacactgttggtggaaatgtaaattaggacagtcattatggaaaactgtatgaagcttcctcaaaaaattaaaaatagaactaccatatgatctggaatttctacttcggggcatatatccaaaggaaataaaatctgtatgttgaagagatatttgcattccatgttctttgaagcattattcgcaatagccaagatatagtatcaaactacatgttcattgataggtgaatggataaagaaaatgtagtggttgtgtgtatactattcagcctttaaaaagaagttaatcctgccatatgcaacaacacgtttgaacctagaggacattatgctaagtgaaataagctagttacagggaaaaaaacatggcatgattccacttgataagaaattaaaatagttaaactcagagaaacagagtaaaacagtggttgccagggtctgaggagggggaaatgagggattgctgttagataagtatgaagtttcagttatgtaagacgaataagtcctagagattgtcaatacaatattgtgcctgtactttacaatactgtattgtctacttaaattattttaagattgtagatctcaatttaaatgttcttaccataataaaaaaacaagcaaaagcattacagcaggtcaaaaataacactaagatttgtttcaataataaattctggtaaaatgtatttggcattttaataagtgaaacagtgctttttttcaaaaagacttactgcttcccatggcatcatgagatcatatcaggagatattctggggttgcatttatatgtatcacatggtaagctcaataccaggatttggtaagttaattgaaaagaatgaaaaaattctattaacttctttttttttttgagacagagtctcagtctcttgcccaggctggagtgcagtggcaccatcttggctcactgagaactctgtctcccaggttcaagcaattctcctgcctcagcctcctgagtagctgggattacaggtgtctgccaccacacctggctaattttgtatttttagtagagacggggttgcaccatcttggccaggctggtctggaactcctgaccttatgatccatccgcctcagccccccaaagtgctgggattacaggcataagccactgcacccggccctattaacttcttattgaagaataatatgtatacaaaaattgcacgtaagtgtaaacatcaatacatttttataaagagtacaccacataagcagcaccctgatcaaaaagcagcatattatcagcacccagaagtcccctatgtgccctcttctaggcagtagctctcctactccataagggtaacaactatcctgatttctaaaaccaaaacaatacttttgcctgtttttgcactttgtttaaatggaatcatatagtatgcattcttttgtgcctggcaaccttatgttgagagattaattaatcttttaaaatgtagttgcaactacatgctatccattcattctcacagctgattagtattagagttgtattcttaggttcttgtgaatatattacaatttattagttggttctttctttgatgggcattgggtactttccagcttttgtctgttaatactggtgttaccatgaaacactcttgtatagtcttttatgaaaagttgcatgcaattctgtttgagatacatctaggactagaattactgggtcataggttatgcatttgttcagctttagtagatactgccaaagagtttttcaagccaattaccaatacacactatcacaggaagtgattgagggttctggttgctccacattcttgccaacactaggcattgtctatctttttttattgtagcaatttttgtggtgtgtacttgtattgaattatgggtttggttttcctcaatgattagattgagcccctttttatatgcttattgactatttggatttcttctttggtgaagggcttcttgtttaagtcttttgctcattttcctaatgggatgtgtgtctcattcttattgatttgtactagttctttatatattctgcattcaagtctggagtttttgtattcttcaatcattcatatgagatgatatggctccattacatgaatgtattaacaacaaaatttaagtatttgaaattcacttgacagatatttatcaagcatctactatatatgctagacactgtgtgctaggctttgtggaaatgacttataaaccttgacttaataaataaataaattatacgatgctagtttataactgcagaggttcaggtagaataaattttcatgtttcctctatctcaacacccaagctcatataatttcagaggccttcgacttctaaaggtctaaaaaacagtccaagaattaaggtgtgttcttgaacctattacaatagttcacatagcttttcattaaatgaatcaaattaatggaaagccttgttattagaggctgtgctttggcttgctgccctagtattctggatgtttcacagtctcttaacaaggacatacataatgaaagaatgaggaacttgtgtgctcaagctgctcaatttaggtaccagggttgcagggccaaagccagaagtggaaatgtgtctaacaatccaagaatcaagggtacagtcctcagagttactagggtaagaggccaggaagaactttctgtctggaacctgggctagccacaggataaaaccacagtaattgttgctactaccactttctgggggccctgctgccttctaagcccaggtagctcgggcctcgctactgtttgtttatcgtgtttgaatatcctttattagtctgtgcccaagctcactcagtgcccatttttcactagtcctaaaggaggagaatgtatatctggttattaaatccaagtaactcatgtctttttttgactggaatccaagattgaaaacacatttgagagcttcccctagagtgagctttcctccagaagtcccagttacttgcttatattaaactttactcataaattcttcagttacatgtatattcctagataataaaaacaatactagactatattcatttcttcatataaagccatagtctattgtataaaacataatcacttctggattatcactagtataatacaaaatcagttaaaatatttaaaactttttttcattataaaagtttcattctggaacacttgaaaaataaaagtatagagaagtataaaacaaaatcacccataatcttacctgccctagtttctgttaatattttggcacaatttctaccattttttctatgtatgcttttaagatgtcatttattccaatgtttatgctgtttttcaaattaaatttatttcattagcatttttttcatattaaaaaagctcttagtaaacctaactcatgatgcttatataatataccatgaaagagagttgtcataattcatttaactgtgcccctacctttggaacttagaattttttgaacttctttcactacaataaatactgttgaagcaaagacttttgtgcagcaaaagatattttttaattatggattgctttcctgaatatattaatagaattaaaatatagtatagaaacatttttaaagacaccatattcacaaagtactttccagcaaagtgtttttcaattttgtaagaatgtttgttttgcttcaccttcatgagcattgggtatatatctttttgaatatgtttaaatcattgttggtagatgaaaatactaattgcttttacctatttttacttctgttggtttttagcaaagcagaatattttaaattacctattggccacatgaattttcttattttacttatacattcattcattcaaatatttattgaacatctactaagtaccatgcagtgttctaggtacaagaaaattatcagtgaacagagcagagaaattccctgtacctatgaagctagagagggaagacagtctacaaacaaactactgtgaaatgtgtcaggtggtaagttctacaaagagaaaataaagcaggtgaagatttagagaatgaggagggtgctatttcagacaggcattaaggaagacctctccctaatgaaatatcacttaaggagaaatatttgtaaatattctgttcatttcctcaaccaattcatttaaaggaatctgttctcttaaattgtgatccaaaaaagatagccaacattaacagtatttggatctaacgaaaactaacttcttaaacttcctagatttcatggtctttcttctcagatagtgcaatgatttcaactaatggtggtacgaacctacatcactgctcccaactcagttagcttttcccaataaataataatgtgatattatttaaatacaaacagaaaatgaaccattcttttcttttcttttttcttttttcttttcctttccctttctttcccttccttccttccttccttccttccttccttccctctctttctcaccctcttcgtctctttctttctttcctctagcattgagggtatgcttgtgatagaatatcctatatcctatttcccatggaaaaaaatggtgctaattgatagtactaaattcataaggttattgtgaggattgcatgagttaattgcatgcttagcttggtacctaatacatattaagtacagtcatgtgtcacttaataattaaaatatgttctaagatatccatcataagtgattacgttgttgtgtcaacatcacagagtatacctacacaaacctagatggtatagcctaacacacacacacctagactatattgtatagcctgtttctcctaggctataaacctgtatgccatgttactgtactgaatactgcaggcaagcataacacaatggtaagtatttgtgtatctaaacatataaaaaataggaaagatacagtaaaaatgtggtaaaagataaaaatatacctgtagaaaacacctaccgtgaatggaggctacaagattggaagttgctctgggtgagtcaatgagtgagtggtgagtatgcctgggacattgctgtctactaatgtagactttataaacactgtactcttaagctatgctaaatttatttattttttatttatttttttgagacaaagtctcgccctgtcgcccaggctggagtgcagtggcgcaatctcggctcactgcaagctccgcctcctgggttcacgccattctcctgcctcagccttcagagcagctgggaccacaggcccccgccaccactcctggctaatttttttaaatatatatttttagtagagacggggtttcaccgtgctagccagaatggtctggatctcctgacctcgtgatccgcccgcctcggcctcccaaagtgctgggattacaggcgtgagccaccgcgccaggccaagctgtgctaaatttattttttacattttctttcttcaataataaccttagtttattgtaacatgtttattttataaacgttttaatttctttaagctttttgactttttgtaataatgctcagcttaaaacaccaacatattttacaactgtagaagaatattttctttctttatatccttattctgtaagttttttctagctttttaaaattaactttttaaacttttttgttaaaaactaagacagaaacccatacattagcctaggcctacacaggataaggatcatcaacatcactgtcttctacctccacatcttgtcccactggaaggtctttaggggcaataacacacatggagctgtcatcttctatgatagcaatgccttcttctggaacacctcctcaagaaactcattcctgaagttgttttatggttaacttttttttttgtaagtaggagtacacactaaaacaatgattaaaaagtatagtatagtaaatacataaatcagggacgtaatctattatattaagtacttaacagtaacacttattatcagtaattcttgtcatcaagtattatgtactgtacataactgtatgtactatccttttatatcaccggccatgcagtgagtttgtttgcacctgcatcaccataaacatatgagtaatatgttatgctacaactttatgatggctgtgatatcagtagagctgacaataggaatttttcagctctattataatcttatgaaactaccatggtaggccatccatcactgaccaaaatgttacatggtgaatgactgtactaaataaatatttcaatattttaattattaacataatcatcaccatataatattcagctgagcaaagctgcccaaatttgattctcaccttcctcttgcattgacttcttagaaatcaaggaatgagatgtcaggagaatttgttcatgatgttggctgccatttaaaattatagctgcatataaatcctgtctacttccaaatttctttgtgtgaatgagcgtcatttgaaaagttaaaagatttacagttgatccttaaacaacatgggcttgaactgcacaggccaacttacatgcagattttcttctgcctctgccacccctgagacagcaagatcaacctgacctcttctttctcctcctcagcctactcaacatgaagatgaagaggatgaaggcctttatgatgatccatttccacttaatgaatggtaaatatctattttcactttcttatgattttcttaataacattttcttttctctagcttactttattgtaagaatacggtatataatacaaaaacataaaaattatgtgttaattgactttggtgaacagtaggctattagtagttaacttttgggagaagtcaaacattacacacagattttcagctgcacaggggttggtaccactaactcccgtgattttcatgggtcaattctatattgaatttagtcttttccctattttgtagtcctctgaaaagccatgcaaacttgctgggaatccagaattaatcaaatatagagctctgtggattgcaggaacttttaactatctcacacaaaaacactaacaaaattttttttaaaagagaaaaaaaaataactggaccagagtgtgaaaaacacatatcatttattattcaagtatttattcagttgctttctttattagtccttcctttctaatctatcaaatctcattggtttgtctcacagaaaatccctttgatatgaaatgtaaatttccaaatctgctgtttcctcagtactttgactatcatggttctatggactcttacttttaagaatatacaacagaagtaaccagaaatacttcttctctcaccttttccctagtattcctgtcttcctctccacatctcttactttttgtcctaaatgtggaaattgacaaatgaaaatttaaagtcactaccttataaaagactgatttgaagtttttccatgtcatttttttaattctaggaaaacatcttaaatttataagtcaataaaaacacttcaaaacagagaccaggtaacattagccatcaaaattcatcatgatgtgctgggcacaaaagattttcttaatgaattatcgattaagatgtcagataaattaattgacatagaattttctaaaagaaagtagaaggagaaggaaatagttaagtaccccagatgctaaaggaaatcaatagacactgagagaagggccgcaataactctcatggctcctttccactttctagtgttccataaacctggtattttgttgtctctacctcatactatttaattgttcttctgaaaaagtagactgcataagttgacttcagatccattttggcttttgagttccaaatgggaatttacattaataatacaatctgcaatattacattacattaactttatcacccatgtcccccttcttcctcaccatccagaattaataaagaaactaataatctggccactgagagtttagactatataaaaggaagtctattttaccacttactttcagatgttgttgagtatgaaacaacatactcaagcaaaacaacatttcacttgaaaacggtcttcctactcttcaactgccccacctaatggcaagaggtatgaataacagtgatattctggatcccctagttgaagaaacccaacagtaatttttcagatctgtgcaaacttgtagccctatgattgaaacatgcatattttcccctcaccttcacagtactgcactacactcatttacagtgcctgaattcatgccacttgcaagctttttaatatgtttctaataataacattttgtcgttacagatgaattgtggtaaagtttactgagataacaaaggcttcgcacattctcattctatttagcattagagaggatcacagaaatcattcacttaccactatccctattttacaaaggagaaaactgagatgcaatgaggtaaaattatttttctagaaatcacatacatctttagtggcagaaccctggtcttcaagaaagatgcttattcatcagactgctgcgtccaccaccaaaagcatcaacctaccaccattttctgataactaaattcttccaatctttactcttaacaagaggaaagtgatattatgccctttaataagctcgagggaaaacagtgggggtgggggcctctttaaaagttagaacttgaattagaaaacacaaattagaatatatacccaacaaaattaagtacattattgtaaaagagacgttagcaaaatagatttatccagcatgccccatatatggaagattagcatagtgggtaaaattgttaatgctttccagagcccagggtttggtatccataactgaaattaaccatgtttcttggcaatgttgtccctattcttccatgtcaactaagagttggcctctttaagtctccgcagctgagacaaattacattgtatctctaaggacctatttaaaaccttttgttgggttttgtttgctttgagccatttgctttgttgttacatcatttgagttgtttggaggttttgtgtatttcttttattcttggtagtaatatttgatctacaaaatccaaacttacctcccaattctaaaaggcagcattagtcagtgtggccttcagaccatctacatcagaatgacctggggagcttgtttaactgtggcaattcctggagcccttcccagagatactgaatcaaaaatctcttgggataaacttcaagaacatgtattttaagcaatcattcctgattatgttaatgcatattaaattatgagactcgctgccaggaagaaaaaaaaaagatgctacccaaccacaaatggcaaaggaagaaattaattttcccttatcccagaaagcccaacacttggcaccccttctacctggtaccacagacttagtttgtagaactccttaaattaatgagaggtttcattagcagaatttaaaatggttcattcctagtccctgtcctgagaacaaattacacagaaccacaaacagatggttttcagttatctgttttttaaacaatctaagttaattgaaaagcacaatgtgatattatcaaataacagctgtaccaaaaccctaccaaactaaaactcaaggtcattttgagggaaagaaaaagaggtatatgggcttatgcatctctttttaattgaaagcctgggctaactcctgagctagctatgttgtttcataaactgcgttggtcagtcactacaacacataagcgtgtttcctctttccctttcccattgttattctctctccactttttccatttctatccctattttcttgcctatttattactctatattttcatctcttgagaaagttattgagtccatttctacatatttttttcactgggtaggtttagctacacaccatttagctaaacacaagtttagctcacttcctctgagcaacttggtttccagagcagctgtttccagcagtctttcctctttataataggaaatgtggttttacatttacccaaatgcagaggcacatgtgtgtctgatcctacagacagcaaaggtagtctgacaaataactggctgattccaaattatacaatatatgttctcttccgatgattatcatacttgtgctcatcacttcagggatgcacaaggctcagttgtagcactgctctggaaactagttaaccatattgagacttctttatggggtgtgcccttaactagcactgccaagtctgtaaacttatttcctccaacctttcattcaaggaggcactatttctcaccattcccaacctcccctaccacgccaagccttgagttaaacaagaaaggggcaagatttggaaagaaaatattggctttgaatacaaatgaaaagaagaagcctggcccactagccccaggacatccccattgactttctggaaatctgtacacaccacaaatgagatgatgatattggagaggagagcattctagcagaaaccatctggtaaatgctgatctatctgtctaggaatgaatgtatcatttaaatatgttaacctcaaaatgccacagagctgtctttaataccacttagcctcttaatagctatttattcttcattttgttctattaaccctctcttttataacactttgtttttaaggaaaataatttaataaaaataaattcttctcaaactctcaatatgatgacaaatcaagcaatagattgggatattaatgataaaattattactaaattatcaataataattctaaatatcaggtaaagaggaaaaccaaggacacagagtaaagaaatcctttatttacaactaacgggaaaactattcaaaggcactggtcaacaaataaacctggattaaaaatagaaattttccagaagtctaagtggaatactccttatgttgcaaaaacccaaaacctagtgaaatctgaaagttaattattttccttttctccttccattctatttaagcaatcaaaaactcatacttctagaaaaaaagatggattttttcaataaatggtgcagaaacaagaggataccagtttagaaaaatatatgcggctgaatatctgtgtcactacttataagcaaatatgttgattactgagtaaacatactaaatgttaaaaaatgaaaacttgctcacagaatgatatagccaacatggaactggcagtcaaggaaaatgtgatggaaattttggctctattaattattctgggattcctaaatcattgcaggaggacatgagctggttttgttttgtttcttaattgacattctgtcaattaagtatgcatttatcaaatacaaaatgatgttttgaagtattctacattgtggaatagttaaatctagctaattaacatatgcatcaacttacatagttatcgctttgtgggagagcatttaatacccgctttcctagcatttctcaataatacaatatattgccattaactgtagtcaccatgctcagaaataaatctcttgaatttattcctcctatctaaaattttgtatcctttgaccatttgtccaagccccctcccccaacctgtctagcctctctaccatttacttctttatttctatgagatcaatgattttagattctatatgagtgtggtcatacagtgtttctctttttgtgcctggcttatttaacctaacatgaggttctccaggttcatccatgttgttgcatggatgattgaggtgattccatatcttggctatcataaaaatagtgctgcaataaacatggactgccctttcaccattgtgtgttcttggcacttttgacaaaactcagttggctacaaatgtgtgaatttatttccaggctctgtattctgttccattggtctatctgtttgtttgtttttatgctgatatcacgctgcttaggctaatttagctttgtagagtattttgaagtcaggtagtgtgatgcctccagctttgtgctttctgctcaataatactttggctattcaggttttttataattctaatattaattttaaaatttctttacttctatgcaggatgtcattaatattttggtagggattgcactgaaactgtagatcatttggggtattatggaaattttaacagtattgattatttgaatccatgaacatgaaatatctttctatttatttgtgtgttcaattttatatctgtataacattattatatataaatatgtttttatattatagataattatatataatataataacatttaacctttgatctatgtgtgtacttacaggtgaagtgggtcccttgagggcagaatatgattgggtcttttttttaaatctatttttctgtcttttgattgcagaatttaatccatttacattcagggcttatttatgggtaagaacttactactgctattttgttcactgttttctagttgttttgtagagtctttgtttatttctctcttactgcccttctttgtggttaagtgattttctctagtagtgtattctgattccttgcattttgtgttgtgtgtaccaataatagggtcttcctttgtagttaccatgaggcttataaaaaacactttataaaatttatttatttatttatttgagactgagtcttgctctgtcgcccaggctggagtgcagtggcacgatctcagctccctgcaagctccaccttctgggttcacgccattctcctgcctcagccttctgagtagctgggactacaggcgcccgccaccacgcctgtctaattttttgtattcttagtagagacgaggtttccataattttaacaagttatttttccattgtagttatcatgaggcttataaaagacacttttacttttaacaggttattttaagctgataacaacttaacatggattgcaaaataaaaattaaaaaactctaaacttttacctcattctcccaaacacattttgaattttggtgtcacaatttacatcttattatactgcatgtcctgtaacaaattattgtagttattatttttactaatttagtcttttaacctttcttctaaagatataagtgatttaaacaccaccattacaatattagagtattctaaatttgactatgtacttttaccaatgagttttatatttatagatgttttgtgttactagcattaacacatgtttttgtattattagcattcttttattccagcttgaagaactccattaagcattttttttaacacaggtctggcaatgataaacttcttcagcttttgattttctgggaaagtatttatttctaaaagatggcttttctgtgtatagcattcttggctggcattttttttttccttcagcacttttaatatatcaccaagtccctcctgatctgtaaggtttctgctgagaagtttgctgatagacatattaaaatgcccttatgtgttgtatgcttattttctcttgttgctttcaggaccctctctttgtctttgatttttgagaattttatcgtaatatgtattgaatagtcttattttaactgaatctgattggaaatctttgaccttcctgacctgaatacttatttctttctccagatttggaaagttttctgattttatttcttcaaacaaactttctactcctttgtttttttcttcttcttgacaccaatgactcaaacatttgttttttgatgctgtcacataaatctcatatgctttcttccttcctttcattctttcctctccttgaactgtgtattttctttttttttttttttttttttgagacggagtctcgctgtcgcccaggctggagtgcagtggagcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctgaactgtgtattttcaaataaccctgtgtttaagtttacagattctttttctgcttgatcaagtctgctgttgatgctatttcattttcattttgttcattgtatattttagctctaggatttctgtttaattttaaaaattgttatttcaatttttctgtttctcattgtgggtcacttaatgttctccttttttaaaagaaattgtttatctgtcttttctcaacattcactgagctttctcaaacagttattttgaattctctgtcaggaagttcatgcatctccatctctttaaggtcaatcactggtgctttattctgtccatttggtgtcatcatgtttccctgattatatctgatgtttgaggacatgtatcaatatctgcacatctaaagaagtaaatacttattccagtctttacagaatggatttgtctaggaatggtcttcaacaataaatctatccagagattctgggcagacctactggcatgatccccctgtccaagactactgtggccattgcagcattaaggggtactcttagcctgggattgctacctgtgcaatcaggtacaaagccctgagatatagatattttctactttaggttgcaaaccactctggctataacaagatttattaatattgataagtaaagtgtggacatagtgaaagaacagctaaaacccaaaagagctaatcaagacttatcaaagttaaaagtaacatcttttgaagaagaatgttttcctggataggggttcagagcagattttccacttggcatagtaatttcaggaggaagacttttaatgcctcagtttttccaattccataatccctgttttctaattcctcactggaaataagttattggctattttctaactaaccattccactgtaggctcccctctccctcacaagacattatgaatctctccatgctgccccttcttctgtgaaccctcttctgagtaggtaggccgcatagccacatatatgtatatagttgtcccttggtatccgtgggagattggtttcacaacttccagtgaataccacggatgctcatgtccctgatacaaaatggcatagtatttgcatgtaacctacgcacatcctcttgtgtactttaaaccacctcaagattacttacattatctaatacaatgtaaatactatgtaaatagttacactgtatttttttaggaaataatgacaaggaaagtctctacatgcttactacagatgattaaaaaagtattttagatttgcaattgactgaaaccacagatgcagaaatcatgaatatgagggctgattgtgtatgtctaggtatgtgttagtacatatttattcatatggctgtacctcatgcaacataatgattgaaaataagaaaaaagaacaaaagaatgcagttgtttctcagtataccactagagctcttgttgttgtacttgttattactacttttttcattttgtttattgtattttttaactctaggattttgccttcttttcctcttctataagataacctaccagaatacggataagacagcttgccatggagaattattaatctccaagaactatttcaaatagctatccctgaagcatctaggacatttgaaaggaagtttgtttgtcaaggttaggggaaaagagaaaaaccataagaatgttcaaaaacatgggcaaaattatccataatcttgcagtagaaaagcctcactaagcaaaacacaaaaataaggaaacattaaagaaaaagatcaactacattttttacaacacaaaagatgtacctccactgtttattattgtttaaactttcatatatttatatactgtttaggagttttcaaaatatcttaaatgaatttgctcagatttttttcaactgaaatatttaattcatcctaatctaacctcttccctcacaaagagcacaacaatttttttgctggagttggtttctaaatctatctatgagatagaattcattcctactgtagaatggacaaagagaaaagctgaataaaggcaagagatgaagaaataacgcactatttctaaccccatttttaattcatttattaatccacaatcaattaataataatataaagttttcattaagtccccattagttaagacgtattcatgttgagtgagatataagcatgcaagcattccaagtctaaataaactattttggaatcccacttttccctctgttccctttattactgcagagacagagtcttaaaaaattgagagaatgcaataacaataattttttaaatccattaatttccattcttcttgattttagcataattttatatcattttactttttgtggacctgcaaattatatttagtttgcattatcgacatgaaaagcctaagaaactcaatttcacaacagttcccagaaaatggctcagtttttactctgtactctgcatttttctttcttttttgatgccatttttacctcataaattatactgaccatgacctttttagagtctaatttggattaagtattataattattttaatttcagaagaaagaaaatttacatagcattaaggaatagccaacctagaatattatgccaccatatggcatatggatggataaaatggtactgtgttagacactttaacgtgctttgtctcacttagttttcataacaatcctatgatgtagtcattatcacctatattacttgggatgagtcaaataaggctcagcttggtaaagtaatggctagcaactgataggctagcctttcactatagatctacataattccaaggatacagagtaaaagggaacaaactaaaaaagaaggaaaagagtgaacagatctcaggtaaggatttgaaaatcttccatttaaatgcctctccattacctgataaaagtgttttcttgtctacagataataataataataacacagcctaatgtacaaggttgttatgagttgcaaataaggtaatgttttttaagaggactttgtaaactgaaaagcatcatacaaatgttttatatagtattatcataatgaggcctctgtacacaaaataaagagcacttgattagagcattaaagtgatccagaaaaatcatgaagagaaacacgataatgacatagatgatatgtaatgacataatagatgaaacaacagaagagaacatcttattaaattacaataaactcttcagacaattctgagaatacatatatctctgactctttaatttctagtattgataatggaaatgatgaaacttccaatagtttacttttaaagaggagaaaaagctgggaaagcttaagtgaaaatggtaaaccataaaatctgtcagatgaaaagcataataatctaaccattgaaatattttcaagtttgggatcaaaatatgtatctggcagcacagggttatgattgttgaaataaagaaactatcttctagatacttcaaaatcaccttactttcagaagttaaaatatagtggaatttttatcaaataatactccatgtaccaaagatggaatgactacattgtcatttgttgatgtgcacatcagccagatagctagttaagcaaaaatagtatacacaaatcgaactttgtggctcctttgtaaatgcaaggcaataaaccatatgagagaatttcaattgtttttggagacagagagaaataaaacatatttctaggtagatacagttgattcctaaaattatactgttctgaatatgtacggggagagatactctttacagaaagggaccattgatgaaggctgttgtgcgttttcagaattcatcttagttctactgaagtgcaaagtagagacaaattgaaaattggtcatagaaacaatgaaagctcaatttaaacaaagtataaaacttagagaaatgcatggatctgaggtagaaggaagggttaacacatccaaggagagacagaataaaagctcttactattctgaaactcacataggctttataaatattttttccagaaaggattaaaacctatcccactgtggatttaaatccagtgaaatctgaatgaccatcctctaatcagaaatgaagtatttgggaagacatgttcaaaaggtcataaggcctgtatggccacttatcttggagaaattgctatttgcataggtgtcttcttacaagctatttaaagttataaaaaagaaactgaataatgtattccatactcatatccagacaagaggtctaaagttcactcttgagccaaatatttccatatactaactttaaggttttaaaatgattcgacttttcaattttattattaaaacctacataaaattttgagactttttcctcatattctcttatttcaaatatgtatgttttaggtattttagacgtaagtattggctcctttgtgtactttagtttgtttatccaaaaaataggaataataatcgtatcatagaaaagttacataaaatattagtgtcatagaatagttttgagaactaaatgagtgaatatatatatattatattatatatataatataatatatatatatacacacacatgttggcatttggtgaggtcctcaataaattttgatcacagaatattgcatcaaccaaattactttataagttaatttgaaatagcataaccttatgccaagtacttcaatacacacacacacacacacacacacacacacacacaaatatgcaaaatatttgaacgtattcagacttctgtgggcaatacaataaacaaaaccatctccccacataacaatgggacatttagagcccttcccagtatttctgggaaatacctccaaagggacaggtgcttcaccaaccctaattatttgtcacagcttcctctgcacagttgttccaattccacagcaatcattgctttcactctgcccctgctacctttcttccctgttttgtctctaggaggaacacagcccttctcttcccagcttgaggcaaaattgttacaatgctgttgtgattacagaaagtttaaagaaagggttgaggggagaaaagaaacagacaaatctttaaaactggttactagaactcattcattctaaagaggctttaaccaggccatctttgctacagggacaattggtagtccctcttcctaagccctgtctgctgccatgtggctctatccctgcagaactttcttatatctattcacttaccagagtcctccaaagtactgccgctccccaaacttcatctcttgagcagtcaggggacaagtttaaaaatcctaatactttattatgcaaaagagtttaccttccttgtgatttaacaaaggctaatagggatccccaacaagcctccattcataattaaaatgtcttcctaaacaaaaaatccactttctgtcatagagtgcaaaagtatctagagtttacaatataacattgttatccaactgtgaggatagctataaatatagataattgactataaatatgttacagtttctctccagtaggcacatggtgtaacaggtacattagtacataagtgatgcctacagttacatttgtgtggctccaaggtttagtgtccaaagtaaggaatttggaatcagaagaactgaagtatatctaggattcaccattactagttgtgcatcttggctaactcacctaatctgtctaaggctcataaaatgaggataaatataactgcctttcctacctgtaagtttttataaaggaaaaaaacaagaaaatgttgtaatagtatatggaaacttaaaagcattttgcaattctaaattattattgttattcttattagtcacattaacacatatattagactttaattccattcgaatctggtataataaataatctaacatttcatctaatcagtctttgctataattattcctcacaaataatgaattatgaatgatggctgtaacagaaattacacacacacacacacacaatcagatccaccttaatatgaatttagtatttaaaggctatcttaaactgtaatcaaaagaagttgtgaaaagacatagattcaaaacacttagtacactattaataggaaaaaatagagttgccacagaaacagctaatggagcaacagtcagcagcttccatatataattttactacttatcactactgtggtatattttaatgagaaccatcttggggagaaaaaataaggtgatccccagggcattggtggaaagggaagtcaagctgagatgaggactcagaaatatgtgcccacaaatacatgcagtaacacttgttgcttgtttagatgttgggagggatgatgagtctggagctgaggaaggttcccagggctctgccttaggcaactggatagctgaggcagtaaatataatagaaaatatttaggatatgtagcagtatgtttaaagatgaggaagaataatggatgcatctagtttgggaaatgttgtgtagatgttatgaatgtccagcaagcacttggttagagttctgtgactaaaagtagaaatgggaactaaatatggaaattgagagataatcaaatagaagatagttaagacatgaaaggagatatcttatgatctttcaggtgtcttcataccttaaaatattacatgggccaatgactgaatcttggggaacagcattgtttaaggaacatgcagtctcagaaggaaatagcaataactactagaaagaaaaatataaatactagaattgtcaaaagagatatacatggacgggagtgacagaaaggactggatggtctagttcataaactaaggtaaaaaggagaaatagaagagagattagctaaattgcaattgagcctatagagggaggaggcaattgactaaccctctgaggcaatagaggtgttggtcttgaatagaagaaacagctttaccctctcagatttgaaaaaggaaagacaaaataaaatgaggatataggtgcatattactttggggacatcagacagaataggaacctaaaaagttcagtcagaaaaatttaaattcctgttttaactgtattattattgggcatagaattctgggttactgggttttgtttttctttcaatactttaaagatgtcattcctttttcttcttgctcacaacatttctgaggagaaatttgctgtaattcttatccttacttctctttaggtaatttatcattccctccctctggttgcctttaaggttttctctatgttgttgatttttagcaatttcaatataacatgactctgcacgtgtgtgtttattttggtatatatcttgcttgatatacttggagattttgagtctgtgatttggtgtccatcatcaattttggaaattttttcagcgatttttttcttcaaacatttcttctgcctctttttctctttcctctccttctgtcatttcaattatggatatgtcatgccacttaatattgtaccagagttcttggatgctctgttatgttctttctttctcccttttatttccactcttttttctgtttgggtaatttctactgacttattttcaagtccagtgattatttccttagctgtctcacgtctactaacaagcccaaagacattttttaatctctttgactatgtttttaatttctagcatttccatttgatttttcttagtttccatatctcctctgaaattacctatctgatctcacatgtggtcaaccttttcctttagaacctttaaaatattaatcatagttactttaaattccttgtgtgataatttttatatgtgtcccatatatcacatgtttatgtgtattatctcttcggagtgctttctcttgccttttcatatggtcataatattttgctgaaagccggatatcttgtgtaggacagtagatactgagatagatacttttggattcttaaagaggaatagattgtgaaatggcttgccagttgttattttcttaatatttgctccccctttagctttgggtcttcccttaatgctgggccctaaagagaatgtgtctcttgaatttcttccatattcaaccatattcccatattatttttactcaacacttgttaggctgttggtagcaggccagggaggaagggcattccttgatgttctgattaagactcagtcttaggtaggtaatgtgtacctctgtatcagcaatgtggccttcacaagtgctcctgcaactttctccaattgttgtgcaaatcctagcatatattccataccccacccctggggatagagcattacttttttctcttcccctcaccacgatcattcttcctactgccaccatcaccaatgggtttcctccagttccctaagacaatgatttttgctattctctttgccaattaactcttttgttccactgggaaatggttgtgggtttgaaggtggctgctgttctccccagtctttcctgtgagtgcctggtggggtttgtggaggaaaagcctgctataggatgcactccctatatctgccacctccagtgtgtcacattttcatgctagcccatactcagccttagcaattcattaaaatgtttagctgaatcatcttgctggtttacatgacatctggtggtgtctacccaaggaaaaacaaatgatgccatcctctttcttcttgcaggtgcctgtctctttccagatttggagttgtttggttgccctacgacctaaatttgctggtgcttttttttaaattaatgaataggtagtttgtatagatttttccttatggtaagaatgagaacgacactctgaagctctctgcatctctgagcttaaatcagaagctagagagtttactctggaatttcttaatttaccaaaataaagaacttgagattatttactgtgagttatagaaatgataagggtttggtgaggatgatgattgtttggattcattgatttttccatgtctttaaatatttttattagaatgggggtactcttggctgataactgatcccagtattttctaaagtcttaaatgaaaacatctgggagtgtgagacacgaaatgttattttaaaagaaaaggtgttattccagctttgaggaaagattgctcttttagtttgacaaaagactggttaaggtctgtgtctggaacatagatgttccagtctaaatgcctttgcataacgctgtaaaaggagttttttgttgtgggcagagttgtatctttgtaaattattatgtttacttgaacttggaataaggcgtttctcctggctttcctggagtaaagggcctggaaaccatgtaggatataagaagaaagacatttcactgtgggaagataagcaaagcaacagggggtaggtcagtaactaagcagaaaggactgggtttgtcctgtaatgccagaaatgattatttttttatattcagtcctatagttttctttctacactatgattttttcccattatgtccaggactcagtaaagttcggttgcatgttaccgcctggaactggttataattcaggaaagtgaggaagaaacaacactgtccacatttggcacaacaattcagaggtctctgttaatggaaaaacagacaggcttggtgggacaacaggtgaaatgcaggggtcaaaatggtagttttcagaagagagctggtcgctggtcaaagctgctgtcattggaatacaaagcaaaaggattcagatttcttcaaagcacaaccattcaaaatattacagctcttatcagcaacatatatgggtaaattaagaaaattaatgtttaaagcagcaaaaaatttaaataattaattctctgaggtcccagtaaaatgaggttattttcaattccatcaattcttagaggcaatgaatgtccgacaaacagaggcagtgattttgcatacttggcagagattctttgaactcaatttattaatcaggatcctgtttatactttgggtggaaaggatagtcatttgttaggttaagaagaacctattctttgactgcaaagttcataatgtgaaaaattattattgagcctgttctaagaagtacacaatcttgaaaatacattgtcatagctttggagttgaaagaaatcttttcgtttatttaatctactcctctcatgttacacatgagtgatatagacaccggtgaggtcattcacccaaagtcatgtaacggtaagaatttgtaaagctaagccacaagataatttaatgaatgacgtgtattactgtaatgaaagtatacaactttagttttaaatgagcagatgccaattaacatatatgttcatcttcctcatgaatgtctacatatgcacaaattatatacacatttataaatataatagtgagaagttaaagattataaactaaaatgtttaaatgttttataattcagagtatgatactaacaatacaaatttaaagaaccataaatatttcatcagattgttaaaagatcttgaaataagaccattttataatttcctcaaaaaatactgtcccagtgctagaaaaccctgtcagaaagttttaacttacgtctattctgagtcacttttaccaacatctaattgcattttatggtggttgttttcaattctcccttcctgcattaggacattttcagcattgtttcaggaaatcaaaacatgtaaatgctttccaaatagacaacaatactacccactcaaggatatggtcttctttgactacttgccaattatttcatttatgttgggtgaggaatgcatgttctgaatccctgcatgagcacttgcaaagaaaaaaaaacaattggaaacttttactttttcagcccttatatgcagacatactggagatctctcatcttttcctccaatcccttgtttattttgagactactgtttctgagcaatgtctaggtctcttggtatgttcaaatagaaccctgctggcaaatcaatgctatataatgacctcttctagaaaaataaaagttggacatttaataatatttttaaggacatacaataagcagagatgatgacatttaaagcttgttgtttcttgttttaaattaatttatagaaaggattgtttaggttgtggtactgtggtgttatcatttgttttcagtaattttaatacatttatctaaaagccaatatgatttcataagcaagatcctctgaaaatcttaaagcccaacctggaagtgaattggtggtgtgttaactctctgaactgctggggtaccatttggtatacagttccgtgggatgtaactgtcatagtttggtcaaatagttggtgagggcttaacaaatatcgtagattgtattaaattcaggatgttgagggctgcaagtacagtcaaatccttctcacggaagcaatattgccaaaacagaagtccagactacctgagtaggaagaatggcagtgggaggggaatattaccataaaagagttataagctaaatgtcttattctcagttcttatgctataagtagggcggtatccctacccccatgtgtgtggcgtatgacatatcctgggtaataggaagaacaagaaagcagggtcagggtctctctaactatataccaacgaaccattcttggccttgctgtcatggcttttaatttgcacaagttagggaaacttgtgaactgacaagagtgacatttttcaacaataaaagtaaagttgttatctgcttattgatggactaattccatttaggaaagctttaagacttaaaggttttggcgcagaagtattgaacacaattgattattgtatagcatttttaaaatgatttctgcttgatgatttggtttggattttttgtttgctttattttttaatgtgatttcaatgctgtttttctcattttacccttgaaaaaaattatgcaagctattggaagcatttgataataaaactaattacttatggttctcttactcccacttcttctaccaagacatagatgcacagatgcaaagccagaactataactcagggacaattccagttctgcccttgaaagtgctgaccatgggaaacaatgtaaacacactaataattttaattgaagtcaattttttagttttcaaaacatttgccatttcaatagtgaaaaaaagctaaacaaaattttaaaagaaaattaccttcagttaaaaataagcagccattataaacatttttctagagcaaatactactgatagaaaactccaccagttatgcttttcttcaaaatttcactttgttatagagagattttgtctgtaagaataattttttaatattcattaacaatgcaacaagatttctctccatttttttgtatctgtggtgtttacactggtaagtacaatatatgcaattatttcttggacgtaatcatttgtaattcaacttcaacttgaaattgtccaaaaatgaaatagcaaacacatcacagtacagaaaaaagtggaactttttccaagatgacaatttaatgattggctttggccactaaaacagtcatgtgacatgtgattgatttaaagcaaatggttgctgatcagtcgctgttctttcagacctttcctgtcattctcacatttatttatactcttggctattcttatactattgttgattatctgagaaaaattctttttatctactctgaaataatctatgtttctgcaacaatgagcataattgtcaattatagcacattattcacagctcaaaatatccctactaaacagggtgcccacaacgtgatgaagtgcaaatacagagagacttcagagagatacagaacttcagccttcctaaaaagaattaaagattaaaatgggatacagttaggtgatcagggttagggagacagggtggtgaaataattttaacaaattgtaaaaattataaatttagttatcagatatgctctatgagggtagagagaacatgtatcttacattggatactcagagcctaacacacagtagccattcagtaaatatttgtagaactttgtaaagaaggagaacaagctggaaggcaggtataaggaccaaaggagtgaaatctctaaaactacaacttctcatatcaatttgttgtgaataaagacacaagcaggaacttggttttgttttgtattttgtgcttttcaaaggattttacctacagcatctcccgtgaccttcttggaccctgctgagtgaataccagtgaaaaaaatcagtttatacatccttaactttattaggattctaagctgcaacagctttgtcaatctcgtagcttaggtggggttgaatatagtagagaattgaagcccatctaggaaggaatttgttatttttactttaaccatacaaataaaaaatactctatcttacagggtaattgtgaggaaaaatgaatgcagatagctctgaagtgccataacaaaatgtaccatcttttctaaatttattttttggctgcccactccaggaagacactaaaaaatgcagataaaatggcataaataactcaccctgggtcattaggtgagtgactgcttctaaaaactcagcaatgtaaaggtacagatggaaaaaaatatatattttcttaagaataaaatcactttagtttaccaagtttgtacaattttttaaagtcttccatgaaaataagcaatattctagggagcctactgggaaaaatttcaccagatgggctcctagcccccagactcaaaactgacagcctatttaggtgggctttaaattcattatgaaagaatgtgccagataccctatgtcttccaaacaccaaggagttgcttccagttttgaatgaacactgaacaacaattctatcaaaaaagaacaaggaacatcaaagacatctggtgagtgacaaatttatccaaaagtagaacatccataagaatcctaagtcaaataaagggcaatttcatcaagaaaattaacaaatccaattaagtagatgacatcttgaatatcttcaaactggtaggaagaaaatgattcagtgtactagaaaattgggaatttaatgcaaaagactacaagaaagtttagaatttaatacacaagaaaatttattaatgaataagaattaaaatttatctagtttattctccagatgagaagatttataaaacttcatgagtttggagaataacagggatattataaagaaaagaaaatgctaaaatttttactttaactcctgattttaaaatatataattacaacaaaaatttttatatcctgttctcttgtctgtacctttccttccctcccctgattagctaaaagccagtaagaaagcaggcattagcagagggaagaagggtaactgagatagtcagttctgaaatatataaacatctgaaaagttaaatagtaaatccattgataggacaagatacttcagagacctgtcattggattagatgttaagaaagaacaatataaaataagcaaactaagaatagtgaagaaaggggaaaatcattttcagtaaaattaaaattagcttctaggtctatgaagtgattattagacttcaaaaatcattggtaagaatgtccctaacataaaatttagaaaataagaaatgaagagaaagatgttgaccagatcattttcagtgttaccaaattgggaaaacatacagattccattatactagtcactaccctttgggcttaaacaagacagtgacttattaaatcaatcatcccttaagaatatcaaattcacctgagaccagcctgaccaacatggtgaaaccctgtctctactaataagacaaaattagccaggtgtgatggcgcatgcctctaatcccagctactcaggaggctgagacaggagaatggcttgaacttgggaggcagaggttgcagtgagctgagatcccggcattgcactccagcgccgtggctcatgcctgtaatcccagcactttgggaagccgaggcgggcggatcacgaggtcgggagattgagaccatcctggctaacatggtgaaaccctgtctctactaaaaatgccaaaaaaattagccgagcgtggtggcgggcacgtgtagtccctgctactcgggaggctgaggcaggagaatggcgtgaaccagggaggcggagcttgcagtgagccgagatcgcgccactgcgctccagcctaggcaacagagcaagactccgtctcagaaaaaaaaaaaaaaaagaatatcaaactctcttatggaccaaatgtttgtgtccccctgaaatacatttgttgaagccctaacccccaatgtgatggtttttggaggtggggtctttgggaggtaattagtgttagatgaattcatgaaggtggggccctaatgatgggattagtgaccttaaaagaagcagcagcagagatcttgctttctctctctgccatgtgaggacccagggaaaaagtagctttcggcaagccatcagcaaaccaggacgagagagcttaccaggaacaaaattggttggcattttgatcttgaacttcccagcctgcagaattgtgataaaatacttttctgtttaagccacctagtctatggtatattgtagcccaagctgattaatatactctgtttgccctgatgccttgattttatatttatttgggaactggtctttgattcaacttacgaatgagcacaacatggtatagaatcatagaaattcataactggtaggaaacagaacactcacatagtttaaccacccatcttatgcctgaattgtttgagttgaagagtgactaaatggtcttccaagacacactggaacccctctcatgagaggaactcactaagtaaggtgatcgtttaaggatgatcttttttctacctcttttgtatgccttaaattttcacaatgaaagatgcaagacctacaagagaggcatgtagggaggaacagagactgttttaaatttcgaacattttctttggatttccaaatgtcagaatgccaaagataaacatcctcagattctaaagagaactaattctttaaactttcttcatcaaaaccaggaaaaatctacctctaagtatacaattttggattatattatggcaaaaacgtaagcgttggagggttatatgctcagaccagagcaaaataaaattttatagccctaaagtgacaacttctaactaggcaataagtctggctctttttttctgataaacattaacttctgcttagagtcatttaattaagtggaagcattttctttatgccagtggattctcaagaagctaggaagcagtgaaatgagagttctactgtttacattttgacaaatgtaggcaactcaggttctcttaatctggaaagcttgagcctttccaccaagataaaattttttgcattaaacaaatacaaataggaagtctcctagcatcattaagtagtctcagttccttaaagtcaccgctcagttaatcatttgcttttacaatgttttcctccaagaatagggaaatgtttaatgacatttgtaattattcaaaatatcctcccttttgcctttacacatttttttttcagatctcatgtctctgaaattcaataacagaaaacattatatgaatagtttgctttcatatttaatttataataagaaaactcagtaagagaaagatgtgtttgcagtttggtagtttgtatgcaggtcacctcctattacagtgagtgactttgtatgatgataaaaggaattccaggctcaaatccatggccccttcttttatgcaataatccatacaaccaaacaccaaccagtaaaacacataaatttgaacaattcctcagagtttgttgaatttacttggttggttattaaacacggtattcagtcaaaggattggcatatctctcagcatatcctcattttttaacaaacacagttgggcatactatactttatctgcacatactcatgcctcacccttaaaagctggatggtaactccatagaaagaatgaaagatggccttgggccaccacaatagaatcactggttataacacaaagtgttcccatactagagaaatgtgtttgcatttgtggtttttctgatgccttcaaattaatgttcctacgtcacaagtacatctgtttggatgccttatcccccttgggtaaatgaacaaagggatgtgttcttagcgcttgcttgatggaaattaatagtctgctttcatcctttccttgtgtggctttctttgagttgctctatttgcttttttccatacactaatataaatttaaaaagtatcatgactgtggtaccttaagaacactacataattggaaataaggtttaaccttcagtagagccctgaggatgttcaatttaaaatgtttttaaaaaaagattaaaagaagaaattagagatatatgccagggtagaaagctcatagaagggaagaactttcagaatgtgactggttgaagtaactaataacataagtataatttatgcttttagacttgcccagaaggtttcatattcaagacataaattccctatattttgacttttaatcatatattttctgcatgcactcaaaaattagagtgttcaacatcaggcttgtagacgtatatgaatgaatggtaagatataaactagctgaaagaattctcatcaaatgctaacaggtcacacagacaaactagtctttgtttgttaataagctgtgtacagtcagagaactgaaagttgactaaacgtttcccacaagcctaatcatgatagcatagcattaaaatccaaaaccaaaactaaaatgttatatgtacatgtgtttagaaaatagatgaaaacaaaagttacttacacttttgctccgagaaagcaaatcacaggtatttcttttcatcgtggtgttttaagtaattaaaatgggaactagtgtttccagtgtcaatgatctcactgcacgtatccactcaaaagccaactggaatgctgaaaagaaaaggaaggaaatgtttaatcaagttatgattaacacttgcactttgaaatgctgtcttagactgggacagttaattcttaaataattcatcggaacaggctaaaacggtgctgtgtttaaagcaataaaaaagtatacataagcaacatttccaaaacagcttttgttaaatgtaagttagagatttcaagcaccatctgttttccattaaatattcaactctacagttttagtggctgaaaaaaaaaaaaaacagatatgatagccataacctaaagttacatgtataaaatgaagatgcaaactgaattgtgtatatgttgattcttgttgggacagctaaggattcgacaatttttcactaagggatcactaaggtgatccactgctggaggaatcttacttacatgtgaagaaaagagccctctgagcaactgcatcattgcgtcttgtttcactgacaataatcaatagtaccttgaagccaatccaatgactcttcagtaaatttagtgagttatctacccctttagttcttagtggttgtaaggaatacttgagaagatgagaacaaaaagtataagcaataactgttaagtaagcagtaactgttatttcaaggaatattccagagtaattgccacttgaatgacattgacatcctcattacctaactaatctttgctttctcctagacactacagtggagattctccattttgagttttgaagaaagaacaaatcgaatagctatatgtgctgtgttcatttatgatattctgctacatcaggacacaacctacatatttataagatatatttgcatgtgggctgatattttctttctgggaaagaacttactgtaagggaaagaggataaaaggcttggtcaaaccacaaaaactctgatattgcaggtttaggctaatagtgtaggtgtaggctgatgctaacagcagcatgtagttctatcatttgggtttgttgtaagcttctcaaaaaacatgtgtctgagacttaaggaaaagagtaacagtgattaaggtctgaaggagctggttttgctaaaatgattgacaatattaaagtacaaagtagtatgaattatacatttaaaagataaaaaacaaagtaactatgtatcattttttaaaaaaacatacaaaatgaaagcagagaagcctgcaaggaacacagcctttttaaaggctgaaaatacttgtttggaatatatgtgagtcaccctctcaagtcttctcaaaataaaaggaagacactttgcgggaggtaagaggtcccgtaacagcaaagtagaggtagaaacagagaagtaaggttcactgtggctaagaatatctctggatgcaacttggggactcaaagggaaacaagggacaaagccttcttccaaggttgatagaaatgcttgcctgaagattaaagaaaaatgcacaatcaaatgtgagttgctaagataaatactgtttctctgagtgtgtatggattttttctaaaggagtaggatttgaagggaggagctgatccacaatggaaagttctcagctagtacacctccaggaattgaatcacctttacaaattagcatcctataggtcccagaaaatgcagaattatgttactcatgtaatttaggaattggacagaaattaatacaaactgaatgaaatattccatatctagggagaaaaaactttagataacagccgtaggaaacatatattatcagagaaaaacttattcaaaatatttaattattcatccaggatttaatgagtagccttagggacaaccatggaatagttgccctactgggctagtgactcaatggtaacaaatcagtcaaatcagacaaataatggatttgacctgataagctttgctgaattaaccaggtttttaaaaaatttgccttgaaatcatttaaagaccatcattaagagatactttcctatgggaatttagaacttagagaaatttcaataggcagagagattcagttgaaaactgactgctgatggaatggctcttctcaccctgtatagctaggaggcacctagcgtcagtaaaagggtatagactttggaaccaaataggtataggttggaatttcagctctccactggcattctatgtagcttttaggtacattatttgatttatctgaactttttccagatctacaaaagaaagataataatacacatatgtgttttcaaaatgaatgaggtaaaaagtattgtctaggagaatgtttggctcataggaggtatttgggtctcaccatcatcatatctttatcatcatccatcatcactaccttctttttctcttagtatcaaatggcaagtaaaaacagcccattcttgttttttcttctataagtgctaacctctctcaaataatacatatgtaggcagatctactttccactaaccagtatgaataatctaccagttgaaggtccaagaataaacagacagcatacttttattaggatcatttacagcaggttcaacaaagagactctttaaggagatgttggtagggtagaggaatccacaaaggatggcacagtacctggaactagcaacagcgaagttttcaccctaggagggatgggttgcccatacctaggaaaaagcatcacacagagtgggctgccttgaaaagggaagttgctctctgggacacagctagaccctaaaaagaagaagacaaccagttgcacgcagtctcattttcctttctccatctgtctcctcctaggactccccactaaccaaatgcaagcaagcaggagggcaaaggaggaagaagtacatctgactggtcagccttccagggttcaaagccccccaaggtagggcagggaggagagtggagatggaggggaaatggtagatgtgctctgcagtctatgaagaggattgcatgttctgctacctcatttatccttaaaaaaatctctataatgtatcattaaactttccaatactcctgtgaggtagacattgttaatatgttttcccatggcacaaacgaggaaatcagcagcaacgaatgaagtaaattgcccaggaatggcagaaccagtattcacacctgatttgtctgcctcaaaatccacgtttttgtctactcttccatagtgctttgctgccaatagcatgaaccagtgcattttaattatgaacaagtggtaacctctgcaaaaatcaaagctgtgcctaaactaaagaatgtttgatgaaaaggttgactctcaggaaggcagttatcttagttcctgcaagtttctctctcagcaaagataatgtggtgagactgcagaaaagctttctccctccaggtgcactaaaaagaaagccaggcgagagaacactcacacgtgcaatttcgttacgataggagtttccacataaagttaattagaaagaaggaagagtcagctcctgcagggagaacactttagaaataaaaatgaatagaggaggtggataagacagatagtgctggaatattcagagatggaattagatggaccacctatatacattttgctgtgtcaatgcaaagggaattaagacagtttctatcctagagattaaagatttatatagcagaaaatgtcttgaactggtcatcagatgaaataagttctactttcattgctacgtcatatacacaaactgtatggtattaggaaaatcccttcccttttttcccctcatatctccacaacccacctcacagcgttgttatggggattaatcagataatatctcagaaaaatttccggggactttaagttccctgcaaatataaatctatgtattgaaacagcaaatgtccccatacataatgacatccttaaatatgagtgaaaagggattccaatcatccacaaaatattagagaagctactgaacaggacatgttttatatatgtaagaagaattctttaatctcctctttttgaactaatacttttttcttctacatagtaagtcagttcatacagtaactgctgaattataaagccactcagatgcattggttttaaaaagtttattgagcaccttatatgtgccaggcacagtactaagctctcagataaacaacaaactttcttgatgcaaagggaaagaattgtttgggtacagttgcctctgagtgatcaaggtgtaatggattagctctgtctctaacttactgttgtctccaactcatcaaaagatatatttttctagggttgcataaatgaaaccaaacttggcagtttattcccttgattagattctcatctaaatgaagaatgaatacatgtggcatgtataaaaagagaagcttgatcacaatcaaagacaactccaaaggaatataataaaaacaggcttaatttatcaaggtttactcaccaaagtatctgcaggaaggaaattaggaggaggcaacacaagaattaaatactcaaaaagttaaaagaaaagaaacatacaaggatggaataacagatttttcatgggaatggttgaattattgccttgggctcttaaatgtccactaatttgccctctacacacgtaagatagataatgtgaacatctgcttcagttggccctctgctacattggtagcagaaacaagggaagaaagttctggatatctcctcataccttctaaaattgtgaattaaaagaaaggacttcttattccagatctaaagatgacaatagagatttcctgctatttacattttctctcttttctctagagtgctgtttatctgaagctatgctttatctgagctcctgctagaggctatagaatctgagatttagaaagaacgtagagtacaaatagggtaattgaagtatagggaacataagtagtctgcctaaggtcatagaactgcctgggacaacacaataatgagaggaccctgtattccatggccattgctgtggctagctgataatattgccctgtgcatgcattttcctaaaactagttttatctgtcaacccatcttgtagtcttcccagcacagtttaacatcttgaaacttgccaaagtcagtgcaatctacctgtaaccacaaggatggctttatataatcaggttgtagcttatgctcagtaggaactccagagtgatgtgtttcaactagaagagtcaagtgatctgtgatttgcatgcttaatttggccttacctcacactgtatctcccaacaccagccctctaccctccaggctggtctcatctctgccgcacctgagacacatccatttctacctcttggccttagattcatgccctttaatttttgttctcttcattttacagaactcttcctattcaaagtccaacaaaagcccttctttctaataacaacttcccctactgcgccaagtcacatagatttctactgactctgaggtccaataacaaaaagtatgttgtaccacaaactcatctactagctaacatttttttttcaataattgttttatgggtttaatctttgcttcttcaactggggcattgatatggtttggctgtgtccctacccaaaatctcgtcttgaattataatccccataatccccacgtgacaagggagaaaccaaatggaggtaatggaatcatggaggctgttttccccatgctgatctcatgatagtgggtgagttctcatgagatctgatggttttataagtatttggtagttcctcctgtgttcattctccttcctgcctccttgtgaagaaggtgtcttgcttccccttcgcctttcaacatgattgtaagtttcctgagacctccccagccatgcagaactgtaagccaattaaacctcttacctttataaattgcccagtcttgagcagttctttatagcagtatgaaaacaaactaataatacagggttgaataaggtacattgtaaagtctcttccatactgcaagttgtatgattaaaaaatataacttctaccaggcacagtggctcgtgcctgtcatcccagcactttgggagaccaaggcaggtggatcacctgaggtcaggagtgtgagaccagcctggccaacatggtgaaactctgtctccattaaaaaaaaatacaaaaattagctgggcatggtggcaggcacctgtaacccagctactcaagaggctgaggcaggagaatcgcttgaactcaggaggcagaggttgcagtgagctgagattgcaccattgcactccaggctgggtggcagagtgagactccatctcaaaaaatatatatatatttaagtttgaaagcaattcattatcattcttttgcctttgccatagtattaatatgtaacatacattgtaccatttacaaaatatgttaaaaattagaggtataaatctacaaaaatgaatgttttaattaataagtagaaattttgcaaaattggaaataaaattatatcaaaatatggggtatattcaatctcactattaataaaatgaaaattaaaatctcaagatttgtcttgcttaaaaattattttacttttaaaaataaaatacttgaaaatggtgtatatataattagatatgcatttcatatattgctgatcaactttccaaatgacataagtctttggataggaatttgataataagtaccaaaagctttaatggtattatacacttttatatcataattcaggaagtaacttgaaatatggaaagtgctttgtatgcagaaacattccagcagtgctacttaaaataatgaaaatctggaaacaatttagatgtcaaatagtaaaggaattgctaaataaaatatgagaaccttcatgatgtactatgtaattaaaatcatatattttgcaagatatttcaattatatgagaaaaagcttgtgttataatattaagtgaaaaaggcaggattaaagttgtatgtgtaatattatcctataaaaagttatgcacagagaaaagactgaaaaagttagcaaaatattagtagttatatttaggtacagtattatgggtagttctgtctcatttctatgtttcttggcttctcaaattttcaacacttagaaaaaatacttaaaagttggattaaaagaaagtatttgagtgaatacaaaagttactcatctcttcttacttcagaggacatacaaaagtgctagttttttgttcgtggaattgttagattgctttctcatttgtttgtttttcagtgctcaagtttgctatttcgtacccaatgttagactttgtttttgggaatctatagactgagaaaagccaagttggaaaacagatggctaaaattaagttctctcttcctgactctactattttcatcctccatttgggtgtcaattaacttacctctttctttcagatctagtaatggtgtctataaaaggaaaatcttcaggttccacttcacctaggaaataaattaggtgttgaggcctccctgcctgtgctagtttccgggaatgcaaaacacatggaacatgagacaaatgcaaataaacaactgaatcagcaagcaagagatttgggttttataggaccaacaggagctcaatctacaaaataggttcatattattataagttagaaaataaatgcaatatgggtggaaaaagctgtcacaggccgggcgcagtggctcacgcctgtaatcccagcactttgggaggccgaggcgggtggatcacgaggtcaggagatcgagaccatcctggctaacaagatgaaaccccgtctctactaaaaatacaaaaaattagccgggcgaggtggcgggcgcctgtagtcccagctactcgggaggctgaggcaggagaatggcgtgaacccccagggggcggagcctgcagtgagccgagattgcgccactgcactccagcctgggcgacagcgagactccgtctcaaaaaaaaaaaaaaaaaaaaaaagaaagaaaaagaaaaaaagaaaagaaaaagctgtcacaattttcaagaaaaatatttttaaaatagtaagttaacaatagggctctttacctaggtttagtttcaaccagctttgtaccctttcaactatttgagcctcttaatgtctctctgaacatcccatcaaaaattatgcctcagcttccttcctcacccagcttactctcccttacctcctttcccgctgtctgagaggatgagtgaggtgtttctcctcctatgaggagtcctgtcttctacctatgcctgtctttcctcctccatctgctctagttctaactggttctctcccctcaagatctaaatactctcttgagtctctcctcttgtaaaaagtaaattatccttataaccctatgttctccctcctcaagatatcattctctttctcttcaaaatcaagctatttgaaaaaaaatgtctgttatctttctttacctccttattcccactgtctacccctcaacccaatgcaagcaagttttactccttccacacttaaactactttctctaaagatcctagacctccatatcacaaaatctaacaaacttttcacaaattatctgactagaactctctgctatcacattgttttgccttctagaaaatccctcttcctctgtcttctgctggttctccaactgactgctcaacttcttgctacttcacggggtcttcttattttgtctacatctaaaatatgagtgataccattgatattatttttatcagcatttcccaaacatgactgcatatcaaaattagctagggaatgccataaaatgcagatggctgactctccaccaatgaatcagaactttgaggacaggtactcaggaatctacttttgaccaataccccagataataatcatgaagggtgaagagcaccaccacttttgattggcacttgggagcctctgttctagattatatttcttgataatccactagttttcattgttttagctgccatgtgtatactttaacccgccacatacatatctcatacactaagaggggtctaccactaccacagtcttccagagttttatctacacaaattcaggcactttctaatgttcttcttgtcaccaatactgcctacttcaagtccaccttaaaatctatcaatagctgcctatcccctacagcataaagtccaaataaatctcctttacatggtaagtaggagtccccctgtctgctgtttgcagtatcatcccttgacctcccacacagcattgtttcactcacttgctatagggaaccacttgtaattctttgcatacgccatacggtttctcacctccctgtcctctgtcttggactttttcccctcttcctttaccccatagccatgctcttcttcctttgtttgggaatgtcttgcttcaagactcaactcaggtgtcatctcctcctggaagagtttcctgattctcccaatatcccagccccattcccactgccagcctgacctaacatccctttttactccctccataatgcctcctgaatgcctcccacagtatatttgtcaaattacatcaaaatgatctgtttaattgtacgtcactgccaaccttgccctggactctaagtcccttgaggttagaaaacatttcatgtttatatatacaattacaacataaaatatgcttagtaaatgtttactgatttctgctgaattgaacagagaattaagagaagaaaagcacattttgtctccagactgaaaagaatcaaatcatttcctttgtagtttatgtccatataaaaccatcattctattcccttctcttcctccaaaatgataacagcaatctattttactaattcattcaccagacatttactggacacttgtggtatgcaatgaactgtgctctagggtccagggatgcagagataaatacgataaaaatctctctccacgtggaactctcattctagtgggggacagagacaaataacacaatacactaagtgctctgacagaatctcagaatagctggtgtgggacccccgaggaggcagtaaatgattcatacacctaatggcttcaaagcctgttccgagttattctgctcttgtgaacacttctctttaagttattcaaatgccatttcatatactgatgtttttccccacgtagagggaaaggaacatgaaagtagacattgacggttcttttcatctcctttgtgcatctagtcagaactttgtccctgtagaaaaggcatctgtagaattccacacctataaagtatgctgtaaatgaccattgaatgaataatatgcaggcggtcacacttacatagagaacacaagccactttttatttcagcacaaatttattacaaaataaatgacatttttggaaatacaagcatatcatttggctccccaaatagcctaattcttcactcccaagggtatggaaatgccagagtacccactctttcaacgctcaccttgaccagtatttcaaaatggcacagttcagtcattgagctataaattaattacttttctcccaggattccatttcctcccacctaaaataatttcagctctctaaaacacaactctccaccctaattaaaagtccagggaccttctcattaatattgcataaatgtagggtctgttgcttgataatactttgctttggtgttagcctcctgcagcagagaagaaagttacaacaaaagcttccttttagcaactttcctagccatacaccctcccactgcctcattatggtgcccttcctgcctgggcagtgggaggtgtctagagcagtttcgtcctgtgaatcataggacagcatggtgcgtagtttgctggcctgaggcccaatatggaatgagcctctgagatgtgtcatcatcagcttgactataacagatccattgagagcctcaggataaaattccctgagtcatcatgaggaaaataaaatgatagcaagatgatccccataaaatctctggtgcaagctgcttactagctacaaagaaaagtggagttcatcaaggcactgagccttttattctttttaatgtttttttgtcccatattaaagtaaaatctgctgtctgaatacttgtaaatttgagaagtattagaaatggcatttcactgagggttgtagaatgtatgtagagactgctgtctacaaatcattaattacaaatcatagtctgtactttgtatcatgagaccaactaggttctaaaacatgaaccattctgcctctctggcaaaaacaagataggcagatagatagatagatagatagatagatagatagatagatagatagatagatagacagttagatagatagatagatagatagatagatagatagatagatagatagattagataggaataggtagctgaaagagagaaggaaaggtgagagtgaggaatagtgagaaattgagaaagacaatccatgttatagatcctgcattatattatgtatagctttctcaatctgagctatagaaccaaaattattatctctgggtaattatgagccagataccttcagaagttcctttttaaaatcaacataccctttggttctttagttgcttttatttagtcaatcagccgtgaattctaatttttattttcccacaaaatctactgtgaatagcctccttaagaaaaatacaagtgaattattttaagacctaataatactcttggtttagattatttgggacacaatgagaatttaaataaaataaaccagagttaaagtaaagatcaaagagacaaaagggaattggtagagcatcatgcagatcttacttgaggtaggtacataaaagttgttctaatgcggcttcagtagaacaacttttatcctagcaccaagtaagtcaggaagtaccctcaagctatcatttctccctaattaacaagtgctacccaaggagtcattgccggcagactgtacaaacagaagaaaagcaaggcataaaatgaagaaactcaatgttaattaaaagaaacataaacaaggaaaataacagagccaagaaaccaaagactatgagtagaaaccaaaacctctcaatcctctgtctcttaggaagcaacagcccgttagcgcccttgcaagggaatgagcccactgtggtggagtcattaacacccacaaattgaaaactgtacatgccccttagtttggagcaaatttctaacgaatgataaagagcagttggcttttttacattaaaaataaaataacagcagaaaaaaaagtgggcaaagaatttggattttttttttttttgcttttcaagagttttactgttttaccaatttattatagacattaaaaataacaagcaacaaaatcaagatctagtacagcataaattataatatttttctgccattagagaatcattttcaatatactctttttctttcatattcagtgtatatgtggtagataaaataaactccttcaatgtagtgccttgttttaattcctttgttcttaaggagatatttttttctcactccattataaaacaagaactctaagatatcccctaaacaaaagtaatttatgtaagagatgttgattcggagagatgaagagacaaaactaatcagtggaatattaggttttggaatcagtcatattccatattccaaagaatttggagtcaaattctgttttggccattttctaattttatggccatgagaaactacttaacccttttgcatgtcaatgtcaggatcaagataaatgtagatactgaaactcacatttcaaggctactactgtgtaaactaaatgatgaacttacatgtcagcgtatataaccactgtacctaactctaagaaggcactccttaaatgtaagctttttattactttgtcccctgatatgtctttaacaccaagagcctcagcgagctctaagaatcaaggtaaattacagttagaattaatccttcgaaatgtaggataggggagctcaaaatttattgtataacctggtggcatagtgagaagccttgaatttggcttatccttctcatcttagagtaagcaagcattgggttttttaggagatctggattttactaaccctgcaaaaatgtttcattaaaaatgcactcttcccaggattgttagtctgctgttacactgccacaaaatgagagaagcctgtactaattctagagacactcaattatagtacaagatttaaccttcagtttctgtgtccaagcctaggcttttccacagccatcagtgaggtcaaatgaacatttcaaaccttatactcagagatttgaaatccttttcattttgatgcttccttcttcaaggactcattcaatgagcctcaaaatgaacccatcacttttccagcaagatgtgaattgtgacaccaactcttaactgctaggacaaagcagataccaagcttcatagcaaattcaaaggctctgaatatagagaaagaacaagtggaggacctgacacacagaagaaaattcacctcagttcaccaagatctcctgattatccaaatagctgttcagagcttggtatctgtaactggagcctgtgctgaatcattgccatttgtgtggcacccatctggcacctggaattagattttgctctctcttcattcaaaatggtgataagggatgaatgagggattgcacaacagcaaaatctcataaatattattgtgctaatagatgaatttcttagtgaaaatggaaaatggcaatttcttttctaaggatcggctacgctttaatcatctcagggcttattagttcaatttttcagaaggacaatgatgcttgagaagctagaattttctctttaaaaatctctttaattcactaaagaagtaatataagcgaaagcatataaatgaaaaagtaaaaccaaatttaatatctgaagtagaagtagctgaatgaaagaaacttagtattaaaatggtctttcagtttctaactcatccaaactctgctaagatgaagatgatgtcacaacatatcataccataccaagatattgttacagattatctcattcataaatattactaaggaaagagaccccatattcccagcaagagttgggtgccaacctagttggcaaaaacagatgtaattcctattctttgcttatggcaagagaacagaattagagtattaaaccagcttcagatacttcaaagtggaggcaggagagacagacaccaaatcatcccaagagcactcaattggaaaatggcacatgaaccaaagtccacttcactcctaacactatgagaacaatcataattttatattataattacaaacgcttatggggcatttgctatgtaccaggaaatgttctaatcacttaaaatatattaactaattcaattcccacaaaattctgtaaaatagttgtcattttaatatccaatttgcagatgaagaaatcaaggtagagaaagctgaaataatcatcacaagattacatggctagtaagtataaatccaggatatgtatgttttctcctgcacccagaagttattttatgttttagggaagacatcagaagtcattgaagaggagaaaaacagttctgatatatagctcaactttcaattatttacatactgacccaaaagaaactattctaatcccgaaatgaattaaagtttgggtgtttttccccacctcattaatgggaacaatggctctacagctagaatctagagctagaaaatttgctataagaaataaaagccacattctttaaccatagctgaatttcagtcagtacatttgactctactgtagatgacagtcaatgcaagtatgccagacttccagtataagatagaaatttcagtccatttatttcactctccttgctcccaaattcacttagaagcaagaaacaatagaaaactcatggagaaatgccatcaatttagggaatttctgtaagacagtacacaagatccatattattcatgagtttacacactctggaatgtgagaagagtttaatagtaagaaacctattaatataactcattaaagtaatagaccaagggaaaagaaaaacacataatcctttctaagaatgtctaaaatgcatgtgaaaacacttaacactgaatcctgatttttaagatttaataaaacgggaccaaaagtcatatctttctcaaatagccaatgtcttgcttagtgatcaaagatggaagacattctcattaaagccgggagcagcagaaaaatacccactaccaccaccctcagttgccaatgtgtttaaagtgctagctaataaatcccataaaggagaatcataaatattgaaaatgatgaggcaagtctatcactataggaagaccacaggattctctacttgaaaaacctcccaaaaagaaagcaaaaaaaaaaaaaaagaaagaaatagagtttttttttttaagttaagtaactgggttgattacaaatcaaggttttcctatataccaacaatttgaaatataattgctacacacacacacacaacttaaaaactaggcatgaagaagctttcttaggttttgtatgcttgtttgtttagaaaggtagagggactatataaagaaatgaactacaaaacttcattgaagtacataaaaggagactttttttaaaaaacatgtttctaaagaggaaagcatgtgcaattccaattacatgcagttccgatctgaattatttacctaattatttatataaagttttgttatcgtcactttcacacatacatgcaagcagagtaaataggatcatgagtcccacattcccatcacacagctacaacaatatcaacatttttccaaacttgctttatttacccccaattgcaattcccccttgtctcccattgcttgtgtattttaagacctcatataaataaatgtaaatatatccagaacatttctgaaagacaatattaacaaaggagtaatttctgtaataattataataattgatactggcaccagactagaagagaatccaatagaactgaacagaaacaccaaagagatacaactatacataagaatttgatatttgacagagttaacattttttatcagcatatggaacacaggataatcaattatactgggacaacttgataatcatttgggaaaataagccttaagacttatattatgccagaataaagtccagatgaattcaaactttaaatatgaaaaaggaagctatggaaatactcaaagaaaatatatgtgaacgttttatttctctaagggtgaggaagatctttctgagcactatatatgccagatgcttttctaagtgcataaactatgaataaaatgatttcattaattttatttatctatttatttgtttttgagacagggtttggctctgtcacccagactggagtgcagtggtgcaatcaaacctgttgcctgggctcaagtgatcctcccacctcagcctccctagtagctgggactacaggtgcaggccaccatactgggctaatttttttaaaaaaattttgtaaagatagagtttcctcatggatcccaggctagtcacaaatttctgggctcaagtaatctgcctgccttggcctcccaaagtactgggattacaggtgtgagtcaccatccccagcctgtgatttaatcaattttaaaacaaaaacttctatatatcaaaaaattttaatatacaatacaacctgggaaaatattacatattacatattttatagttaaagaggtacaacatggagaactcttaaaaatcagtaaggaaaataaatatgtcccagtagagagagagaaaataatcatgaatttacaaaaaaggataaattaaaaattttaaattaatgatatggaaaaatcaaccatgcgagaaaacaaatgaataaaaaataaaataaggagatgcctattttgtctatcagatggtacatgaaaagaaaaaaaaatacagttttgaggcactcatttattgccagagggagtatagtcagcatgctatttctagatatttgatgtatttggcaaatacatcaaaagcctgataaacacacatgccccttgaatcagtatgaaaaaaagacacatggatgtgcaaagatgacagtcaaagccttgttcataataataaaaacaatgtgaataattttttgagacagagtttcactcttgttgcccaggctggagtgcagtggcgcaatcttggctcaccgcaacttctgcctcccaggttcaagtgattcttctgcctagcctgctgagtagctgggattacaggcacccaccactacgctcgactaatttttatatttttagtagagacgggtttcatcatgttggccaggctggtctcgaactcctgatctcaggtgatctacccgcctccacctcccaaagtgcagggattacaggcatgagccaccatgcccggcctagtgaataaattaaatacttaacaatagcagattacctaaattagtatcgctataaaaatgcaatggaatgaggctactacagatgataatgtatatgaatatacaggtgtttattgtaataaatagctgactgaggagcacagattacaaaactgtatgtagagtgtgatcccatttctgtactatgcctcaacatctatggaaaataatctggaaggatatacctcaaaatttgatactatttagtactggaattatgggtggcttttctcctttaatttctgtgcctaatgtaatctaatttttctacagcgaacacgtgggctatttctatcaaatatgtttttaagtacagaaaaagtatatacagtaatagctttaaatgtaattcgtagctaaagatccaaaaaagttgtaggtggaaagaatgatcatgaaattttatagtcagaattgtgttgatgcttctcatatgaaagatggtgcaggtatccatgccttaactggagataggatgtaatatttatgccctagccaccatcctatgcaaggtaggctttgaaattcaagcataattatagaaattcaaacttagaatcatttcagtcagttctgagtactaacaaagttaatgaacacaaaaaatcttgaaagcaaaagattaacatgtttataaaaatgaataatttttaaatttgccaattattgttcctgaagtgagcattagtttacatctttaagatgcaaagtttcattgattgaattaactgtatacaaaagcacttgccagcacatttttctgtaaattaaaagaagaaagcaccacattgtttaagggtaagcaggcaggaaacagccaggtgctgtctcacctctcactatagcctgtggtgtcttttatctgtctgtctgtctatctatctatctagctagctagctatctctctatctctctgtcatctatctaatctatatctctctatctctctgtcatctatctatctatctgtctctatctgtcatctatctatctatctatctattcttcttttcacaagggttgaaacctgtggcttccctaattatctcaagcttagcccagacttgtgccctggaataatcctatttccaatcggaagtaactgaaagagctctatacgaatgggcatttagagaatgaaagcaagcagatatttgttgagtggcagcttcttgccagatgaagtctaattagcttgtatctattatttcacttagttcttcaaaatcaatgggctggatggcatttcccgcattctacatatgatatagcaaatctaagataatcacatgattttcccaaaatgtcagaaataacaagtggtagaggtgagatccaaatccttatctctctagctcaaagcttttgccctttccaataaactgtaaagactcaatttattttgtatcaccttttagtacttgaaggtgggatagcctggaggataaacacacagactttttaacccagaatgcttggattaagatgtctattctaccactaattagatgtgtagctctgcaatgctattccaccttactgggactcagtttactcccccataaggtggggatgatagcagtaccagcctttaaggattgatagagttaaaatgtgtgaaggacctgggacattttctgacatatagtaagcatcaataagtgttagctatctttattattattatctgtggggattattattatttttgtagccacgtgtgccccgttttcagcagctggtccttatcatactcccccaccttccttgtcttccaggtttctgcctgagagctcctttaagcctgcaactctgatccccagctcaaaggctaggtccgctgtcagctgccaggcctacttgagcccagcttcatgacccactgcctggagcaccacaaactggccacactcaggctctgtcttcctgtgatgggccggcccatggggtgccacctgtgagactttgcaggactttgcccagtgacagctggcttagatgtgcaactttgcacttagcactcctctttcagtacattgcactctgcttgcaaactggcaaaacatccttttgtctctaccagtgggacctgcccctacccttggagcagatcttgttttcaaattctgataccacaaaatctaaaaatgcacccagcctgatccacctattatccactgaactgaagccagcattcaaagggacactaaagagaaagcttctaaagatagagaatgtggatcctccccaaccttcagaacactccaaaaactttcctgaaaaggcaatagggtggggcatggtggctcacgcctgtaatctcagcactttgggaggccaaggcgggtggatcacctgaggtcatgagtttgagaccaacctgaccaatatggtgaaaccccgtctctactaaaagtacaaaaaaaaaaaaattagccaggcgtggtgatgtgtgcctgtagtactcgggaggctgagacaggagagttgttcaaacctgggaggcgggggttgcagtgagcggagatcaccccactgcactccaacctgggcagcaaattgagaccctatctcaaggaataaaacaaaaaaagaaaaggcaataaatatgcatgacagggaaaaatcataaatgtacttcattttgaaaattggacaaactgcacagtattcaactaatgtcattaagtgaggtatctccagacatggtacagttccacacaaagaaattctatcccagtgtttcttgaaaaaatgctgacttctgcatcctgaccctctcagcttcttttcttgccaccaaaacacattcactggcactttgacttatctcatccaaaagacggacttgcaatgtaacccctgatttgaagtcacctgtagatcatccctagcttttgccacctttaatctgatgttaaaaaatgcttaacactgtctcagaaattcaaagccttcccgattacctttattgctacaggcatatcctcaaggaaacagcacagggctaaagagaaaaatatacatactctaaggcttcaaaggacagatttcccaaccttttctagtgctctagaaatggaatgatgaattatttggccttgcaatatacccaaaatttcccatgctttgttttgaaatttctaaatatttgcattttcattttgctttttgaagatgcatactttgtacttatactacacctttcatctaaagttctcaaaagtgttcatgcaaacatttcacaatgtggaagtttggtgttcaaatttcaaatataacagaagcaaaatcttccagtgactttctgaaaatatgtgtgctcataaaatgcataaaactaatatcagattggaaggatctgctgctggataaaccacattttactatctatcctaaaatgatgtcattgtttctattaatagcaggactcatacctatacaggatgaaaagccaagtatttgtagggcatctcttaataaaacaacctctactctacaaagtataggcgggaaagtataagacataaatctctttaagcacttacaatcttgtttagagagcaaggctaacactagaaacaattatagaatgctacagtctgtaattaaataaggattaataaattgtgtggtacacctgataagttcaaaagtaattaagaaaagaaaaatgagagagattatttgttgtaggctagggacatgaaaacaaagtgtgtaatttacaggtggatcttacagataggtccataaggtgtatggataagcaggaaaaaaagaatgacattcatgcctgaaaggaacatcagagaagaaataagaagtccctgaagcagggcagactagtaaacgggtgcctaacgcaggaggggtggctaataaggaggaaggaagaaaagaagaagagaaacttcttgactagagcagaggatttgttacaggcagctgaggtaaataacctaagatggttaaggggaaatgagactatatgaggctttgagtgccttgcttggcacttgagtgccttagcttggatttgatccagtaggaaaccaatgcagactcttagcaggagaatggcatggcagggccctactttaagacgaatattcagctaacagaggatgaataacatggagggtagtctaatcatttatttgttgttttctaacagaagtccttattttacagcataacttgaaaagatcataaccttctctcataatttgtgaaaccttgagtaattaaaaagatgttcagaatttcagttcaaataggaataatgtatttttacactgtttttataagaattaaaatagatcatatataagaagtgattgagatatagtaaacattctctccccaataaactccttcaatattctaaaaatattcagtgatgaggtataaatgagattctgagatttagacagagctgttacatgaagtgttcagaaagttatagaacaatcacatttagtattgaatcaatcaatggtctgctcttatttcagtgtgatcgacatagacctaggactcttactcattccaaatgacttcattaataagtcagtatactgaattttgacccaaacttaaatggggcaagtcattatagcatttctgctgctgtgggtataaaccagattaagaaataaatgtatcgggcttctaactgttcatttgttctttcagatacttattaagcacctattaagtgacaggcattgttccatgcatgcaaaatacagcagtgaacaaaaagaaaaacctctatattcatttaccttatattctacagagggaggacagatactaagttaataagtaaatataagtaaaatgtgtaagtgattagtgagtaaaatacattctgtgagatggtgatatgtgcaaagacaaaaatagagtgtattagcagtagggattgcaattttagatagcatgcccagaaagagattctttgaaaagacgacatttgagtaacagcttaatggaggggcaggagtgaagcctgtaagtgtctggaagtaccttggtgtgtctgaagcacagctggggccaagtgagcagggaagagaggagtagagaagagttcagagatatcacagggtgtatgtagggttgaactgtgtagttacggtcttgtaagttttggctacagcaaatctatgggtgcacagccccttaaaaagaaagccaaagagaatagcaggacaatggctcccccttagaggtgtcatgaaaaaggcagaaaagggcaccaagctccaacctggcagcaccaggtatgctttcccgccagtgctgccagattttaaatggcttcccccagcacccagcctcagaatcctgtctcccattgtattcttataagcagcaacaatgatcagtataacaaagtaaaaatatagtcactgtggtattaaacatcattaatgcatcaaagtgcagtctatctgtggactagcaatggcaccaggctgccctttgagaaccgttatcctagacctgacgggacactatccagcatgcagaagttgccaacaagggcaagggatgccagcaagtgcaggaggtgccggcaagacagatgggatctacaggaaacctgcctcacttgggttaggcagccagtgacaagcatgaaaaggtgaaggaaaaagcaactcaaagctgataaattaaaaccagatttctgagatctttgcctttctatcaactgatttaaagccaggctgcctggactcttattttcactgagctggaagagaaatctgtgctggaaacctctatgtacagtcaaataacattgccagcaagcccttagaaatcctgcttgtccccaaggaaagtattttttctttttttcttttttttttttttttttttttagtgttaatgagcaggtcgcctgggttgctccctgtatagcactagaacccttatactttaggaaattaatcaggaaattcctaatgatacgtagcttcccgttttccagagacaaagaaaattatgctgttgaaatgttaaaaacattgctatgtcattcttttctctctggataacaatggagattttggaaaagcttcctgttggcaattctgccattcatctaaaaaacaaacacactagaattttagcaacacttcaatccagcaaagggcctattgttgtatggcattaaataaaatagaggaagaatcaataatgataatgtcacaggatggtaaaatgtcatcattatcttatggcaatttttgcaacatcattctagtgtgggatttttttcctagtttgggcatagtattcatcttctgagataaggttaagaagttattacacttacgctggcagagagatgagaaagagagccggagggaggagagtgggaggagaggaaaagagggagaaagagggagggggagaaaaggagggagagggaaggagggagacagaaagatcatgaaggcaagtataaaatggttgtgttttttaattatcttgaacctaatgaagtgtttgctttaagttgggaaattctctgcaataattatcttagttgagaatttaataaaagctaccatcagaaaccttgctaagtaagtaaattacttatttttaagtaattacttttctatttatgcagctataaggcaaaatacattgaaaagaaaggaaaatacacagcagctcagtcttatttccctcaatgtgaattgaaagcacaaattttgagatccatactaacttagaatctacaaatgtcaatgtagattctaaattgggaaaaaaataatactgccagtttccttaactacttaacaaatgtactaaatctaatatattaactcaaaataaaagcaaagctttagtaaaactgctatttgtgacaatttttagtaattgtccaggtttttaaaaaatccattaatgttggcaaagataaactgagaattgaaaaaattatatataaatcctcaagcttttgattttttgatttacctcaaaaaagagatgtctcatttgttttttttttaaaaaaacaacttttaaaaccacatgctaaaataaagaaagcagcctcattaaattataaaatcaaatttaacttttgaaacagcaaagtaatcaatacatagatgcattcaatccttaaaacaaggaaaataaagctgcattccaccaggaagcgaattaaattattccagaccaactccttgcttatttagcaaaagatagtaaaggctttcccaaaaaggaaacaaaaatatctctgaagtaaaaaaggatacacccccctccccaatttttttaacctggaagctctttgatgtctaagaaaccatgttaattaactgttttaaaacctatttcaaacctcactgtttatgtaaatactcatggcacggtattatttttatagggtttcctaatttttttttttttttcagaaatattagattacagcccaggtagttctggtaggctacaatgtaggggaagatgaccaggtggcctcagggaccaagaacagtttcactttggtgcttctatttctaacagctgcgtttccatcctaatggtggatgctcttttatggcaggccaggccactgcaaatggcccaagctgagaagcggcacagccacagctggcgggggcggagagcctggcgctgagcctgcatgggactggggcggactgaggggcgcgacaggagccggccaagcccctcagccgctttctctccacctgggcgctggaatcattgagccctgtcactctgctgaaatgacagaggtgtcctccgagctcggtgacgctcagtagaccaagaacgaaaccgtcattccggaaacacagctcctaatacatttctctgcacccagggaccctcacattagctcgtagatgccatttctgtccctggaggttgaaggagtttgtgtggactttaaccagttcccaggaggcggaaagaaaacgggtcaagcaacatccattttgcagattggggagctaatgtacagagcaacccttcacagggcactggggacgggtccagatcccatttcatatggcacaggtctctaagctgtcctcaagagaaagctacttgctttaagaatcttgggggggtggggtagggaatatatatatgtatatacaaatatatatatagatatatatgtataatgtatatatacaaatgtttatttgtatatatgttttatatattgtgtttattacgcgttttatttgtatatttttatttatattatatgaataacatttttatatattttttctcatttaatgtttccatatttgttgtctatgcatcatatgcatattaaaaatgaaaaacagaaaagagagaactagaaaaaaattaaaagaagatgttacttgtgaaactgtgtgtgcttccctacccctaccctcattttcgtggtttattttggtttttaaattagctatttgggtggtagcaaatcacccacctgaaggtacagtatttactggtactctatatactgaatgaaaatgtcttaaaatatttcctgagcatgtctttatgtaagaacacctgaaattgtgcataggctactttttgaatccatgattaacttaatttcaaggcaagaaatctgtgttttggaggcttcagagtgactgaaagaggctcataaatctagaagctccccaagcattacttgcaaaaggaagatatcgttgcatatatatgtaatttttaaatgtacatagcagctgttatcatgaattttagaaatttattttaagtgtcactaaattcatagtagctctttgtcattatatatatattttttttctcaagtaacacattctaaatatgtaattattcttatgtggaactgtcacagactggtaaatttgcctgcttagcatccattttctattttctctttttataatagaaaaatcataactttctgtgattctcatggaaaaatcctttccatgttttgggtgtgactgacaagattccctccaccagcaggatgggcatgtaacccagatttagccaattggagcactctatgcttacagcctgcaagtgattggtgcagtgaaaggcacctgacctaagccaggccaatcaatctcttccctaagatttgacctggggatactagaagagagaaagttctcttcttttgggatcagaagttgtaagcaatatgtaggtctggtttccagagttcagtttttcctagtttcatggaaaaagcctgcctaacaatgacgccaatacagagggcagacaagcaaagcaaaagagggagagagaaaggtttaacccgattgcaccacttaagcagctaatgctagatctgtccccactgcacttaaagttgtatgtgtcaataaattcattttttgcataaatgactttaagttgattttctgtaacaaagtcttgcctaatactaggggtacacagaatttttgttactgaaaagatgtcatactacaaaaattgataactgctgcactacagcattttcccattattatccacttccttcttcctaaacttttgttcttctttggttgccataatgctacattttcctgcgttcttcccttgaccccgtgaccattcatccttagtctcctcaattgtcccttgaatgttcatgttctcaggtgcttctcttctctatagatttccttatccatgtcatccatcttttgtctagtatatatgatgaattggtcctcaacattaatttctcccttcttccagagagctcacctgtattgtggagtctggaaaggcaaaaactacaattatcagactactttgcgataagagtttcaaatacatattagattccaccagtttcatgtgctctagtgagacagctggcagacagaagcgaagcaggggctattttcctattgctttggttattgttgctggcaaataggggtgtggaaatattaggtttggggcagcaatggccctgtgtggagtcactgacaccatggtgtctgaagaattgtagcagccatgttggtggcagcctcctgttcccaggatttccatcatactatacgttcttgaactccaaaggttcacgggcagccttctgggatgattctcttgagaccagtcggatggtcttgttctgggagtcatttctggaagcctacctcttctcccctcccgattcttttcgcaattctctgtaaaagctaggaaagtttgccattccatttcttcaaaattctcttcccccgttgacaacagaataaattttttttaaactttttttatagtcaataaggccaggcattatggagccactgcttccaagagtagccttggctgctgcgtttctgctacacctttacacaatgacaagccagtcttcctttatgcctctgtcattggcacctgtcctccattttcctagacctccctctggccctcaattgccctgtaaatctatgcagccttctcagactcgtccagcgagattaggtgtctgtaggcaccataggactttatgctgaatgcttttagaataatcatcttaatgtattataattttgttttaatgtttctttcactataattgaaattaattgaggtcatgggaagtgaatttttcttggtttcccctgagcctatcatagtacatgatacttaaatgaacaaggtgggaattaaaccttccctcaatttacgaaccattgcagacgctcaacttccatatcatctccttgagagagatgctaagatcacaaataaaatgttttctctttgagaagagagtacatacatatgaaaactttattagtatcacttctcatgtagcctccagaaagttttctaccaccaggcaccattctaaatcatttaaagccaaggaaacgtcaacggtgtcctgaaatacacacaaactcaattctgctcatgacctagtccacttttctattttctccagcaaattcatagaaaggagacaggatactttgacaatctttctcttgtgttatcttcaatactttctagtttgtgtgtttacataacttatagaatattttttaaacttgatttaaatgaagatgccccatgtttgttacctacgagtaaggtggtgaacacaggcactgttaatgaacttaataaaaatgaatttagtataactactagataccaatttaataatattatttatcttaatacttgaagaagaattaaagattacttgttagggcagaattagaaactgcaaagtatgaaatagtgatgttagcaggcataccacactatcatgacatattatggacaagtattttaaccatggtgcatggtccttcagaaactgaacagaggacagaggcccttattgattcttaatacttacttagaatagagaaaataccatactccaaacaggagtttgtcctaaaaggagacatttaaacctaaagtgttcaaggaagaaagaaagcttctaaagtggaatctctgtgccccagaagtccttgagccactcaatacttaaagttccatcatctgaaatgtaacaggtgaagaaaaatatcacctgatacagttattattgcagaatctgtattcttcctctctcccatgctactctcagaatcatctcttgtatgtcagtactgatgcaacgttgctaccaaaaaaattcttgctcccagattttaatttatgaggtaggctaactgaaattattggccatgactgatagaaagagagcagtatgattcactcctctgtagcgatttctatgattcatttggcgaccaaatctggaactgacagaatttagaatcagacctttttaatcccaattggaaatactacttaaagacatttggtatctggtatatacacaacaagaacacgtaaataaaagaaaaatcaaccaaccacaaaatctgattaggctgaacagataaaaaaactgtagagcagaggttaaggctacttgcaatgggataaaaaactatccttgtgttttaaaaaatgctacttatgaggatttttttcccttctgcaagatgcatggcctccaagaaattaatctgatatatgaatctatctcttaccccaaccctcaagcaaatcaaaattgcaaaattaattgaggagcaaatattttcatttttataataaaggctctttattttccaaagaaaatacagtttcttttaattgaaagtttccctaatgagacaaaatatgatgtataaaggacttattcatgttaatatgtttagggacgtatcttttatctacttcttaaagtgtgatccctggacaagcaacagcagcatcactaggagcttgttaaatgttggggccctatcccagacctatgttatcataaactctgagagatttggcccagcaatctatatcttaaccagccgtccagatgatttgtacacatgttaaagtttgagaatcacatatcccaatataaataagatagaaataagaattgaatagagttccctaagaagtgcttattgctacagagttaatactagaagtagcaattattcaaaagcaactatgttgtttatctgtcacagttatcaattatctaaatgctgttgtagccataagaattttatactcatgttggagaaacttaggaaggaaagggaattaaacatgaattactaacacaagatcttttaagggtgataatttgggagattctggggcccctattttaccaacaggagcatctccttggaaccagtaagagaaaatcagatagcgctttattctgatggatgtaatatagggatccacctttggccttaaaaccccatgaaagtgacttccaagtaagagtctggaattgcatcttgtatttctattttgcttaggcctgcagtgatcctctatagagccccagttctgagagccagagactttcaacaaccagctcacatgagtcaagcatttttatttcctttgtaatagacatctattatttgtgtctgcccagcaccttatttcccttctcttggtagtggcatacctacttctttgaggaaattgcttccttctttatttcaacctgtgattacatactttaaatgtaaatggattaaattttccaatcaaatgacaaattggcagcatagattaaaaaacagaatccaacaatacgctatctacaagaaactcactttagatccaaagacacagatagattaaaaataaaacgatgaaacaaatattccatgtaaagagttaaccaaaagagagcaggagtggttatgctaatataagacaaaataaactttaaatcaaaaaaactgcaagagacaaagaaagacatattacatattagtaacagtttcagtacatcaagaaatataaccattttaaacatttatgccaccaataggacaataaaaatatgaagcaaaaactgacagaactgagaagaaaaatagacagttctataataatagttggatactttaatactctgctttcattaatggatagaacaatcagacagaaaatcaagtaagaaaatgaaagacaacacaataaccaatttgatctaatagacaggtatggaacactacccaacaataacatcatatacattcttctcaatgcacatgggacatttttcaggatagacaaacatggtaagccagaatttaagtcacagtatgttatatacatacaatggaatattattcagccttaaaaaggaaggaaattctaacatattctacagcatggataaatcttgaggacattataccaagtgcacagaagacaaatattgtataattcctcttatattacatacttagagtagtcaaaatcatagggacagaaaattggcagggggttgccagacaatggggacaaggaggaatggggagttgttgtttaatgaatacagagttttggttttataaaataaaaagagttctggagatgggtaatgattatggttttacaacattatgaatgtttttattaacactaaactttatacttaaaaatggccaagatggtaaattttatgtatgtgaatattacaatttttttaatggggaaagaaacaaacctagcatctgtcaatttgaatgcattttgtggtgactggattttcaaatcacatagtaaaacacaacgcaaaaagcatgaacaatcacagaaaatagtgataaattagacttccttaaaattaataacttatgttcatcaaaataaattattaataaaaaactagcaggacacagactggaatcagatacttgttaatttgatttttttacatatttatcagaatacataaagaacaaatcaaaaacaaaaaaagacaattaaaggaaaatagctaaaaaatttgaatagtatttcatataacaggttcccagaaggccagtaagcatatgaaaaggcataggatattattattaattagagaaataaaatttaaaaccacagtgagatactaccacacatccaccagaatcattaaaatgaaaaacactgacaatatcacatatgggcacaaatgcagaggaactagggctctcatacatcactggtagaaatagaagttagtactatcactttgtaaaatcctttggcagcatttactaaagctgaattatgtctaccctacaaaccagccatgttaactctagctatgtcaactaaaaaatgaatgagtagatgtattcatcaaaaatcacaacagacattcataactgaaaaatgaaaataaagatctatcaagagtaaaatgaaatctccatagagtattacatcacagtaaaaatgaagctaatgattatttattataccataggcaagaatacacatgaatctcacaaacacaatattgagcaaaagaaagcaaatataaggtatcattccatttctatgaagaacaagaacaggcaaaatcaagttatggtgcttgaagtcaaaatggtggtaacttctaaatggaggaaaattaactgggaagggatgagaagagattttttaaatcttgctttatatcttggttcaagtggtagttatactagtgtacacatatgtaaaaattcattgggttgtatacttaagatcaatatactttcctatctgtgtattatacctcacttaaggaaaaaaaagaataaattttaaaaatgccacacagatgtcctaattccccatgtttttatgaggattcaaaagtgtaagagcccagaagagaatggaattgagaatcatttcaaatggaaagtctgtgatatgactgtgaagtccacatttcttcctagataagttgagcaacaaaagagtctaaaaaatattgaactattttagggttgtttggggacaagatgtgacaaactgatgagcagaaatgatttacatatgttaaaatcatctttcttgatccacaagatcacaccaaaatgcatttacatgctccttgaaaatcagggaaaataaaactcattcagtgccacaaaccctctctatgaaccatgtatactggtgaattctgtcttgagaagtattgtgttattaaattactatttaattttataaacatatccacctcttctaaaagcaccctcaaataattatattttctctgtattttcaaattaccttcgaaaaacccatacatgacacagcattaataaaatagcatatacagcagccttattatttctagctaatcattaaagtacaataaacttgacaaaaagcatgtctaggcaaatatacacactcacaaatattatccaatctctttccaaagctcctgcatgttgaccttatcaacctaattagatggttacccatttccaaagcaaagttaaaagcagtaaacatatccttatgaaaaacaggcaaaggttagcttcctggagaattgttgttacaatagatgtatgacttttgtcaatttgttttgagaagtgacaattgctactggaataatctgttttatgtttgtttcactgacataatctagtagctcttgttgaacataacattttagaactgaaagagaccttaggaataatgtagttcattttcctcattcaagaagtgagaaaactgagcaccagaaagttttcaatacttgctccacgtcagatacgtgggatacacctaagttaccttacaaatataatttagaatcagtctatgagctatgaagtctacagtaaataacacatatctcacaaagagaatttcagtttacaaattctgaggaagctaccatctccattgaaatattggcatggttcttgagttacgttttgaaatgcaaaccagtggttctaaacctcaaaactaatgggcatctaaactaaggccgggaccttagatatggcaagaaaaggatattttaaaaatgagttcactgctgcagagcacgcaaagtgtggtttgcagatccttggtctgtgtcactggtccatgatgaaataagatgcttgcagctaagtcagtaagtccactatttacttcagctgacctttctttcatagaaacatttctttgtgaaggaagcagcatacagatttatgttctggcacaagctcatcttgtcctagataacaaggcaaagtttgcatattggctacttgaatggactagtatagttcacatgtcagaattatcttgattaggaaagaggaagctggattacttatatcatatcatcagcaatcattgcttcaggcctatgtcctgggggtgtggagaaaaaactcccaggtctccaggcttgtgggtggcagtgggggcggtttgcttgcagcctgtccacaagatcaggtgctagttgttggttgggagtaatgcacactgcatgagtgcatgaaaaaggtaaaggactccaagatgataagaaagggacactaacctaacagcatttgctaatttgcccaggaagtatacaatttatcctagagcattgtgtcttgctacatatggtcttcatctcttctgtttcatctctaatggcaacctatcccatttcacctcactctataccactggtttcacattttgcttacagattgtaatcacctggggacttttagaaactactgatgcctgagttcttcacccaactatcctgattttattggtctagtaaggcctagatattggagatttttacattctccctcaggtgatcctattgtgcagccaagactgagaacaactgctctaagcttttatactaaatgacttacaattccatgaggttgacatggaatgactttgtttgccatgccatgaacattgcagaaaaaaccttccccatctttgccttcaattgatatttaaaatgctattcattctttaaggctcaattcagccatttttctcaattacaatggttaataaacacatgaacaaagtgttcactatgcttatcaaagcatagtgaaatacctacttcacttacctattaaaataagtcctttaatagactactggtaaatgtgtataataatttaaaccctgtagaaagcaatatgaaaatgtgaaacatattctttgatctagaacgttttggaaaccctagcccaaggaaataatcctcaacactaaagatcaccctttatgaacaactccactgcattatttaaataatgagaaacaacctaaaggtctatcagtaacagaacggttacataaattataaatagtcttacaatggaatataacaattgaaagtgatgcttaaaaatagtctttaataatttggaggactgtttatactgtaaggccaaccacacatacacacacacatttacacacacaaacacaatcaatttacaaaatctcaaataccaaacgttcttatttattttttaaatgcatgaaaaaagactgggaagtacatcaaaataaaataaatcaacaattattccagaagtggagattataaatataaaaataagatattattaaaattatctacaattaccatgtgtttacttatttgaaaaatatatgtaccttagtttctccttttaatattttcccttctgtattaatttctctcttatcaattatatggcttatttgtctttcatgttccttggattatgccttgtattttttatcagggtataatttacatataatcttcagaacataagtgtactgttgagttgattttgataaatttgatggaatatttccattaccccaaaagtttccttttacccactcccagtaaatctgcctactatccctgtgagaagcaatgacacataggatttctatcacctacagttctgcctgttctaggattgcatacaagtcgaataatatggtatatattatctttttcttctttcactcagaataatatttctgaaatttattaactttattgcattcattagtagttctcttttatcactgaggcatttccaatgtgtgaatatactacagtttgtttatccagactcctgtgaacatccgggctgttacctagtttggctattataaataaagctgctatgaacattcttgtacaaggttttgagggactttcattccatttccctgggataaatacctgtgtggtagccagactccaaaaacagcatgcaatagtccttgcttccttatctcaatgctcttgcatagccacacccttctccccgcacatacatacatcatacactcaataggactaatttatgaaattaataggatatttcacaaaactatggagtatgacttttgaagtgaggtcataaaagcttccaccttgctctctattgaatcattcactccagggcacgtcagcttccaggaggacactcacgcagcagtatatgggatccacatggcaaggaactgaggtctctggccaactgtcatcctcaatttgttagtcatatgagtaacctgtattggaagcagagcctccagccccagtcaagctttcaggggactggagacctggccaacatattacctgaaatctcatgaaagactctgagtccaaaccacctaaaccctcatctgaattactgattccccagaaattgaaatgatacgtgtttattcttgttataagccattaacattgtgctaatttgttatccagatgactaatacaatttaggaatagaatttatagatcatagggtagatgtacattcaactctttaagggatactgaacgttttccgagttgggtatgccatttccattaccagagttataattgctccatatctatctttgctaatacatggcatagttagtctttttcattttagccattctcataaatgtatagtggtatctcaatgaggtttaaatttatatctctctgatgactaataaaagtaaacatttcatatgtttattatgggccttgtggtttatatatttttaatattcctttcacaggactgttaataagcattaaccatggaacttggtactaattagggattaatgaatgtttgatgaagaaatgaacaggtttttgctgtcaaaacttacaaatagaggtaactgtgagctcttttaaagatatgaattgtaaattgcacaatataagctataactcaattactgggtggtagatatttataatgagatgttaaaagttttccttcttttcatttcctaagcaaaaatatgtaaatgcttcctctttcttatttactgggatccttcttgttaagtgtggttggcactgcactgaatgtcttgcaggacagggtgggaatagagtgacccttagtacatggaggcaacagtgagatactcaggactctgagttaaattaggaaaatcaacatataacaaatgaaatctgatctctgaggagatccttgaaagacgccatattacaaagtcccaaacaagctttgagtatacctaattaacagtataaacatacctatcgattaagtttgtcattacttgtggaatggtcacattagaaggaaatcaatggtaaccaggaagccagaatctgctataatttatttagcacgtatggaagagaacaatactgaatgagggcatgggacaccacaagaattctaagcaccaaagagctgttctctattgtaaggcagaagtggttcatcaggctcatgatgacccacaagacagagcttctcctattacctttgttcagaacttctgatgactgaatggcctgatgactaatttatcctcctagcatgagtacatactggagcagacacaatggttctgatcacaaccgaaaaaccattcccactgtaaaagaataaatggacacaggaagagatgagctaatcagataatggggattttctaattggcttaccggctgtacttcacatatttaattactatggtagatattgatctcacaagctgcaaactcaattgtgctaaaaaataactgtttcatttttctattactattcttaattctcaaactccattttttcctactggcaaataaccaacttagttcaagatgatagtcttcagacaaatcacagtttcttctgccatatgaggatattcccagtgaaatgaaggttcctcaccatcccccctttttcctgggtagtgtctaagacttagagagtaagtgggtggctagcaaggctgcagtgttgtacaactccaatgataccaatcatggcagtattgtttgcttctctgtcaacatttgtccatgctaatgcccactgctgatgtgcaaatgaatgagttttcctgttcaaacttaaaaaaagaggctcccctgaggtccttttaaggtagatattgcataattacaaaatataatctatagcattgttcccaagtgttcccttgggagtcagtttgtgagttcttctctgaccaaaagacttcttgaggttgaagttagacaactctgtctattgcagccctcttctaagagcacatgaagagctatgacctggttatctattgtggggaagtaaaccatccaaaacttaatggccacaacaataattatttttataatgttcatgccccacgggtcatatttttaagaactgggttgtgtgattctgcttcccttgggtcacttggtggtgtttcactgtggctgaactggtttggaaatccaagatggcttcattcacatgccagtcatcttggtgagatggatggaagacaggacttaactgagctcctccctctcccctacaggcagtctcagcacctccccaggtaggctctccagcagcatggtcagacttgttatgtgacagctggctttctttgtggggagcattctaagaaatctaagtgaaagctgcaaaacttcttgttatctagccttggaagtcacagatgctcatttatgctgcattctattcatcaattaagccaccaggctagcccacattcaaggggagaggaattagactctgtcccttcatgggaggtagaaagaattcgtggccatttttaatctgggggaggcggggagagggaaagagcaagccactctagggatcataagaaactcagtgaagttaacttaggctttcttggcccaagataccacatcatgctgtattatagcatcacccctattcaactggtgtcatactatcccaggatatgacaaaattccagcatctgggtattttcccaggtaccacctgggaagcaagggacaggtccttctgctcttggagcctcaaattcatttcagactattatcgctgcctcctcagggatctcggttttgcagtggggtgcagggcagagaacttttcagggaccaacatctgcatttacttcattttcatcttccctagttcctttgttctacccatgtcaagaggatcttcatcattagtcaacaggcagagcaaacagggcttgactgaatgaattttcttacttgcctcgtatttataccagggctttagaatttcaaactcaaagaccattaataaacgtttttttcctccattagattttagtctaataaaatctcccttctctgaggcacagagactgagatctagattgaagaggcaaacagaactacaggtaaaagggattgcatgaaaaaaaaaaatcacctcagtaattgtttcaaaatattttcctgtcacttttataaatggagcttctgtctcttacattagtcactattaggttcatttgttcaatcatctgagagactgtgagatgattaaatctgggatcactgataaaactgaattgctcaacctgcaaagctgagaacccaactcctcactttgctgaattctaacatgggaactctctggggttccactttataataatggtaactaaaagctaccttttgtttaatgggtacctaacactctactaagtgctgtacagtacatatattacctcatttaaatagaataaaaatcttatgagatagatcatattactatttatattttacagatagaaaaactgaggcacagaatgattaagcaacttggagaaggtcacatagtgacagaatcagaatttataccttggtaatctcattttagagttcatgctcctaacgactgggctactgacacattaatttttgttttgaaactgtaacaaaatattaaatcaataagtatatggatatgcaggttaaatatagctagaacaaaaagcataatagcaaacctagagaatataatggatatataaaggtacaatagtctaaatcctgtcaactttgttatttgaatataaacctcaaaaatattttaataaatcaaagtatttggatatttcttgaaaggaaagtaacaacctgtaaattgaccattaagtgcttcttattgacatgaaaagggttctttaaagtgactgtgctaagaaatctttctttatatccatgtcacatatggtgacagctgaggttaacttcctaattcccagttgtgaactataaaaacaaagtactagacttcaagagattagaactataatattacagtgacaatcaatcctaaatcacagctgctcaaataaatcaaacagggtgccccagagaaccaaagaaaaaacccagttggaatgaaccttcacaaaaataatgtaagccttaatgcatgtgccttgactccagatagttttataaatgtagaaaagatgccttgaaatgcagacatttaattttttatttgaaaaacagcgttattttttaagtgcatttttaacaacctctttcttttaatgctgcaaggaaggtcaactgtaggcaaaagctaaaagaaagcaggctggaatcagaagaaacaagagttaaggctaccctaaactggaatgtggtttcaagagtggtactggtttcttcttctgttctcatttttccccaaactctttgtcatcaatgccatctgacacttccagtcccaagccatccttctttactcaggtgtctttgttaatttctacacatcacacacacacacacacacacaccacctggatattaatattttaaatggtattaaactaacttcaccatcccaacccataatcttgattaattctaacctcgccatcccaaattctaaccttgaagatgagtctgtcatcttcagtctatattaaaataatttccaatcagtctttgaacaaaccacctattttttgacagagggaaaaatatacaaacagatagatatatagatagatacacatacacacatatgcacatagtgcataaacacataattatacctaacttcttgaatatttaaagtttccccaatcagtcacaaaaacaaaatatgtttctacaatcagaatttaaatgggacagtcagaatcacagtaagccattagttattaaataacataacataggtggatatgcctaatatatgattggcatttggtaattattagtaccctttccctttcagttgtgcataaaatataaagattagagaactgactgtatgtaaaaaggatagtgagaaatatttcatacgattcccagaatgtaagttccatgaggtcagggactttgttttgttcattgatagatccttagcacccggatgagtccctggctacagcagcattccagaagtatatattgaacaaatgattgtgtgataggaaagagggaaataagggtagaagggagggaagggaggaggagaggaagggtagaagggagggaagggaggaggagaggaaaggaggaagggggagagagggagggagggaggaaagggaaggagggagggagggagggaggaaggaacgaaggaaagaaggaaggaagggttttacttttgtaaaaacctcctaattagtctttgcacattcactcttggcctcttaaattggttctccacacaaaggatagatttatttttacaaattgtcagtcttgttatttgccatgatcttcagctgatctcttaaatatttcagtgctattctattgttcttacaaattcttatcatagccagtaagtccctatgtgctctggctcccattttttcattgcagtcgcacgtcacatcactttttccctaacttcctgcactataatcacattgtctacattcatttcctcaaacacccttctcccctcaatgtcatgctctctcgcacctcaaggtcgcctgctggaatgcatctctcccattgcccatcactttactcttctactctactctccttgccctttaaataattcaaacacacatctctttctcagggaatattatcctgacttccctttcctaatattcatgtactctcgtggcaccctatactttccctctaccatttataatatagtttataactataaacacacacatgaacacatatatttatttagttatttgattatatctgcctctcctcataaactgtcacctctgcaaatcaaggtcatgtctgcttgatatacagaagatatttttcagagattagcaaaggctatgcaaagccctactaataggaactaggtctaactaaatccatctatccacgacacaacagagtatatgggtaactagtatttctcataatgaacagagaaatatcacatgccatttgaatgaatcaataaatgatcatgcaggagatgattacttgggtgccccccaatgagctgtgcttcccagcattcacatccttgtatcctcctctctccttgaatctgggttggcactgtgacttcctttaaccaataaatagaatgctgcaaaagcaagctgtgccaattctgggtttaaggattaagaaggcctggaaatttttatttttgtatttttgggtaccctgagctgctgtgtaagaagctaaactaccaaaaaaaacaaaaaacaaaaaacaaaaaaacaaaaagccacatggaatgactatgtgaaaagagagaggcccagaaactatacagagagcgagaagtcatcccagcatcccaactgagcctagctccagctcactgcaaacctgcctgctaaatacagccgtgagtgactgccagccacaaaactacccagctgggcccatgtcagattaaagaatcatgacaaatagtgagaatggctatggttttaagccattaaattttagggcatttgttatgcagcaatatataaggtaacggctgggaactaagaatagttagggatcaatttaaaacaatttcaatataagtctgctgatacatctagattttgaaatatcaatattctcttctttctgcacgtaataagaagccaagcattggaaagctgaaaattttgagacactgtaagactataatttaatagtagaagtatatgtggctcaccattcataaaaaataaacatcctggcacttcaatatattcacttcagaactttggtcctcttttaagagcaatctttagccagtattatgttttcagcttatgatgtattatttgcattttaaaacgacaaccacaagatcaagtcattcctctcacaaggttaacatatctatttttcttataaagcattgtttttgtcagtcacaatgttttatcctgagattagcctaagatgcttgatcacaatgttcttaaagattgctaaagttttttacgctaaagaataaaagaaaaatatttaaatcttgaactagttttcagaatatttcagagaagctaggaaaatataagtatcatcatccttaatttgtaaatggtctcctgagttctgaaggatggtattatttgccaaatgccaatggaaaactccatgctatcaagacaggtctccttcaacagttgtcataacaactgatatgttcatgtcctagattctggcccacttactatcatcaaaagtaaattcctgtacaatcagtttctttgaacaatcacttgggtttagcttttagaactgcagtttagaagtagtagatcaattggcaagaatcagcacttgattttgaatacttccacagctgcaagcatagcagttattcagcaaggtttcattagagaaatctggaattcagcccaatcagtttggataaaaaatagtcttacataactcttcttcattctaatggcagtttagcctcctcacagaagaaactatttctgctgaaggggcattttcactcaatcacattaattgtttggatagtgctgaccacataacacccaagctcttcaaaagaaaggacacatcaaaatagggcaacaagcatctgggaggctgtgctggattacaactgggattttatgcttattgttgattttgttttcaattagcaataaattatgaaaggcttaaattcaattttaaaaaacaatgattttaaagtgagaaactaaaatgtgaatctagaaactctttaaaaacatcttgagggctttattgattttcaaatgagtttttaattattttgaaatagtggagtttttgaagaaatcattcaataaaattactagactagaggttctgaagaaaaaacaagtccccattcttgaacactgctacctagacaaaagtgggcaaatgtgatgtcctttgcaaagtggaaacttattctagttggatttttcattccttgcaaaccacccatatcccgagtgggtgaattattctagattctctctctgccactagaagagggactttcaccaccaatgtaattcattcttgttttggcaaaaacaactgtggactactgattttaactgaggttgacataacacttttaggaaaggagaagctgggccttctttcaatattacaaaagtattccatgatctttgacacaatgatgtttggctaaagagaactttgagtcaatgatagaggaaaagtgctagactaaatgaatatgatgacataagtaaaggtctcaaccactattttgtttacacaatcttcattgaggagttttctaaaatcatttggcagcctaaagtgaagtggagcttaggatgcaatggaaatttaaacatcatccatcagaaataggtaggctttggcataaactctagaagatgtcagttgaaacccttagttctggcaggaacaggggttaaggtttgctttcttcgctgatctctcattattcttactgttcacatggagaatgcagtgatgacctggggaatgttaaaggtagaagtttgttacagaggaaagaaaatgtgtgttcacgcataaaagaaaaagaaatataattgggaatacttcataaagtagaaagaaattaaaactatgtatttttgttgggtggggagaacagattcattcttccattttctgatagtgacagcatgatcttccttggtgaatccacacttctcatctctcatctcaggcagtcttggtgcacgacactgtcctagctatagtgattagttcaattggggtcatatgacctgcatcagtcttgtgagatgcaatcctgagacttttatttaaaacaaatagagaagctattgttctattgaggttgctgaaacaataagatataaactttgtggcaaattatttatgttggtgacagggttgtaggagtaaagtctacttgaatgaagccaataaagagaaaaactgagctgtgcaatggaaaaaaaaatgatcttaatgatatttttctagcctgggatccagatctaaccctagaattttcaatgataggatccatttaagttggattatcatcacttgcaaccagtatgtccaataaaaatccatgccttgaacaatacacgggaacatctcaaagagacaaagtaactgaaaattctatgaaaaaaatacacattcaaagggctgcagtaaattattcaaataagacagttgtaatcctatataaccattccctgctatgtaactaaacatgacctctcaggacaatgacctcaaattcttcgtcttgagctcctaagatgttgtcacctctgtccttgacactattagggctggtataaaatcaagatcacagtttagctgtggagaggagctattaatatttgaaacagttgcataatagttgtatgccaaaaatgagttaaacagacaataaatgttggagacatcccgctgtgagctgacatagtatagagggagggggaccgccttagtcaattttttaataaattccctctaatcattctcattagccttgttcaaggctttttattttcacagataagatctacaaccaactgtttgtaactttgtaatctataaaaaagaaccactatcacatgttagtgcttcacacacaaagtggctcagtaggatatgtaaatttaaattgcttcaattaaagcagttctaagcaattgcaatataaagtttagtaacattaagacacaatgaaatactgtgggaaatgctttaaaacagcagcagatattaagcaatactgtggttatcattatggttctgttctcttaagacaataatttagatgcttacaggggtgcaagtaggttatactaagcctttttgagtcaaggaataaacctacttcttgcaactttaaatgctttaattctctggtcagttcttcttggattatgatcagtaataattctcctggcactgcagcatcagtctctcacatgttggtaaatctagacttgggaagcaaaatcaatggtatgtttttgagacatcaagaaagatgtgacagcgcctcagatcctatgcactgaactactgtcccacactgcaatgaaaaaggctatagatgtttctcaataacttgtgtactaaattgagtaaagcaggttatttcacaaggatccaggaagcataattattactaagcattttcatagcagtcagtgtggttctaactgttcacaaaacataaagaagccttacatccaggctatggaatacaaaaggtaaactgaaacgtgctctatggagctaaaatattttcaagtttctcttaaagatattaaaagtgccaacacagagggtgagacagaccaaataaaattatttaaatagtctgcagaaactaggaagaaaaataaaaatgtaatagaaattggaaataaaaatagtgaacacatgcaaacatagcagcagccatactactaatagaaaacattacagaaaaattggggaggggtattaaataatcccaattatcccttaatactttgaggattggattctaaaacttagctgcaagattagaatccatataaatacctcaaagtgaaatctcatgggaataaggttagcagaaacatgcaaactcaagcatatcagatataactatacagactttaggataccagtagaaagaggtcgttgtcacacacacacacacatacacacacacacacacacactgagcaagtcacacacttatgatccattcttgtcattcattccaatgcacattcattaacatctcctatatgataagtatttttctaggtagctgaatatctgtaatactcttctaatgttaaaacttgaatggttattaattttttgagccatctggttccaaaggccactgaacaaagacatagttatagaactgtggttctctaatttaagatttcatggaaaagtacaatttcaaaaaatatttttaaaattactttgagatcaatatagaagtgccaactgttcctttagcaaattaaagatattacaaaataactgccatctactgtaactaacatttcctttttttttttacaaagggaaattttaacataatagaataggaagatcaaactcttgaaataaaaggtaattttccaagaaacaaatattgtagtcttcctatatttatttatttctcaaacacttatatagtgcttatgttgtgccacatactgttttaaatgcttttcaaatattagctcatttaatgttaaagatgacaccatgataaaggcactattattatgcttacaggtgaggaaactgagacacagagaaattaagaaagctgtaagttcccacaactgttatggtgaggttgaccttaggcactctgacccaagttgatgatcttaaccactcccctgcataacttctacataccatgctatctcaacatacatattcacattacttttaaaaaacagttttcttgagatataattcacataccatttgaagtgtacaattcagtcgtttctacaatattcaaagttatgcaaccatcaacacaatcaaatcaataacatttaaaacaacaggtccattaacaatcactccctcttgtcccaaacctcccagctgtcggaagacactaatcaactttcatagatttgtctattctggacacttcatataaattgagtcatacaagaagtagtcttttgtgacttgcttcctttactaagcataatattttcaaggttcatccatgttgtagcatatatcaatactttatttctttttatttctcaataatacctcaccgtatggatatatcacattttgattgtcacctcacttgttgataggcatttgggttgtttctattttctgctattataaataatgctactatgatcatttgggtaaaagttttcttgtagatatatggtatttctcttggatatatactagggagtacaaaaactgctgggtcatatgcagctctagaattaatgttttcagaaactgccaaatagctttccaaagagactgcgctattttatattaccaccaacaatgaatgaaaattccaatttctctctttctggaaggaacttgtgaaggatttgtggtcattcttatttaaatttttgttagaatgcacgagtaaagccatttgggcctgggactttctttgtgggaaattttaaaattagtaattcaatctgtttacttgttgtaggtctatttggaatttctacttcttattgggtcatttttggtagtttctatctttccagaaatttgtacatttcatgtaagttatcaaatttgttggcatatgatggatgaagtttgtaatcctttattattttattgatgccaaaattactgatagaaaaaaattctgctactagccagaagaagtaaacaaagaagacgaaattgacgtcctgttgctaatttcttgctctagcccttctcaaaatgccttctgtcatgatgaaaccagaaaatataaactgtgttctagataacaggcttaaagtcatagccataaagaaaatcagaaactcttttctaattaaaatataacagctaaattatcaattaaaatgtgtatgataaatattttctcataatcattttacaatgtgtttatttctaagaagactgtaagtgctccttagagggttaaactcctatttggaattctgctgactaaacctctaggactcttatacattgtattttcttatttatatttcagacttatttataaattgtaaatcagatcccaagaagcatcatatagtgaccccattatgaaatccagaagaagtgtgtgaggtatttataagaaactacaatgatatcttctatagtataatgattattacaggtataataaaacctcccgaagtagtttgaaaaagagggcttgctcccaaccactatgaacctgtagttaattaggcagcctctacctggaaatataaacagtgtctcatctttaggctgtaaaccagaatgacagcctagatcccgctccacatctcttactctaaactcaacaatgagaagcatcacatactatgtgagcatgcaaatgtcaaaagactccaggggtctcctagttcagccctctcagttcacaaaaaaaaaataaaactgaagcccagagaggccagtaaccttatcaatatcatacagctattagtctccaatccactgtgatcaacatctcactatagcattacccactttcttaatattttcagagtttgagggtgcaaatgcctccttattacgttattgattttaaaatatttcaatataacagaaaaatataaaaaacaacacatgactatgcccttagccttattagactttaatagtttattgtatttcctcttttcattaaggaatgaaacaattcatccccacacaaatacagccaatttatttttaacatcagtggaaaagcagttctgtagagaaaggatagtcttttcagcaagtggtgctggagcaatgcatacagacattcacagacaaattaaatagataaaataaatctcaacttgcacctcactatttatacaaaaattactcgaaatgggtggtagaattaaatataaaactataaaacttctagaagacaggagaaaaatgttaggacttagtgcttggtgatgagttcttatacagaatgacaacaaaagcataatttacttttaaaaatcaatgaattggacttcatcaaaattaaaaacttttgttttgtgaatggcccctgctaagggattgaaaagacaagctatagactgaaagaaaatatttgtaaaacaaatattatagaggacttatatctacaacaaaaaaaatttaaaccctcaaaactcaatactaataaaacaaacaatccaatttgaaaatggcaaaaagacatagacattttactgaagaagacatatggatggcaaataagcacatgaaaagatgttcaacatatctacctatgataggcagaacaatggctccctaaaaatgtctacacccaatcctcagaaccagttattctggcatggcaaagggggctgtggttgcagatggaattaagattgccaattagctgaccttaaaatacagccattatttcagattatttggttggggctactttaatcacaggggttctgaaaagtggaagacccaggcagaagaggtaagaatgatatgatatgaggactgaacccacaaatgctggatttgaagacagaggaaggggagccatgagccgaggaatatgagtagagcctaggagttagacaagatgaggaaacaaattctcccttacaacctgcagaaaggaataccaacactttgatttcagtctggtgaaaactgtgttagacttctgacctacagaactgtaaaatcgtaagtttatgttgttttaagccactaagtttacagttatttgttacagcatcaatagaaaactagtacattatccatcagagaaatgcaaattaagactatgataagacatcactacacacctctttgaactgctaaaataaaatacagtgacaataccaaatgcttacaaagatggagagaactggatctctcacatgtcattaagggaacaacaacatatggctgtaccataaaatggtacagcaactctggaaaatagtttgaaaactctggaaaatagctttaattttctttaaaaactaaatatgcatttaccatatgaccccataattcactctgaagcatttatcccagagaaaaagaattatgatcgcagcaaaacttatatgcagttgtttgtagtagccaaaaattgaaaagactaaaatgtcccacaataggtgaatagtttaaaaactgttacatccatatcatggaatactactcagcaataaaaaggaatggattacagattcatacaacagcttggaggatctcaaggatcaaagacattatgctgtgtagaaaaagagccaatttcaaaaagtcacactatatggtttaatttatataacagtctcaaaaagacaatattttatagagatgaagaacatattaggtggttaccagggattagatatggtggcaaaggagtgtggctgtgactataaaagcatagcacaagggagatcattgtagtgattggggctgttctgaatcttgattgaagtggtgattacacaaatctacacatgtaacaaaatgacatagagctacacaaacacatgagatcaatgtcaaattcatgactataataactatagtaatgcaaggcataatcattgggggaaactgggtgaatggtacacaggacatatctgtacaatttttgcaacttcctatgaatctttaattattatcaaataaaatgttggggaaaaaaacaaacaattccgttagatttgaaagcccagtgtatccttccctctctgagcccatttacctccttccctacctcccttcacagaaaaatcctacaattggtgtttaggatttccaccctcttttaattattttactgcctatggatgtattctttaaaaacataaaatattgttttgaatgtcctaaaacttcctagaaatggcatcaaataatattaatccctctgcaagttgtttttgtttttgcttaaatttatgttgctattatgttgtttattaaatttattaacattacccatgttaatgtatctcatggaatttatacatttcatctactatgctgtaagtccattgcacaaatatcccagtttttatttgtactttcttctgttgatagaaatacagaattttatttttgagtatcatgctatttcaaaataatgctagaataaacatccttgtgcatgtcccctggcaaacacatccaatcatgtttctagatatatgcctagaagtggaattcctccttcaagatatgcaaatgtttaactttactaagtaaagtcaaactgacttttccaattggttttaccaatttattcttatttggcactttcacactttaattcttaaaactggttggtatgaaataaaattttcctttttttaatttgcatttacttgattactagtgagctaaagcaaatatttgtgtgtttatcagccatttttttctgtcgattgtttgttcatatctttcacctatttttccattggattgaatttttaaatatttatttgaaagattccttcatacaaaatgcatattaatttttgttggttgtatatactataaatatctcctattctgaagttttttaaaaatgttgttggtgttatttgctattcaaaaatgtttgttttaatatattcaacctattattatttttctttatagtttgtcttttaacccacttatgcctgaggttgcaatttttttgaatttttgcaatcaggccttggcgatgatcttgagcagtaggataataaataactctcacatgcttagcattccaataatggaacactaggcgtaaatgggttttagtcttaagaaatccttccctgcccactggccacaaagatatttcatacattttcttctaaaaaacataaaatctttactattcttttcacctttacacctacattccacatgggatttaattattatatgttgtaagaaagggtacttattattttatttccccatgtgaataattatatctcctagcatcatttattgtatccttaccacactgatttgtaatacatccttagggacacatgagtctatttctaaacctagtatatttatttattgctgctccaatatcccaatgtcttaatcactatacttttacagtagctgttgacatgtggtagggctaatcttcccgacttcttcaaaattgtgttggttatgactgacgcttagctctttgtatacattttggaatcagattgatcagattgtcaagttcctgaaaacaaccaacaaaaccactcttgtgtgagctcttattagaatttataaatgaatacagaaagaattgaaatctttctgatactgagtcattctgctttaagtatagtatatctttctatttatcatcttctttgtgtcttaccttaaaattttgtaattttatttgtaaagatttctaaaaatcctttgttagatttattactacatgtttctaatttttgctgtattcatggtatctgcttttaaactgaattttctaattgtcttttgctgggttacacaaaggtagtttacagaattttctaattgtcttttgctgggttacacaaaggtggtttactttatatctagcaattttcctgaacttttgtattattttctaatagtttttcaatgaagtctctttactaataacaattaggtttctctcttttctatctaccttttatttatttcttttacctacaatgctggctagaacaaccaattaaacataagcagaacccgaagtcattcttctcttgttccagatgtacagggattatttccaatatactagtagctgtaatgtttccagtggtttccttactcaaacatgccatgttaacctatttattagtcttttcagggctttcagttttgttttatatattattaatacacacatttttcttttattatactttatatttgctttgcctactctctaagttcttgaattggatgctgatcttattattaataatatttactcctttgggagcaagatggtggaatagaaggccccactgattgtccccccaccccacaggaacaccaaatgtaacaactatctaggcaaaaatcacaccttcagaagaaccaaaaatcaggtaccagctcagctatggtgggttagggcaacaagcagactcttggggtccccagttccaaggcttgactcttgaatggcatttctggacctgccctgagccagaagggatgagtctcagacttggctgcattcaccacaagctgactgaagagtccttgggccttaagtgaacagtaccttaagtacggccaggtatctagggccttgccagatagtggttacagcaggccttggacaagacccagtgctatgctggcttcaagtctgacccaacgcagtctcagtgcaacaggcacgcttctgtcaccccacccctagccctaggtggttagctcaacatagagagagattctgtgtttgggagaaagtaacggaagagaacaataatctctccctggtaatccagatgattcttctggatcttatgcaagaataccaaggcagtacctctatgattctgcaagaaccacagcattactaggtttgtggtacccccgatgcagatatggcttagatcataatacccaagtacttttgaatacctggaaagtcttcccaagaagaatgggtatgaagaatcccagactgtgaagatgacaatacctaactcttcaatgtccagacactgacaaacatcaacgagcattaagaccatccagcaaaacatgacctcaccaaacaatctaattaaggcatgagaaaccaaacctgggaaacagatatatgtgacctttcagacagagaattcaaaataactgttttgagtcaacccaaagaaattcaagataatacaaagaaggaatttagaataatatcagataaatttcacaaaaagattgaaataattaacaagaatcaaatagaaattctggagttgaaaaatgcaattgatatactgaagaatacatcagagtctctctctctctctctcttttttttttttttttttttcagatgcagtcttactctgtcacccaggctggagggtagtggtgtgatctcagctcactgccacctctgcctccagggttcaagcaattctcctgcctcagcctcccaagtagctgggattacaggcacacgccaccacacttggctaatttttgtatttttagtagagacgtggtttcaccatgttggccaggctggtctcaaactcctgaactcaggtgatctgtccgccttggcctcccaaagtgctgtgcccagctggagtctcttaatagcagaattgatccagcagaagaaaaaattagtgagctagaagacaggctatttgcaaatacacaggcagagaagacaaaataaaaaagaataaagcatgcctacaagatctagaaaatagcctcaaaagggcagatcttagagttattggccatgaagaggaggtagaaagtttattcaaagggatcataacaaagaacttcccaaacctagaaaagagtatcaatatccaagtataagaaaattatagaacaccaagcagatttaacccgaagaagactaatgcaggtgtttaataatcaaactcccaaaagctatggagaaagaaataatcctaaaagcagcaagagaaaagaaacacataacacaatggagctccaatatgtctgtcagcagacttttcagtgaaaccttaaagaccaggagagagtgacatgacacatttacagggcataaagaaaaaacttttaccctagaatagtatatctggtgctaatatccttcaaacatacattgcctataataaacacacttcacctataaacacacacagactgaaactaaaagggtggaaaaagatattccatgccaatggaaacaaaaagagcaggagtagctatacttagacaaaatagacttcaacacaaaaactgtaagaaaagaaaaagaaggtcattatataatgataaaaggttcaattcaggaagagggtataacaattataaataggtgtaaccaatattggagcacccagatataaaaagcaaatattattagagataaagaaacagacctcaggaaaataacagctggagagttcaacagcccactttcgtcataggacagatctcccatatagaaaatcaacaaagaaacatcagacttaatatgcactatagaccaaatgatcccgatagatatttacaggacatttcatccaatggctgcagaatacacagaatacacattcttttcctcagcacatggatcattctcaaggacagaccacatgttaggtcacaaaacaagttttaaaacattcaaaaaatttgaaataatatcaactatctcctccaaccacaatggaagaaaactagaaattaaaacaagaggaattttggaaactaaacagacacatagaaattaaacaatatgctcctgaatgaccaacgggtcatgaagaaattaagagggaaattataaaatttcttgaaacaaatgataatggaaacacaacataccaaaacctatgggatacagcaaaagcagtactaaaagggaaacttatagttttaagtgcccacatcaaaaaagaattaaaacttcaaataaaaaaacccaatagtgtgtcttaaagaactaggaaaggaaagcaagagcaaaccaaacccaaaactagtagaagaaaaaataataaagttcagagcagaaataaatgaaattgaaacaaggaaaatacaaaagatccattaaaaagtttgcttcttgaaaagacaaaatagattaacctttagccagattaagaaaaaagagagaagacacaaataaataaaatagagatgaaaagggagacattacaactgagactgtagaaattcaaaggatcgttagtggctactatgagcaactaaatcccagtaaattaaaaaatctggaataaatgaacaaattcctagacacatacaacctacaatggctgaaccaggaacaaatccaaaccctgaacagaccaataataagcaacaagatcaaaactataataaagaaatctcgcagtaaagaaaggctgtgtacctgatggcttcactgctgaattctaccaggcatttaaagaagaactaataacaatgttactattttgaaaaatagaggaggaaatacttccaaactcattctacgatgccagtattaccctgataccaaaaccagacaaagacacatcaagaaaagaaaactgcaggccaatatcactgatgaatattgatacaaaaatcctcaacaaaatactaacaaaccaaattcaacaacacattaaaaatataattcctcatgaccaagtggggtttatcccagggaagcaaggatagttcaacatgtgcaactcaatcaatgtgatagatcatatcaacagaatgaagaacaaaaaccatttcaattgatgctgaaaaagcatttgataaaatttcacatccctttatggtaaaaatcctcaaaaacctatgtatagaaggaacatacctcaacacaataaagccatatacaaaagacatatacctagtatcacactaaaggaagaaacactgaaagccttttctctaagatcaggaacatgataaggaagcccatttttaccactgttactcagcatggtactgaaagtcctagctagatcagtaagacaagagaaaaaaacacagggtatccgaattagaaaggaaggagtcaaattacccttgtttgcagatgatatgatctcatatttggaaaaacctaaagactctctcaaaaaaatattagaactggtaagcaaattcagtaaatttacaggatacaaaatcaatatagaaaaattagtagcatttctaaatgccaagagtgaacaatctgaaaaagaaatcaagaaagtagtaccatttatgatagctacaaattaaataaaatacctagaaattaaccaaaaaagtgaaagatttctacaatgaaaactataaaacactggtgcaagaaattgaagaggacacaaaaagatggaacgatatcccatgttcatggactggaagaatgaatattgttaaaatgtccatactatccaaagcaatctacagattcaatgcactccctatcaaaatactgatgacattctttacagaaatagaaaaaaaatcctaaaatttatatggaatcacaaaatgcccagaatagccaaatctatcctaatcaaaaggaacaaaactggaggaatcacattacctgacttccaaattatactatagagctatagtaacaaaaacagcatggtattggcataaaggcagacacatagaccagtggaatagaatacagaacctagaaataaatccgtacatctacagggaactcattttcaacaacaatgccaagaacatacattagggaaaggatgatttcttctataaatggtgctggaaaaactggatatccatatgcaaaagagtgaaacccaatccctatctctcaccatatacaaaaccaaaatggatgaaagacttaaatctaagacctcaaactatgaaactactgaaagaaaacattggggaaactctccaggacactggactgggcaaaaatttcttgagtaatgctccacaagcacaggcaaccaaaacagaagtggacaaatgagatcacatcaagttaaaaagcttctgcacagtaaaggaaacagtcaacaaagcaaagagaaaacccacagaatgggagaaaatatttgcaaactatccatctgataagggattaataaccagaacatataaggagcacaaacaacactattaaatctaataatctaatttaaaaatgggtgaaagagttgagtaaaaaattctcaaaagaagacatacaaatggaaaacagatatatgaaaaggtgctcaacatcattgagaaatgcatatcaaaactacaatgagatatcatctcactctcattaaaatggcttttatccaaaagacaggcaacaacaaatgctggcgaggatgtgaagaaaatggaacccttgtatgctgttggtgggaatgtaaattagtacaaccactgtggagaacagtttggaggttcctcaaaaaattaaaaatagcactaccatatgacccagcaatcccactcctaggtatatacccaaaagaaaggaaatcagtatatcaaagagatatctacactcccgtgtttattgtagcactagtcacaatagccaggaattggtagcaatccattagcagattaatggataaagaaaacgggttacatatacaaaatggagtattattaaaccattaaaaagaatgagattctgttatttacaacagtgtggatggaactagaggtcattgtgttaagttaaataagccagacacagaaagacaaactttgcatgttttcacttatttgtgggagctaaaaattaaaacaattgaactcatggagatagatggtaaagggatggttaccataggcttgtaagggtagtggaggagggagggaagtggggatggttaatgagtacaaaaaaaatagaaagaatgaataagacctaaggtttgctagcccaacagggtgactatagtcaaaaataattcaattgtacagttttaaataactaaaagagtataattggattgtttgtaacacaaaaaataaatgcttgaggtgacagacaccccatttacaccccatgtgattatgatacattgcatgcctgtaccccatgcctgtacaaaatatctcatgtaccccataaatatatacatctactatgtagccaaaaaaattaaaagttaattttttttaatttgtaccttttttcattttcttatataggcatttaaagctataactttctaactataactttcattgcttctcatacaatatttaatggatgaatttaattaatattaacattcagttttaaatattttctaattttcattatttttttgcttgactcatgagttgtttagacgtgtgttgatttaatttcaaatccatgtgggattctttttgttgtcttttaatttaaattattaatttaattgcattatagtcagatactgcctcttcccaaatcttcctgtgctctccttctagaaggcctatgaaacatatattgaatcttatgctctccaacatgtctcttaacttctttttcatatcttctatcattttcttttcagtgccttctggttgatttcttcaaattatattacagtctactaattttctctccagctatatctaatttgtttaacctatgataaattattaatttcaattactttagttttcacctttataaagtgtgttctttttttaaccttattttttcttatatttataattcatttatgtctctatcattttcaatattcatttttcatagtctatgtgatagttccatcacttttaggtcttattctaatcctgctctttgtgtttgctaactctcacttgtgggggattttgttcttatgttttatagtttgaggttgtgagttaatctttagaagatatttatgtttaggaatcttgtgaaacttggttgaatggtatctttctcctaagaagtttgtaacagattctgccaggtgctttagaagtatcagtaatctgggctctctgtagttaatttttcaagttgtgatttttccatactacacaagtagtacaaattcaattcccaaacctaaatgaggtacaaatccatagagatgtgtttttgaaggagacattctttttctaagacacagcttccttgtctcttctgttctgatgattttttttcagtcctttccattccaaggtcacaactttgtactgaagatctctgttccaacccacagaacctcaattttccatttcatatctcaagccctttgttagtgagactaataatactgtcccaaaggcagccacagtatcaattcaagtgtttatccctggagttttcaattcaacctttacttctgacccatagtaatgattttatttcctttcaagattagacatgcagtatttctaagcatccgtagcagggatgatagtaagattattagccatgtttctagaactgttagtaaaaagtaacttattttctctagtaaaaatcaacttacagcacaattggcaagctgaatccttgtaatttaccaattatgaaactttttcagttcacaattatattatccaaagcttgtttgatcccacttggtcccagtttcagaaaaccacatggaaaaaaatatataataattataggtgcatacatagcccctagctacaactagaaacattacactgaactttacatggatccaaataaatcctttaattttctggattccctctgaagcccatcccatcacctttttctagagtcctctagtgcttcctctctctcctctccctctctctcacacacacacacaagacagagacagagaaagggagagagatcatttttcatataagtgttcactgcttactgtcaacaagttatatggcttttcttcttcctttccattaattcaatacaacttgtctaagttcctgctgtgctctagacattggagatgttgccaaaaacaaaacaaaacctttgacccacagggtttcaatcatagtatagaagaaatacaaataataaacaaattaataaatatattttagtttgaaccaaatgaaatggccaatattcagctgttcttgatccacccaaaagcaatttcatatggttcaacttgatagaatatgacaggtggtgctacgtgctgtgaagaagatagggtaagtggagagaaagtcatgggtgcatgtgagtgtgctattttagatagcatggccacagaacctctctttttaagtgctatttgaacagatgataatggagtgagaaagtgtgtaatacggatatctgggggaagaatattctaatcagaaatgaaggtggaaaggccctgaggagggatggcatataaaagagcagcaaggaaacagagggacctgaagggagcgagtgacagtaagagtggtgcaagataaggacagagaaggtcagggccaggcccaagaatgccatgtcagccatggcaagacatttgatctcactcctcatgagttgggaagctgttggcaggtttgggcagaggagaggcaaaatcagacttgtattttcaaggatgtggaggccagcctccaaggagcaagatgaacagaaggggcttaggtaggagatgactgctttcatgcaagagtgagaccatggtaacagactcaggtggtagcaaaggaaataggacagactggaccttcacaattctttcatgacctctcttatctttctttttaaaaagtatatttgtcttatcaatttcttattcccaaacaagtatatttccaagcttccacttcttgcccttggttggtattggtgtcaaaatcattttgcctgcctgcttcgatagcctgctttccaacaggaaacttctaaatctctttacattcagtgctccaaaaatatacatttgcacttcccatagcctgacacatctgcatcatcccttttgttcctaatcactctcagaacaacagcagcatacctgattgaggagcagctggcattcactgcgcaaagagcaccatcaaaaattgagcatgtggctccaagagccaccactgtttccttctgtttcttgccaaagactgtaacttgtgggtaggctgggcctgagtgatagcaggaaatggcccactgccatgcaaagtggctcctctgaaaaaacttttaaccatatccctgcagctggaccccttcctctgaagtttctagatattgcaactccccaaagaggaagttgtctaagggaggtacaatgctttagggagaaactgaccacagcttaatggcttgtgaatgcaaccactgcaacttctgggcccatttccctctcatgcccacacagggctgggtgtgttctattaaacatttaggtaaaaggaataagtaactagctcagcaatgtcagcatcatgtcaccatggcatgacagaaactcagttttctgactcttagtgaaatggatcattcaagagtaaagcattaaaatgtttataaaatacagttggtccaagaggacaagttgtgtcaaaatcattttccaagacacctcatgttttaaaaaatcctaacatgtagcctgcatgcaatatgcaaacaggctgctaaggagaggacatgacattaaaatgtcagtagaattactgctcagctgtaagaactcacacactttagatttaacagcagtgagtttacattgggtcacaagaaataggatttaaatgaatattccaaacctattttctgaaaatgcattttgcaaagatacaggtaggcatacctacttctgaaaaaaaattcatttgcaatagaaaatgggatgagaaaacagaaataaaatgtattcatcacccttgtcactcctctattttaaataaagcagaaaccacacataacattccaggatattaagctaggtatgaaatgatgttcagactactaaggctaaagattacagccataattcaatctgatattaaatgcatttatgatgccatataatgtgggagacatttaaaatgactaccaaaatttctactaatatgaccttttcttgaattttattgttaaaaatccttttctgccaaaatgtcaaggtttctcacagtgcttctacatacactgtaaccccagtaatagaaaatgtatattttctgtagacactggggctatcatcagacaaatttattctgctgaaactggagtcaacattaaaagagttttttgcagcataggtattttttcacttataagttattactcatttttcctaatactgtgcagataatataacaacaatattgaaggttttttttaatatttgaaaattcattgcacataaaagcatgctatgctattgttcctgttttaggtccccagtccctgatcaaagatgatatacatctctagaggcagctaggaggtgtctctaagctggtaatagtcggggttggatttgtctcaaagcagcaaaaacttgtaaagatggttctgcatccctaagccttctctatctgataactttgattattttcaagtataatcatgtgccatataatgacatttaggtcaacaatggaccacatactacagtggtcccattagattataacgaagctgaaaaattcctatagcctagttattaatataccataggcatagtaatgtcataatggaaagcagtacttatatgtttgtagcaatgttggcataaaaaacctactgtgctgtcattcatataaattagagcacacacaattatgtgtactacataatacatgataacaataacaaataatggttactaatttatgtgtttactatactttttatcattactttagagtgtggtccttctacttattaaaaaaatagttaactgtaaaacagcctcaggtaggcatatcaagaggtattccataagaaggcatggtcatcagagacgatggcagctccttgcatgttattgcccctgaaaatcttcagtaagacagggtatgaaggtgaaagacagtgatattgttgatactgactctatgtaggcctagactaatatgtgtatttgtatcttagttgttaagaaaaaagttcaaaaaataaaagagataactagacattttttaataagaagcttatataataaggatacagagaaaggaaagagaaaggaaatatttttgtacagctatatggtgctttacgttttaagtagtgttattacaggagtcaaaattgttaaagataaaaattagctattaattttttattgaagaaagaaattttcttaacttttaagtttaggggtacatgtgcaggtttgttatataagtagactcatgtcatgggggtttggtgtacagattatttcatcaccaggcattaagcctggtacctgctggttattttcctgatcctctcccccttcccactgtccatcttctagtcggccccagtgtttgttgttctcctctatgagtccatgtgttctcatcatttagctcccacttgtaagtgagaacatgcagtatttggttttccgtttctgcattagtttgttaaggataatggcttccagctccatctatattcccgcaaaggacatgatctcattcttttgtatggctgcatagtattccatggtgtatatgtaccactttttatttatccaatctactattatcgatgggcatttaggttgattccatatctttgctattatgaatagtgctacaatgaacatatgactacctgtgtctttatgatataatagaatgatttatattcctttgggtatatactcagtaataggattgctgggccgaatggtaaaaaagatatttttgtaaatttagtgtaccgttaagtgtacagtgtttataaagtctatagtagtgtatagtaatgttctgggcctttatattcattcaccactcactcactcagagcagcttctactcctgcaagcttcattcatggtaagtgtcctatacagaggtcactttttttcctcttttattttgtatttttactgtgctttttctgtgtttacatatgcttagatacaaaaatgcttgccattgtgttacaattgcccacagtgttcagtgcagtagcaagctgtacaggtttgtagtctaggagcaatagaatataccatataacctaggtgtatactaagctataccacccaggtgtatctaagtacactctacaatgtttgcacaatgacaaaattgcctaatgatatatttctcagattgtatgcctctcattaagtgatgcatgactgtatttaggttagatggatatgtaagctaaaaatacatgggggtggagaattttgcattaatgtactttttaaacaaagaaatatatatttatcatttatggatgaaatagtttctttttaaaaatgccattccaattggcacaattaatattcaaaatttcacagcacacttttttacttttttttttttttttggtcaaacattagctatagactcactccagtttatttagagtctttctaaatatgttttaaaatacctgaagttctacaaaaagtggggagcctttcaaatgcatgataaactagggtcagtaggttttggagagttgaaagacatttgaaaatatggtagtggcaatggcaggggtatgggctgataatgagacggatagaaatgaaggatgctacaccattcaggattaaaattcaacattagttcaagttttaagacttttactcctatggaaagagtggggaattggagtaaaatccaagagagcaggaactgtctagaagaaaattagcctgcccaatctctttggcttgtttcctcctcctcatggatccctctctattgataaattttaagtagtgcctataccacacataggctccattttccatcccatgccacatctcgagggaagagctataggaataatacacataaactagagtggaattttgattcctaccacttggaacttgactagaatgttgaacaaaccagatcccatttggtgactgtatacattggtggaggaagtcaatgctttgaaaggccaataatcactggactgaagaaacaatttaccagcaacggtcactattagttatggacagcacaaaaaagaccaaagaacatcagtacccaaggccaatttatggaaactaactgaatggcacaaaatcaaccagaaggagcccacggttctgctgacggcagttgctctgcaggtttcaaccatttaatttttgatctgagctcctacagcacaggctctttgcaccttgccctagagaatctgagtaaatgcgtttttatttttagatgttttctctcttgacatagggttccacaaatatgaaagagcaagtcatcccccaggcatgctagaagttgttgttgtctcttttctctccctctgtggtctcctgcaatcacttaaaataataatgtgccaagaaatgttttcctacagaacaggccacttctcttgactggccctaaaatgtatgtgtgttaaaaggattgagtcttctttggaatattaggttgtccctttttgatgaattgaaaggtgttccagacttgagaggctatctcaattttacagtaaacagctattttatgagaaaggaaaaaaattccatgaggtgtttttaccaaaaacgcgattattaccagcctaacaaaagaatccattgtgaggagaaaaagcacagccaacttaattaatatcatttacaatctttacagatgctcacacaatgccacatacttctcatgtctacaatgagtactaaagtcaagagtatgaaatcaaaaggagctaaatgtcttcacagcttctaaaataataattcaaaatgggactgtcggtatttcagaaactacatgtcccagattaacctataatattgggacagagtaaagggaacctgattcaatgataaattacccacagaactatgtggtgtgataaattgctaactcaacaaagccatcaacatattatactttaagaaagtttcttgtttctgaaaagaatcatcaatcaaccttggtacttagaagagagtatcttagatatacctcttctttctatgcccttctaaaattatttttagctagggatgataaccaaaagataatgtagcactgtcaaagtgaagacactgatgtttctcaaaggagaggcattgctatgtgggagactacttatgatccctttgttcttgggctgtagtcccttgttggctgcagagtccagggttcaatcagagatgttcacattataccaagaggcaagagatttctttccttcatggtttcatgacaccttttaagatgctcaattcatgcttatgccagcaaccctggcccctaaagaacacaattagaaatacgttgttctgttcatattcagtcaaagatgctatcttgtccagcccctgcctttaagcaagtgaagcattattcattccacttaatagctgaaagaagtggttccaagagcatatcttttgccagaatccatttgccctgatgcccaatccaatgtgtcttctgctaaagcaaagccaacagcaattaatagacagggtttttatggtgtcccttcatataatcctgtagccataacttgattgagtttcaaaatcatctaggtaaaccatgagcaaaatcgtgtgtaaaaatcatgtagaatgcttaaagtgcaaaaagcaggagagagttgttaatagcgcagactatgtcatcatgatacttagacatcatctgattaagccagtaataaaatgtgtaatcttagaaagtgatttaccctttctgtgcctcaggttgctaatctatgacatgagaatattaatggtatatacatcataaggtcattgtaaaaattaaatgagaaagcatgcagttagccctaagtgctgtacctggcatataataaatgctcaattaatacagctattaatatacaatgagagtgttcattagcaagtactctcattctcatagcaaatacactgaaaaatagcatcatggcttaaatacttcataaagaagaatactgctgcctcagtttacactttgcttccccggctcagaagtgtcatatttacactttttcttgctttgagtttagtaaccatctcttcatatcaagggatgaaaatgactatcattgttcaacccattcagctgagattagaaaaagatttaaccagggatgataagcaaaagaaaacgtaccattgtcaaagtgaagacactgatgtttgtcaaaggacagacatcactatgtgggagactacctatgatccctttgttcttgggctataatttcttgatggctgcagagttcagggtttaaccagaaatgttaacattataccaagaggcgacttgaccaacactactaactcattggaacttctcagaatacacaaggaatccctcttttatatgtcacagtaactattcatgactcatttattatatcctaaaaaacttttcagtatctcaaaatattggtctttggactcagtgagaagtgggttcaaatcctaactgcagcttactagctatataacctagggcaactcacatcttctctatgagcctcaattttcccatttataaatggacataagtataacatagtatattgttataagaagtaaataactcattcatacttaattactctctatcaacatcatcattatcaccaactactcaaaagtaagtatggccaggtgcagtggctcacacctttaatccaaggtgggaagatcacttagctccaggagtttgagaccagcctgggaaacatagtgagactctatctccacaacaacaacaacaacaacaacaaaggaataagcttaagaaaacactatgcaacatattttccaatgtaacactggcaaatgattcctcaaacattgtgtctgtatatctttttacatttcttcaacttgatggtgtcatttgaattataaccttgatgtttaacaagctcatcatctccctggacacatttgttgtcaaagaaagagctcacaatttcagtattgcatttggaatctcagaatttaattttacaaataaaaatcagatgcatacaattcctccatgtatctttactaagccttatatggactctcttgagagttatcaccatcagattttgctgttgctccaggtggccaaagttgtcctctctattccaaactgttgccagaagttggtctacatgcagagttccaaaatcacataatccccaaactcaaagatattacttcaaacatcaccatcagtaccactactttataatgggtttaattatttttaagcatggcctcatcagaggttttaaaatatctttaaaagaaaattttgtgaaaccacttatttatttaaagattaagggacaaacaaaaaatataatcacaatctattttattttataaatccttaatttgtgattttgtttaaaatatgaaatcaataaccctaaactcatgtgtccttcaattacctggaaatatgatcacaatttgaatctcatgaatgttttagaacgaaagagaatcaaacaactgcatttattagaaacacattgcataaaaaaaatttctagtcaacacactggaaaacataaagaatgtaaaattagtcctaccttaaggaaataatacatagacatacccaagaggatttgtaaggcaacatattttgaatatgtgagctgacatcatgtggaggagacagaactgaagaagaaaattgaggaggcaaatgtcgaaagaagtaaagcctccactgacaaacaagaatgggtttgcttcttgggaagaatgtatgtgcaaacatactgaggtagagacaagaaagtttatttctaaagtgtttaacaatattatagaatccaaaattcatgttgaatttcacatacgtatatctacacacacatacacacatgcacccacatggtaactatgtagaagtgatagatatgttaattagctggaatgtaatcatttcataataaatacatagaataaaacatcaagttgtacactttaaatatatacaatttgtatatgtcaaggatatctcaataaagctatttttaaaataaaataaaattcacacagaaaagatggccaaaaagaattaagatttacttctgcatgtaataagaagttattatagagtcaaagaaagaaaaagaaagaaagaaagaatgaatgaaagaaagaaagagaaagaaagaaagaaagaaagaaagaaagaaaagaaaagaaagagagaaagagaaaaaagaaaacacaacaaaatcatatttggaaaaacctcttctatcctcaaatcatttctacacaaaactttcgctattaaggtaaaagagctattattttctttgctataggacaatttttgtggcagcggcgatatctgaactattttcaagtatttcatgcaagacaaaaaaagtattaaaaataaaactatctgcatgctttgatgtagtttgtaaagtgtctgtcctgttttcaaaggagcccttagcttatgatgtatctgaaggcatttagcatttagttatctgataaaatgacaaaggactgaaatagactgcagagatcttatattgacttttgttacatccagggatttgagaggtgaagtcatgctagagaaagcacttctgccagtagatgctgacagattcagcagctcctcagacaaaatggacatttctctgtcaatatgagtcctcaactctgtgaagtgtctcaagcaatcccagctgcagaaggatgtctgcagaaggatgccaagtacagacacaatctgtcccctctcctaaaatgaggttgattctcattattcttaaggagtcacagacaagctgttatcaatttgctcaagtgaggagcaaaccatagcgagctgttgcgacacttaacatctaggaaagcaacataaaccaaatgtgcccacagccccaacgtaccagcaatttctggacctatctaataatagttgagacaaagggaagaatgaagcctgccacacacacctcactcgccaggccttgcttttgcaataatgaactaacagaaagaggggactgtttagtaactcagctccctcctcattattgcattgcaaaacagtccacagaacaagctactccagctgcctgccgatggtgattttaccctgtttcatacactatccttgggcatcagcaatgcagtggtgtgtgaatatacagtccctgcaggaaatagcatgttttatggaatgaagcattcatacaattcaataagaaaaataaatagaaagacataaatggaccattcacaaaagaacaaaaatgacaagtatgagaaaagatttgacctcagtaataagaccaaaaaataccctcagaaattaaacaaaataataaagcattttcccattaaaatcagtcaatattttaaaaagtaaaaaaaatgttctttgctggtgaacttgcaatgaatttggaatgttcatacattgtttgatatagcaaatattgacacatacttttgaaaagcagtttgccaataagtgtttgatgctttgaaaatattcaaaaggaaaaatataaaaatattcctgtttaaaaatgtctactccagctcttgcatataaataaataaataatgaaggcaaaacctcataagaaacataataataaaataataaatgtttaaggaaaccatgcagaaacaattaaaaattctgttagtgaaaactatattacttaagacttctatgattttaaaaattttattgtaaaaatatttcctatatacaaaagagcaaatataactatcataaacactttctataacatagtttcaaatgaaaaaaatcaggacacaaaattatatatacaatatgattacaactatacataaaaattatctttgcaggaaatatgtctagagagaaataacctgaagtcttaacaatggctattctttggtagtgaaatgatagggttttttcccctactttcaaaacattaatttctgctacatataagctcatcatatttactatctctatcttcagatgctaaattggaaaaaatgtctgagccactatagtcatctttttatttttcaacatttattgagttcttcctataattataaaacactaggtatcaatggagaaataaatgtatataagacatattttatgctttccagaagcttataagaaatacaacaggtaatggaacagcaaagtagaaaaacaaactcatcataaatttaatgaattgaatttgtatgtacacagtggcattgtacaaggtgaacgatgaagaaaatgtcgtggcattttgtccattcctcatatattggtaatctggacaaacttctccaattaataatttcacattatcagacagaatcaaggtaataggcaaatttatcgagaccaaagaaagaagccagtaagaaccacctgcaaagctgtactctgcccttttttaacctacctgtggttatctatgagtaattttattcttatgttatctttataaccttagaaactcacagattcctgatcatagatatcatcttgactacagtttccactcatttcaaaaattcactctataataacattttctgtgatagggaagctgaaaactttcaaggcagtgccttccacttatggacagtttgactcattctacacatcttccaggtataagcacaggaatagaccctctttacacaaggcaaataaggaaaggctcctgccctcaaagagttcatgatgcagaaaggtacacgtggaatgcataaactcatccacagtcaagagccctgagtgacctcctgggtgttttactgtatttctgggatgggcaccaaggaaagtggctacttctgctttgcagatgagcctggtcaagggttagcggcactaaagcattaaaaagagaaaaaaaaaggaactatagttgtatactttcaggaaacgcctcttaaagatctgaagatttacaattcttttttttttaagccaaaatatgtgaaagactcacatgcttcagcaaagaaatctatttaggttcatttaatctttgcctccccatcccctcccaaccaccaccacctatttttaaatgggaccatttttcatgttatatctgttaacatcccatggaaaacccattggaaaaagctgctctgaatctggccacacatctgatagtgataaactgaggctcagaggcctctgagctcagtaaattacccgcccaaagtcataccagtagctgtgacagaatcatggttggagcccaggatactgagtcatatccatgctaatcctatgtcctatacatcatagaccctgtcacactttttattttttaaaaaaatcacatattttggatattaactgacagaaccagcatattttaacacagagcaggggaatactagcaatgcaaagagtaggcaaaaaatatgaaggtctaaagtgaatataagtcaacaacacaacatgaatttataataaaagaaacttataatctcaatctggaagagagaagaccaaccagtcacaattaagggactgaactaattgttccctaaggcggtcatgttctctaaatatctgtcaatctgctcaagtgccatgtaaaatgactttacatggatgcagcgctgtttatataaagttgatcatccctatggagaagatgaacaatcaaaataaacaacagagtccttctctgaaaaccctctaatttcacaatgagttcctaagggaccatgtgtcttctgtactagaagtttcatttaaaaacaggatagattaacatctactgggaaaggtataagaatagtcttgccaaaaggaaaagagatagacttgataaaatttcaaagtcattgccaaccttacaagacagcctgtgagtcagaggatggccatcctgtttatatgccacccagagactgtctctcattctccttatttttctcatattttgatcattttattgtttactggaattttgtctaccctatgggaagacataaaaatgaaggaagactggaaacattattatattgaattctttgctagagatatttattttattgaacataggatacaataggagaaggtaaaaattacagctaaaatatggtttagattacatgtgcattgttccataccatttcttgatcaaattagaaacaaccttgaatgtttggatggtaatcactgaccaggttatgtttgagaagagttgctttagttaattttccaaacttagattttcagaatcaattttcctacgccaaatcagacctgaaaacaatttgaactgattctccttctcccttatatcttccccctacatctctttttgtaatctgcaactaaaaggaagtacttctgagaaggctttagaggaatttcaatatgtaattaaattggtacctttctattccatttaacttttaattaaaataatataaaaacaatcacaacactaacatttctttcatttaaaataagaatatgtatgtttttggcttatctgaattaattagcactgatggtctttgattacttttgctcataatgaaagaaagaggtgggctgagtttagcacttacaacctaaagataatgcccaaggtttaaattttaatgattttttaaaaaaatcaatttgcattgatcgggcttaagtcctcctgtaagtactagtcaaaaataaaagtctcttcaattaagtattatcagaaagaagaaattaccaatctcctgggccacaagtgtgcatgaaacagataaaaatgatgtttctgcagtttgttatttccttgaacatcccccaaccctgtatcctgcatcatattgaccagaggaagtgaaatccccctgtgacctgttggcactaatcatgtcccataactaggcagttgacagaaccaaatttcagtttgtgtaatacttgagaacttacccccaagtctttctagtctcttcaccaaccttctacctcagcgtaagaaagaacaggggagattataagcaagctaaagtccttctaatctaccctcaccacccacaaagcctactatcacctggatttggcaataactatgactgaattacggccctgaaattgaccccacgaaataacaccaatgtagaatggttagtcaactacacctgagttgctcccgtccctcaaacactggaaagaatgcttggtctgataactaatttaaattatttttgtagttggaccaaaagaccttgggcaaacataaatcaaaacatgagcaaaacacagcttttaagaacagaaacttttggaatcaggcaaacttaagttcaaatcctgacacttacacttgttctgggaccttagacaagtgtacttctgagcctcggcttcttcctgtaaagcagggatcctggtagttcctcacatgtcagtacttattcagtggtaactattatcatcactgtcttcttagcagaacattcccaggacacagaaagcctctctttattttacacccaatatcctgcagagaaggtgtttcctgccctgtgacttaaccttaaaatacaatgatttaacaaaagtacgtgatgagactaagatctccattttcagcataattgaagtcacattacagaaactagaaatcacttcataaaatgcactgatgatgtacatttatttttcaacactactttctagctttgtcagcacaacctcagcgagggttcctcccatatgacagggtattgtttcacactaagggtggggataggggaagggttagggagaatagagagtggagaaaaatgcagttggaatcaaagtaaggtttgcctcaactttctaattatctgtactttgggaaccaccacctatttgtgcaagaaggaaaggcagtttggataggggaggaaaaagagcagcaaaggagaaatcactacatattataaacaaaaactcagtcttcacgattgacagcttctcatgggacttccctggggagccaattagtgctggttgctgaagtgggtttggtcctataaacctctgtgctaacgcccacctgtgctgcaccaacctccaatggagccgcaaagcctctgttaatgaggcttaggaccaatcatcccacagagagagttctgctaagggctccaaagcagatgtcttagggtaaccgtcagggaatctcccttaaattccattgcctggttggaaactaagacattttaaaataatgatttgatttattctttctgcacctctttttctttgttccttaacacctgagacaaccgtgaccacagcctccatgtaaattctaatccattgcccgtctagcggctgggtgacgccacaaggagcagagaagaaatctaggcaaagaacaagtgacaattagtaacatctctagaatcattgtctccagtagcagtgggagatgcagttaaaactagctctacacaacagttaaagcagagtttagcaacatctgggaagttgcctgattgctcttgcaataaaatgcttcatggtttctgttgcttcaatacacagagctcaggaggccttgtgaacccgtttaatgtaagctcaaacaaactgacaccagttttgttattttgtctcctatgaacaacattcacccttatagaggcatacctacctggttcctgctatcaaaaaatcaagcaatgaaaacctattatgaaaaataaacacctattatgagcagagcactgtataaggcaccctggaaagaaaagaaaattcctcaaagtccttggctttgagaagcaaaaattagtaaaattaataccagtgacactacatgtgaaaaaataataaactaaataaaaataatatcactacatgtgaaaaaataataaactaaaaataataaataccagtgacactacatgtgaaaaaataataaactaaaataaaaataataaaataaataataaactaaaagggatttctgaaaaggagacaaaaagataaatgaggcaacaattccccagaaaccagatgtgaacttaactttttaaatggtgagacttagattggaggaatgggcaaatatatgaaaacaaagctttagaagtgggaatgcacaaaatatgaagcctgaaactataagacccaatgatctgaaaaatgctcacattctcctcaagctcaaatgttcatgaaaataaagggaaataaaagatagtttcctaaacctcatgtaggccaaatttttcctgacacgacttgaagatggctgagaaaaaaatgcctgttgattaatttgactgcaatacaaacagaataggacagtaccttggcctagctatagccaaaacaatcacaaaaacactagaatgaaagctctctgcctccccaggccccacgctctcattgttgctggtaacagccatctacatcaacaaatcagaattggagaagatagcccagagaacaaaagagggaggcactaaagtcctttcacatgtactgggtaagtggactagaatgtctcagaagatgtgaagtacagttggttgccaaattcagcgacatctgtcaatgtttatctcaagaaaagtacatcaatctaacactgagatggcactgaactgggggtgtgggatacatcctaaggatctgttattctctttggcttgcttgggacacctctgaggttggaagaacctggagaagttagaggtgacgtgcacaccctgctcacacccctcattccatccctgattatggagtgacaacattttgcaagtgagaggagaaactatttagtggaatctttactcagaaagaacccttggaattcactcattcatttatccaacagatatttatcaagtgccagggaacactgtgctggacaccaaggatatcatgatgaaaattacaggcatgtttccttctctttgtagtgtattacacgagagagggcaagtggttgaaaagtggaaatatagttatacatgctaggaggctagaaaagctgaatgcagtgtcttctttaccccattggtgagggaggagttcccaccctagaaatatggggatggccaaccacatgacactcaaccttaacagaggagattaatagcagttcgctagtcatatctactcacagcccaggggaggacaatgcaccccacacaggccacacaggggccacactcaggaaaggtgaacaggcagggcctatgtgaggctggttttgaagtaacagaagggcaaggtagccctggtccccacaagaggatgtgactggcttgtttgaataattccacaggctgtgagggaaccaaaacccactcctcagggataagcagatactgggcctggtcctcaagataaggaaagtcatttggctaggagacctcacccacaggagcacaatggagagggaaatttgtggtcaggctgtctgatgagctcttggttttaccttttacctctcttggaaccttaattccaagccttaacctgacacagtggcagagcagagaatgatttataggctgcctcaaggtccaccctgggattacagatggctcaatcaggaggccttagctggtgggaccctagactagaaaaaaccctttttctgttccactcccactctgtacctggcaaaacagctcaagcacataaaaggggccagagtcacctgccattaacaccttgctccttcaaaaaatgctgtacttgctctgagacatcacacctcctgccaagctgagccccgagtcagggcagaggagagcaaggtgattctttgaagcagcctctctgacaattgtattcactacaaagtcaataaagacataaagccccatttacattagtgaacataagttcacaagaacaggacagaagctacagaactgcaaagagcgttggtccctcctgagatggcagacagcttgggagaagcagctgtccacagtagaaggaagaaggtgctttgcctcacagggcttgctgagacctggcagaaggcaggaaactagatgcagcgggaagaaggagcagacatttacaagggctgggtccgctgttgtcactcaaacaggcagccaaatttctaccctgaacacaatcttatcatcagtaaatgcaagggagaaagagagagagggaaactgattaaataagttaaatctcttgcaagaagtgcaaacagtttgcttccccacagcaggatattggaaagccccatgaaagcaggctctggagagacatagatagtggaatgagagtacttttttaatataatttttataaagaaggaaaccttgaagttcaagagtctggcaatctaaaatttttgtagagaaagaaaagattgggttccaaatagataagtgctggtgggcatctttctaatttgctcacttttctttcttggcatcctattaccattggcagcttctccaggctgctgctgcttcacccttgggcagtctgtgcctgagaggatgcttgctggtaatctgcaaagggcaggagactaggcaatctccaggcttctgtttcctgagctctgacagcacccaaacatgggtgtgcatactgtaggcattagtcttcactctggcccaattctaggtggatatacaatctagtcaataagtttcaagagtttatttctaagagagcaggaggaagacacccaagttatacccatctttctgtcttctcagggctatcggtgaagtggaaatagaatgtcagtagacacattttctcttgcattccaggctcaaccaaatgacttaactatgttctcctgtgctatggacaaaatgataatgtcccaaccattttcatcttgagcagatgtagaggagtgaagaaaagtgcacgtgtattatcccaaacccatgtgtttctgcccagattgttcagggactatggtgctctttctgcttttcctctcatcaggcagatcttatgaagatgacagtgggggaacactaaactatgtgcagaatgaagcgctatgcaaaaagttatcgccaatacatatagaataaggacgtaaaactgtccgtgtgtttccgttacatttacattagaaatatgattgggaggaaaggattggaaaatatacaacagcatataagcaaagagatgagagaggagaggaaatcttcatcagggccagttattatctatcagggtctacaagcggctgtggttggagtagaactgtttcatgtgagggttgtgtgtgtgtttatatctttctgtattttctaattttattaatgagatcatagtatataaataaaaatatttgaaacacatacacataaaagataattagagcacttcaaaaccatgtgctgtcatacaacctatttgttatagatgagaaagagcttgactggaagcagacatactcagttttgtctctaactgtatacttcagcaaaatacgctttgggcttcagtttcctcacctgtaaaaataagaccaccaccacctacttcacagggttttcctaggattcaatattacatctatgaaagcaccttggccagtgctggtacttggaggcatcaaaaaagttcatttccttaccttttccacaattcctctgctcaattcagggattcaatcctctgttttgattcagggctctccacagagattagactgtagagggcttaacaacttgcaaaaaaagtatcagacagctgtttccagatctgtgtttgctgtcttttttgcaccaaagaaaacacttctcctttatttgtaaaatctgctgtctgtggcaagatttatcagggcgctgtaggagtttctgacaaagaaagggcactcttccacgttcattcccagtcaaaggctggctctggggtgctggtagtggtacttttccctcacttactagctaacttaaggctatgaaagaacaaaatcacttaaaaccagaggaaatgagacctttccaagccctaatcatgcaggctgtgcaggcaccaggtagagagaaccgctacagcaccaagcacaatgaaaaattctagagcagacagatgcctcattcctgttaccaccatagtcaaggtcatataaggaaaactgccagatgatggaagaaaacaaacattctcaagaaaaaaagccttcatcatgcctgtttacaacaaaatcatcaaatctgagaggaaatgtttaagaaagtaatagatacaaaattcagtaatgggaggcgcacattttatttgcttacttctaggacccaccactgacttagaagccactcccctaggtctctccaataaaagcttatctttaccaaaaggaaaagctttggcactactacaaagaataacattagtaaccaccatagggaggaccctcttcgggtgtggacggctacctcacaggcttagcaacttacagaaggtacctcagtagcacataatgaagggcattgcaaagtgatctcaagtctcctggacagcctagtttcaaggcaaaagcttaaagtactaagaattagttttgcctctgctcccagcctcctgtgggagagcaggcagatcctctgggtccaccatcatctcttaaatgagagcattgtgcttactatcaaaaagctctttgatctgaggcccaaaatcctactgaagttctatgccatattttgtgtctatgggcagatgttcatttttctgagagaagttccatgtcatttgtcagatcctcaaagaggcccatgatccaaaaatatattaagaccaactaaactaaataacttacaagctttcttacagataccaatcattagaggaagtttttctgattataaaaacaatgcaatttattgtagaaaaattgaaaagtgtaggcaaaaagaaaaatctgctgttattgagccactcagaaataaccactgctaacattcatatatacataaatatttcttggccgggcgcggtggctcacacctgtaattccagcactttgggaggccgaggcgggcggatcacctgaagtcaggagttcaagaccagcctggccaacatggtgaaacccatctctactaaaaatattttaaaaaattagctgggcgtggtggcacatgcctgtagtcccagctactcgggaggccgaggtaggagaatcgcttgaacccgggaggcagaggttgcagtgagccgaaatcgtgccactgcactccagcctgggcaacagagcaagactctgtctcaaaaaaatacaaaaaacaacataaatgtttcttgtattttgtatttatatggtattaggctctgctacattccacattttcacacattaaaaattcttcaaaaacagcaactttaatggtcacattttatcatagggatttaattacattttatctaactgttttcctgtggttggacacctgtgttgatactaatgttttgccattataaacaatgctgctgtgaacattcttaaaagaccaatttggttatatttttgttggtaatagctactaacaatttttgggcaagaaaatagcaaaatctccagaactagggatctattgtacaccatggtgactgcaattaataaaatgtattggacacttaaaaactgctaaaagagtagatctcaaatgttcttaccacaaaaaagttatacatatgtaagatgatgaatatattgatttgcttggtttaatcatttcacaatgtatacatgtattacaacatcacgtttataccatcagtatacacaatatttatttgtcatttacatcttaataaagctggaagcagaaacaaaaagagcaaaatcaatatttatcttatgatagtacaggagatgaattgaaatggggaagactaaaggcttgggaagactaaaggcaaacggtttttatctgagaacttgaaccaggggagagacagtgagactgaacatgaaggtccagatacggaacacatgctaaagggaaattgccataagtcagtggttcagagggagacagaagaatcaaagagtcagctgactttctactttcacaattgaaagaatgagtataccatgaaccaagacagggaaagagataggaaggtgaagagtcatttctagaaggtcactgcaagaaagataactgcaaatgtcatgatcgaactgcttctttttatcataacaaaacatatccccaaaaagcaactgataatctagggtactcatttacagttacataaactagaaagtaggagacaagggaacccgttggtgtaacatctctttgctcttgaatgttcaaatctaataaattagttattaataatgatatcttctaaagcataaaagctgagcagtttgtatcattcagaccagaataatatttcataattatgactatatacctagaatggtaatttttaaaaattataccacatttttcatctttatctctattgttttattttgctttttatttctataggttattttaatcaattctatttcaaataaatgaggtaagacctatgggaaaaagaaaagtccagaaatcaatgtcactaacatataaaacaccaccaggaggaagtcagctagaaaactaattcagtgatgacattttgagctctccatgacatagtaaagccagtaggaatgataaagtagagattttctcaatgaaatctccgcttatcattcagatgtctgaattcagctctgaaacagtaaccctggacttaaatttaaaatgtcatattttatttaaatatttaccatgtaaaaatttctatgtcattctttattattgaaatacgttctttccaaaaacttcagattgccaagcaaagatgtagctgaatttctgataagattctttgaaaacaccatttttactgattccagaatactcaagagaataaaagatgcagatagtggccatctagcagagaggaagttgatgttctcttcattttagtacgaggttactattattttctatagccacctttcctggtatgataaagctattacatatgtatttattggaagctgttttcacatgccaggcactggtactaggtgctgatgataccatcagcacattttcacattttcacacattaaaaattcttcaaaaacagcaactttaatggtcacattttatcataaggatttaattacattttatctaactgttttcctgtggttggacacctgtgttgatactaatgttttgccattataaacaatgctgctgtgaacattcttaaaagtccaatttggttatatttttgttggtaatagctactattacatgagatcaagcccatagaaatgtaattgatctaattcttttcttgtaactggaaattaaaggaacaaagaagctaactaattccttttaacattaatcctataatttcaccttctaattctttctttcacagtcccataataagtgagaggaaaattgactggttacatgagagccagtgaggtgtaatccccaccaaagaaaaggccctatatagtcattctgaaagccagagaaaatatgaggagaaggttttaatagctccaagacttccctgcgctaatctggttttcagataagacagtgagaaatgtggtaaaaacagctccatgtgtcatttcaaatgaaatacagcatttaaattgccttagtctgagttacacgctgcactaagccatacttttccatataaagtaaaagatacaacctctgctccaaaggaacatgaagtaattcaaaagaatggcacacagtattgagaatgacaaagcacctagagaccatgatctattccctaattgcaggaaatgaagcttgaactttacaaaataagattcaaagaaacggaggagatgaggaagaagaaatggattctagagcaattcctttgtggcagtgcataaggaaagggacagaaacaagaataagcatactagctcccaagataagcctagagagcaagactccactggtattcagtgtgccaggctcctcctacagaagaaacagtgacattaatttgtgctagaatgtggtctataaagggatcatcaaccctccacctgggagacagcattaaaattatgctctgcagattgctaaagaggatgaccccatacaacacaaatcaggagaacatggtaaaactaagatgaccttgagggtccaaaattctagtgaaacattggcaaaggccctagagatgttgggctggagtgtttgtcatcaacccgtatacttattcatttgctgttcatttagtaaacttcagttgatgttacaaaatttccctaggcaaatatgcatgtaggaaatgaactgcaatcttttaaaactggtgtttccatcaaagttagttcttacagctccctcgaagaagagatcacacaggtctgcagatcttttagaatggcattggtttatcactcaacagagaagactgccagctccacaacatgaaggcagtttattcttctccaacctagtgctgattaggtatagactgggcaatctaccacatacaacccagaaactgaaagagagagaaggcaaggactcagaacgtggaattgtatcagttagacaaaaatcctcatctagttctggaaggaaatgaaacctagaaaaaaagaactgctgcaaggatataaagaatttaattgttaactgaggccctttaaaaattatattataatacctcggcagaagggaatatgtcattcaacctaatgacttctccgcttattttaggtatactttttctaaatatcctggaacaagaaactgagcactgtgataaacagagaagccactatctataatgtgatttgtgtatttctaacagttatacgactacctcaaaacctctctcacacttatttaccatggcaggttcctttccttacactaactgggtattttgtttattaataattatttagcacagactataatagagacatcaggcttgatgctaagggcagagtgaagaagataatcccttcttaaggagctactgaggaagataaacaagtaaagagggaactgaaggtcagtgtggtaattttaacactaaggataagaagagggcatgtaactcacccttgagagaggcagggtcaaggaagtcatctattcagaggtagtgtcttagcaaataaaaaaagaataagaactaggcaaatgggagaatggaaagacactccaagcagaggcatcacctcttcaaaggcttagaacctacagagaaaatggtacatacggaaaatgcatccagttcaaggtgaaaagaagatccttggaaggtgagcaagcaccagataattaataatttttaagtcataataaggactctcaattctgagagcaatggagagctactaaagagttttagatctaagaagtggcaagaataaacattctcactgccatatggaaagtggattagagatggacagacagactaaaggcagggaaattagttaggacactgtagcagcaattaagcaagagatggtgaagacctgcaccagagaagtagaggcaaaatggtgaaaagtaggtggaatcaagagtgatagaatccacagatcctaacaacaagttccatttggggtggaaaagagggaaggagaatcaaaaatgccccccaagttacttatcactgaaacagagaatgcaggaggagacgcagacatggtagggaagatgagttctagtctgggcacactgaatttgaggtgactttgagaaatcaaaaaaaaaatgtccactcagtgacaagccagagagagatctggcctggccacggagtgatcaatacatgagtgtttcttgggaacactggaatagatgagcatgcccagtcagaatgcatgaaacaagatgtgatgctctcaagacattggtctcagggcatcaggagatggtgaaaggatccatgttaccttaaaagggaggaagctgatcctctcctgatacactggaattatttgtgcatctcatcagctaatttttagctgagtatgaagaggtaaaccttgaaagatggtgagtcaggcaaatattgatgatgggggtagagaaaaacaagatgaagttaaaaagcagggtgttcaacattagttctagacaataagggataaaaccatcacaactgggattcttaggcaactaaggagccacttaaaatcagtgatcatcactttaggttttattttgttgttatttgtttggttcttgtcgttgttgttgttgttgttgttgttgttgttttgagacggagtcttgctctgctacccaggctggagtgcagagtgcagtggtgcaatctcgactcactgcaatttccacctcccgggttcaagcgattctcctgcctcagcctcccaagtagctgagattaccggcatgtgccaccacgcccagctaatttttgtattttcagtagagacaggttttcaccatgttggccaggctggtcatgaactcctgacctcaagtgatccacccgcctcagcctcccaaagtgctgggatcacaggcatgagccaccatgtccagccggattatcactttaaagagaacaagaagtatgtgctcttcagtgactctacaacctcaggtacagaaaaccaagcagagatcattcagattgcttgggctattggcagtgtaccataaagctatctagaccagttgttttcaccttggctgcattcccacttggaaaattttttaaaatgcaaatatccagatgtcctatggacccttgtaattcaaattatatttttgctaccagcagtattagcatctgtgacagtgtgtaatatccagaccacaaattaaaatctgtattttcctaagattccctgggagatgtgcatgcacattaaagcttgagacctgctgcctcagaatcacttgaaggagttgttaaaacagagattgctagatcagggatggggcttgtgaatttgcatttctaacaagtttccaagtgctgctgctgctgctgagaggctaatactgtattttgagaatttctgccatagaacaattcagaatctcgctggatgggacccaggcatcagtatatttttaagctccctaagtgattctgatttccagccaaggttgagaaccactggtaaaaatatttttctgctcttcattacataagtaaggaaatgactatgagaagcaacttagctatcctctaacaccagcttaaattcatgactaaactgttctttaatataagataaaatatatttaatataattttgattaatcaaaagagaaagaaagatgctgcatcatccttagtgactcatttccagagatatgtttggttatgattggaaaaaaggtcaccacaagtaaccattatcttaatcattacagtaaccatcaatcaatttattaattttaatttctggtaatttaatagggtattggcattttgaaggccacaatgtgttttttgaactcatgtttttttttttaacagaagcaaggttgtataaattatttttccccagtcagcctacaaaaccaattcttttcttctgtgtgctttgggtttaattttaccttcttttttctaggttcttgaggtaaaagtttaggttattgatggagtctttttctcttttttaatgtatgtatttggtactatacatttttttcttggcatggctttagttgtgtcccacaaattttatagtgcatttgtacttttgttaagcttaacttttttttatttcccttgagagtttctctttaatccatggatttttagaagtctgttgttgtttagtttctaaatgtttacagatttttctattatctttctcttattgatttctggtttgattccactgtggtcaaagaacaaacactctgtatgatttaattgttttgaaattggttgaggttctttacatggcctaatcatctgtattgttataaattctatagacacttggggaaaatgtgtattttgctgttattgaaaggaatgttctctaagtgttgattagatccagttggttgatggtgctgagtttttctatatcctggatgacttatagcctagttgttctatcaattgttgagaaagaagggctggagtcttaactgtaattgaagatttgtctatttctcctttcagttccatcaggttttgcttggatattttcagctctgttgtctgcatatgcatttaagattgctaaattttcttggtgaagtgacccttttaccatgcctaattaaacttgcctaaagctgactccttacacattttaagttaggcctgatggtttatatgtatatagtgaactgtaacctaacagggtgtgtaaatagacagcaacctactcttgtaagtagcagagtctcagccaatcacagcagccatactttagcattcacagacagccaactactcaaaccttgttcaaataagacacccagctgtaaccaatccaggtgtttcagtatcccatttctattttctgtacatcactttcttttttctttccacaaattctctctgactacacagcagtgccagagttgctctgaatctattctggttctgggggttgtttaatttgcgaatcattcttagcttgattaaacttgttaaatttaatttgtctaaagtttttcttttaacaccattttataatgtacctctttgtcactagtattttttttttgctctgaggtctaccttatcagatagtataactatttctgcttttctgtgattaatatttatatgatatacatttttatctttttaattttgaacttgcctatatcattatatttgaagtgagttgcttctagacagcatatagttaggtcatattttttattccataatgccagtctttgttttttgctttgttttgctttaagtttcttctgtttgttttttcctttacatcatgtgcctttatttttattttttaattgtatacatttaaggtatataaaacaatattttatatacatatacataataaaatgattactacagtcaaacaaaagaaaattagcatatccaatggggaaaagcggattttcctctaaaagccagtacaagacaaggatcctcactctcgccacttctagtcaacataatactgaaagttctagcaaaagcatctagagaggaaacagatttaaaaatatatccatatcaaaaaagaagaagtaaaattattcctagttgcagattacatgatacaaaattccacaaaaatctgttagaattaataaatgaattcagtaaggctgcagaatacacaaccaacataccagcatttgcatttctttacaccaataatgatctatccaaacaagaaatcaaggaaaccatcctgtgtaccatagcataatgcagttatataggataaagaattctagagatgtaatgtactagcatgagggctggagttcataatattacatcatatactgaaattttgctaagagaatagattttatgtcttcttaccacaaaaaaaggtaacaatctgttttttaattggtgcatttggactatttacagctactgcaataattggtatgctagggcttaactctactgttttactttttgtttgtacaacttttttagtagctgctctaggtattacatcatatttgtttaatgtatcaaagtctattggttttgtcattttatcacttaaagtgaagtatagaaaccttacctctttgaacgtccctttaaccctccacacttataattcccttaaatattttctctacatacacttagaaccacaccagaaaatgttataatttttgtcaaccatcaaacataatttagaaaactcaggagaaggaaagtctatggtatttatacatatttttgcttaccatgttcttttgtcctccctgatgttccaaggttcctttttatgttacttcctttctgcttagctaacttcctttagccattcttttacagcagatctcctggtgataatctgtttttatctaagtatgtcttgatttcctcttcattcctaaagagggtgttttcactcagtataggtcacaattcttatctttcagcacataaaaaaaaatgtgtgtcacttctttctggtctccatggtttctgatgagaaatctactgccatttcattgattttcttatataagtaaggaataatttttctctggctgctttcaagattttctttgtgtctttcatttttgaaagtttaattatgaaatggtatgaatttctttgggtttatcctgtttatggttcactcaggtttatgtgttttaccaaatttgggaagtttgggaccattacttcttcaagtagtttttcatcccatccctctttctcgtctctttctgtactctgatgacatgaatgctagatcttttgttataattacatgggcccattaggctcttgttttgttttgttttgtttttcccatttattttttttctgttgtttaggctaggtaatttctgtcttccattttattatttttttatctcctgtattctgcccatccactaagctttttcttttagttattgtatttttcagttctaaaactccacgtggctcatctttttctcttttatttctttgctgagggcttctctttccttgttcaggttctctactttttcattcattctaaaggtgttcagatttgctcattgaagcgtttttatcatgactattttaaaactgttgtcaaataactctaacacctctgtcatctcagtgttggtatctattaattgcaattttccttcattttgagatctagttcttggtataagaataatttattaaaacctgttcatttttaaattatgttaagagatgccatttcttatttaaatcttctgttttaattggctttctctgacacttctctggcaggtgaaggggcaggtggtactgcctcatgatttccacatggatgcaaagcccagattccccattcagcatcttaggaagaggctccttattactgctgggtgaaggtgagaattctaggagttccaactcccagttggaacactgtaatgagggtggccttgttatcatagggcagtggtgaaggtcctgaatattgtctaggcctccacggacaccagcccagtcaggagaagaaagagcaccctattacttccagatggctttggaagtccagaattaccatgtggtctccactgacactgagaatagaaatggagctcagtgatgataaaactcctggttccctccttgccttttctgacactatcccagtgtggacattggggtacttcatcagaatctcaaaaaagtaaaaacctaagctcccgacatggcttttgcaggtatagatgtgactgggtccacaatgctttttctgttatttacctggaatatggtggttattatctaaaagttttgtcttgttaggttgaccctctctggtcctttaattatagaaagcatgcttttgttaagaatgtttttgcttaccatgtaatgcattggtatttttgtgttgttgatttctttttttttttttttcttgagacagagtctcacactatcccctgggctggagtgtaatggcatgatctgggctcactgcatcctcgacctcccgggttcacatggttctgcctcagcctcctgagtagctgggactacagacactgccacgatgcctggctaattttttgtgtttttagtagagatggggtttcactatattggccaggctattcttgaactcctgacctgatgatccgcccgcctcggcctcccaaagtgctgggattacaggcgtgagccaccacactcagcccatgttgttgatttcttaagctccaagtctggtatatatgagaaaaaaagaaaacccagggcactccaggctgggcaacagaacaaggccctgtctcaaaaaggaaaagaaaaaaggagagatactctatttctatataaataacatcgttttaaacaacattactcaacatatgcaacaagtaagtcattatcattcctagagtaaggaatctaaattgattgaaactcatgtgacacagcaattaatatgtttttcttttggtcccaaggccccaagctagtctgccttctgccttctctccatatttcagagtattcctctatatacatacatatatatatataaatatatatacacacatatatataaaatatccaagatttttagttgtatttagcaggaggaatagggaaagctatgtatactccatcttcctggaagtctcaattctttaataggatgaataattagtgaatataattaaatttaacttttgcagaatagaaattatctgaaaacattactaagtcactaacagtagcttaaataaaacaagagagtaagaaacaaaccaggaacaagtacaagccaaagttatagatataatctgaggcagggagagctacacttcgtggcctcaggttcatataaccagatgtcagaggctgctggaacaaaccctcagcacctgatgcctgaaaacaggatgcatcatgggccttgagaagttacttaactcttcatcagtaaatagcatcattgtgagagctaagcaagttggtaaacataaataatatatagcagggccaggctcacattaaggctctataaatgttaattattaacttactaattaaaaatatgtttattatctaaaataagggctgagataaaaatctatctggtgtaattcttaggccacaaatctctaaggctttggaggtcaatatagcagaggacattaagttcaccattactgaacttaacatgtgaaacacactgcctgctgacaaggacgtttcaatcatttcaggcacctgcttaagttcataggcagcattgtcaaactagtttagaaataaatattgaaaaagagatacatacaaggtcagggggagctaagtctacccctccctctctctctactttgtttcagtagcagacttcgctgttagatactttctccatacatacaaggtcaggggagctaagtctacccctccctctcactctactttgtttcagtagcagaattccctgttagatactttctccaaacgtacaagaaagtacctcaaaaccacacaaatccaaaatcaaacttcttgtcgttcctgtggaaatttgctcttccttcagatttccctatttcagtaggaaatattaacctccaaggaaaccaaaacagaaattacaataatcctttatttgccattcctaaaaagtcactaaatgtactgattctatatccacactactttaactttattcctgtctctccccactgtcatttctgtagtataccaactacgatggctgaaatctatgaaatctttacaaagaattattctaaatgataataaatttatgaaaggaacaagaatttatttcaatagatagtagatcttattcaggacagttttaacatgaccaaccctttttttaaaaattaagcaaaagaaatgttaattattaacttacttagttaataataaacttagtaaaagaagtgaaaaataatagaaaaagtaagaataagaaaagaaggggccgagcatggtggctcaatcctgtaatcccaacactttgggattgcctccctgaggcaggcagatggcttgagcacaggaatttgagaccagcctgggcaagagcaaaaccctgtctctacaaaaacgtacaaaattagccagtcctgttgatgcatgcctgtagtcccagctacccaggaggctgaggtgggaggatcacttgagtctgggaggttgagtctacagtgagctgtgattgtagcactgcactccagactggccaacaggaaaaaaggaaaaaaaaatgagagatactctatttcaatagaaataacatcgttttaaacaacattactcaacatataaaacaagtaagtcattatcattcctagtgtacagaatctaaaaggattctgtgatacagaaattcatgtgatacagaaattaatctttaaagaacaagagagaaataaacatatatatatatatatatatatatatatatttctcaaaatgagctctatttgtcaggcaagactattcagggaaaaaaggattatacggtaaaaaaaaatctggaatatgctacatttgatcaatgaagattgaagagtgcattagcatattgtaggttggaagtcctgtggtaacttgtttaatttggtctaatatgaagatcccaaggtttcagtgacagtgaaaacattctttttcctctaagtggctttcatagaaataatgagaagctccagcttagaaaccacatggagtccatcatcattaaaaatttgttgatttcaaatgaaacaaataaaatttgttattactatgttctctgtatctatgtcctcttgtcttctttcttttataaagacacgttttgttgggtttggggcccagctggataatccaggattattccatttggagatcctcaacttaattacttcttcaaagatcagtttcccaactaagttcatattgacaggttccaagggttaagacataggcatatgcttttggaggctgcagttcaatccactacatatgagttatttggaagcatgatatttagtgtccagatatctggggacttcccaggcatctttctgctactgatttataacttaattccactgtagtttgagaacatagtccgaaatctttttaaatgtactgagatatattttatggtctaaaatatactttatactggtaaatatttcatgcacatttgaaaagaatgtatattctgctgttgttgggtggagtgttctaaaatgttgatgcagttatttgattgttttttcaagtttctatatctttactgattttctgtctacttactctaccaattactgagaggggtggtaaaatttctgactataattatgagcagtatgtactatattaccatgttttctaatattatctccatcttataccctcaggttcattagtatctacacagagagtgcttcctaatgcattatctccctcttctattagaagtattgcccatcttttgtcttattttgtcatagatattttttcataaattttggttaatatataggagatagttgacttcaaaaaattcaatttcaggttttactcatactttgagactcaaagtatacttttttgttacaaatgttgtaaattatgttcttagtttcatgaactgtctgctcctaatcatttgatgtaattctgcacacaatcaaagccacttatgaaattttgtgagaggtactaaatgctctactgaaaagtttttggcattaaatgttttaaaagaaataaaaaatggtaacatttttcccaaatatgttagcaaattcaagaagcagattgtactaattacaattactgcgaagttacatatgcatcatgaactcaaatttctcttaatgaggcttaatgtagcttaacactttacctcatgggagttacaataatggaaagaacacataaaaaaattgagttgattgttctatatcacagcagggcctgtaaaatgtgccaggtctcccaaggtggccatactctttgataaattcacctatgagctgctgttatatttgagggaggctcatgaactaccatctgcagaaaagggaaaggcacatgaggactgcgtgtatttcctatgcacagagtcaagctcactactgggaaaaaaaaaaactgtcccatattcagcgagttctgagaaaccagctgaatgaatacagtgtggtcacatctcaacattaaaatacgcagaatcatccacactaggtagcacagtgaacggaaagatgagacaagatccaactaattgatatggtaaaactgcaatttgtgataggagacaaatttctgttaaaattgtcatgcaaaataactaaatagtacactttgggagcttgatcattatttttacacctatttagcactcaccttgttttaggtaactatgcctggtagtatagagagctattaatgtttctattacctgatctcaaggaaattaaaaattaatgttaaaaatgcataatcatgaaaataaggtagcctgtatttctgctattattaagcctaccaataatagagttatcttctgggtaaaaagtccctgagacaatctcctagctaggtgtggaaactcccaggaagttgcactttttaggaacactgtctttggtcaccagacttcaccccaaagtaatcaatgcctgtaggtcttaaccgtaacactaaagtcctaattcagatacaaatgcattatatgaaaaagaagtgtgttatctgcttttagctaaaagtttaggatgacagtggtgtactctgccatgagctgcatcacagaaaagaggccccgatgatatttctccaggacaactaaggcaacaggacagcctccccatcactattagatactcaaatagtgagaatctgtaacactttgttcacctttcatccccactttaaaatagagaacagctagaggcttgtgatttattctcatgttagaagccctctcatatgacatattcaggataggtagttggccagtttgttaaatgaatatattaaagtcaagaatcttcagaaataatacctcaagtattctttataaatggcaacacttaaatgcacatagttggctactcttttgatgtagagccaaggcctttgctttgagtttgaatctcttagttagatttctacaatgtcttacatcaagaacatccattatgcatcatctatggcttacagtgtttctttgtaattgagaagttaaggcacttgagaagcaatctaagaatcattcacatttcctcccaatcttttatgattggctcacctacatctaattctacagtaatttttttagcaaatttactagcattctatttagttttcacataaacacttctctttacttatatgttacatcagtctacataataattatatgatataatataatagcaagtacaacagtcattaacagattttggattcctggcaaacatgcaccgccacaaaggggacctgaagtacaaaggtgtactaaagaatagctgtctagaatgtcatagacattggtgtgcagactttagagaggacatagtgtctgataaggcactctgctgaaaaatatgtagaataaggattcggctgttgcttattgagcttgtaactttgtgtaaagtcctgattatttagaaaagaacaaacaaaaaaaaaacctgcctaatgctccccattacaactagaaagtaaccttaatcaaaacacacagatataaataaaaaattacagggaagaaaaacaacgaatctgtttgggagttgaagaattaaaaaaatgaaatttcaaaaaaatcaaaggttagcagaggaagacttctaccctaagaagaaaagctatgtgtgaatataacactactaaagtgaaaataaagagatactaccttaccagcctcagctccctgctacaagttcacagagtgacgtggtgcccacaacttcccaaattcatcaaatatggattgcaataaaatgaccttgagaattcctttcaggtctatttgtacaaaccctggcatgtgagtggcagtttcaacgaaaacccagcagatcacatgagtgggtttgcatgtttataaaactgtttcaaatgcaatcaccagatttcaagatttgaaaagcattctaaaatgtttcagagtgcacaaggaaaggggaaaggaacatttcagtgcctctgagcaaatacagagctttaagaaaatagctggtatcaatgaagacattttgattggacaacttcaggcaaacaggacgcccgtttaacactacacgttctctttaccgtcaccatgaattcaggcatagctatcctcagtctgtcacaacaacccgggaaacatgataattcttataagtgccacaaaaaactgtttaagaaatagcagaatttgtctgtttccttagtgagagagaagattgatacataccctggcagaagctgtaaagtaataccattcccatgaaatacaacaagccattgtagatacttaagtaatattgtctaaagaaaaacaacattcttaaagaccatttttgacaacaatgaaaccaagtcagggccacttttttcttacatttgatctccgtagatatttgtactctaaagatagacagacatttgtttacatagaataaaacatcataaattgccaactagagtaagatgtgtgtcagaatagctgcaaatgacacttctgcaaaaaccacagataatatgatgtggccgctaagagattcatcactggttatttttgaaactccagcccattacaccgactaccattatagctatttaagcatgaaatgtttgccttcatttttattcatatgttttatggaccatttactgttagctagaaaatcgtttaaaaggtaattcagtttacagctgaggaaaaataagaagcctccgaaacaatctcagaatattgacttactgtcagataggtaggaatgaacttaaattcaatgtgaaattggggtgaaaggtgactttctaacaagtaactttaaaagaaataaatgagtagcttgctaatgtttctctttttgtttcccccttaatggaaaatatcttagccacaaagggatgagaacttcctgcaaagttttcattgttcaaaaataacatcaagtatgaaaggtatggcttcaacacagtattaactactgttggcctctgccacacaacacactgtaaagactttgaaagactagatgaagaataggacaaccatgccttctatgagatatattttatttcccagtaaaagcaaaatttaattatattccgaaagtctttaatccttactgtgtgtccaaggcactactctagacagcacagacggatacaaaaatggtaaaacctagcttgtggcctccatgaacttaaggtctagagggaagagaaatgcctgaataacttcagcacaaagcagtgtataaaacagcctacaaatatacaaaatgcaccttctgttggaaaatgcagctcccctagctgtcagatgggttgaggtgccatgaaaataaactccaccctcgtattgctgtgtaggagaggcgcccccttcaggccttagggcaccattgcttgcctcttgtaagtacgtgtttcctctactgcgggaaggctcttcaaagacaagaactaaaattcttatttaccctgtgtgccttgcacttagtttagtatcttgtatataggaagtaatcagcaaatgtagaatgaagaattaataaattccctcaatccagaatcctctgcctccttttctctacacgtgcctattcacatttctgaatgtaaaaatcctacccagctcaaatgccacttcttcctaatagcaatatccaaccttgcctcaaaatccccatccttggcagaaatagtttatactttccctgctttctctggactctttagtttatatccctaaaacttctaaaactttgaaatggctgaatctttaaatcaacagttgtcactagctctcatttgacacaatcccctaatattttatttgattattgctatttgtgtacatttgtttttatgtgtaagctccaagagggaggtacctgatgctaacatgccatttatgatgcctccagcattttaaaggagcatccatttgttggttcaacaagaacttctttagcatcaatattgtacctagagctaaataaaatattgatttaactaaatcatatttctagaagtgattgaaagattccaatgtaacaagggtcttcttaacctctgcagacttttgtctgttctaacagtgtgctgtgtttgtgcaaggattatcatcacctagggctatcccgagactaactactccaagcatttttccccctcaaatctgcaagcattgtttccctcagattcatcttcttcttggataatgtcacagatgaaatataccgatgatcttacatcaaatacttacaggaggaggttaaatcattatttgccccatggtggtggtcagcttctagctgtgaccaccaaacctctgctacatatttatgagtcttcctaaacctctaatttaggtttctaaattcaaaatgcaaatgtcctctccacccccagaaaagtttgacatcttttcatttggtctttcccatctttacaaataacaaaataaaacaaaacaaaaatacaatgaagaatgcattaaatgcacagcttttagctcactgctgggcacataggaaagatgggactaaaaatagttaactagtgatatgtatgaaaaaaagttttttaactataaagaatattttgtgtaactggatattttatttcacagacaactctcatgtagtcagagacttcaaaatgcaacactcatacctggtattttatgtgctttcagtttgaggtttctcatttacaatgaatcatttatattttctctaaaagacataaagcatttttgttattttcaatcgcatcaaattgattttgttcttgacatgatgaccataattgcaacaagaacatcaatgatcacaatgggatatgagtatttcacttcagcacttcatattcaccaaatcatgccatgtgtgtaccttaaatttctgagaattcatttttcagaatcatcttatagattgctaattttcataataaactaaactgctgattcacctacaagaaaacacagaaggaacatgtataactatatttgagtcaacagctgctgtgcccactaaaatcttccccgtctcacattgagaacaccgtcactacgtttttgcagctaaaagaaggttgttctaaaagcagataatctgagaatcagtcatcttacattcatgtctttccccagagtggtttaaaggaaaatgcgttagaaaaatgtttataacatttaaatttgttagttgctggaaacactaagtctaatgtaggctgtttctagaactccttaaatatcacccccctcaaaaaaataacagaatgcaaagtccagtatgtctgatttaaatgtatctataggagctcaaaataagcatgacattttgccctaactggtaaaaagttctggagtaaattttagacaatttgggtgatcctataaatcatgataatctctcaccatctgtctcttctaatttcaccattcctaacttctgttctgtttctctcatcacagccccaaagtaaagagtctgttttgaaggttatcaactctttccccacccctgtagaggagacttccctactgctgaaatagcaataaaaaataacttgcctaccaattactgagatggttatagaatctccgattggaccatcctctggttaaatgtttaaagctcagttaaaatgcaaattaacagtagacaatgtagcaattatggcaagagtgggacaagagaaaaagtttcatccaagaatgcaaatttttgaaactataattaaatgtgcaatttgttctgttttatagagatttttatggcatggaaaggtaccaggaaaccccaactaaaatagtgccagattagtgtttctagtctggtcaaaaagaatcaccttagagacactgcaattttgacagcgcatcttttacctcatgtcactgaattgatttttcctaaattgttaaattgggtaggttaatgtaaaattccctgagttatttggagaaagatgaagtaatttatggatgaggatgaaactttctagatatgtcaagatatgattgctgcatcacagagaggttggtactcatatgtgtaagtaggaatagtgtctccactagtggcttgagtaaaatctatacatgcatacggaacatatgtggattccatctgaccagccattcatataacagttgccagtgtggggatgggttgagaagaggtgaaattagaacaataaaagatcaaaagtaataagaatataacagaaggcacaaagcactaaaggaggaatcatctgagaagtaaatgattataaatcataacagaatggagattgatttacattctgaagatctcaaggaaacaaaatgtataaggaacaaaaaaagaaattaatgtgtgataaaattaagaactgacacatctaataagaaatgactatagacgagcagagaattaatggtttgttcaaatggaataacccatacttgaaaaaacttatacattaatatgaaaaaatacatatagaataatacataggaggcagggagtggtggctcacacctgtaatccaagcactttaggaggccgaggtgggcagattgcttgagcttaggagtttgagaccagcctgggcaacatagtgaaatcccatttccactaaaaatacaaaaagttagctgtgcatggtggcgcacacctgtggtcccagctactcaggaggctgaggtgggagaatcacctgagcttggggaaatggaggctgcagtgagctgtgattgcaccactgcactgcagcctaggcaatcagagtgagaccctgtctcaaaaataaaaataataataacaaataggagagtatacagacatagataaagcaaaggcataatgatttttaaaaatactctttcccctagtgtatttgtaaccccccaaaaaagggtcacaagccaataatacaaatagacaaatagtaagtgctgtaacacaaagaaagagacctgaatattttctaaagaacgaaatgttctgcactgtctcgaaggaatgtgaggtagcatcaaaaattgttagaatcttttttctgggtttcctgtttatccaaagagcaacatctttaatgagcaatgacctggacactgattcaacatcttgacatggatacaaaccatcttgacattgccaacctccattacagactgataatattggttccaatcttggacattttcaggaaatgagaaaacaagctaaccatctgccttcctttagttgtagttttaaagcaaggatattccaaaaataaaagtcaactatatgctacagattaaatatcaaactatgaatgttatccgctatccaggtaataaaagtgtaagattccacttgcccatagggttctttgaacaaaataataaaaatgtcaaagaattcaatttaaaaaagaactccattgaagaaaattttacttttctaaattaaaaatcaagtatataattaaaagcttaatagctaaaagcaaaaaaaaacctattacaatataacgaacaaatataacgtttttagagaagagatgatgctaatcgttaagaaaatcctaaaaaccctaaaagacaaaggcctgaaaagacaggtttttaaatttcaaactcactagtaatccaaaagatacaaactaaaacaatgagattctatttataaaaaacaaaattaaaaaaaaaaccatgtaaggctagcaactgggcagtgagacaagcatacttgtatagaatacagtgggaatttctttttgaaaaataaattgggaaaagcctttgacctggtagtttcacttccgggaatctattctaagtaaataatccaaaatgtaaataaaaatgtttgcacacagatgttccctaataatttgtatgcaatatgggaaaatgaccaatacaataaaagaatggttaagtaaattaggatatataattcatataatacacataatagagacacattatacagactttttcgttacatagggaaacattcctgttaagtagaaaagtaggattcaacattctagatataacgtcagactctgtgtgtctgcatgtgtttgttcatgttcatacccacaagtgcatattgaaaactacattttgaaataactatctctatagacattatttttctgaatagaaaaacacattatttaaagaataaaatttttaccgttttccaataataccatgcagccaaaacaaaatatccttttggtctcactaagtatggtttacaataactgaggattatgagagaatccacagagggtctaggcatggctaagtaaagcctgtcttcactgtatacacactattcatttaaacaaagttgaaagccaaacatttcgagacatcaaataacacttaagacttagatccatttggtatgcgaaatacatattgttcttttgtacttagctctgccaagaatctttattgattaacttgtaaaccttaagagaaaatggtatacatctgaaacaatataaaacacacttcttgccaaagatcctacagtccttccaaacaagtctaattctactgaatgctttaattaattctatcaaacattcataacttttgcagtgaagagttatgaaggctatttcttccaattctagagtttgcagatttaataacaaaaagtatatgtaaaatattttattcttaaaatgtagatgtgtttctaattagacgaacaggtcctctcccccttccccaacaaaagatattgcagagactggtactgtcaacgaattgagtaataccatttattaataccagtaaaaacaaaaacttcaattactctcaattctaagactagtttccataatcatgttgttgttggaacatatgactaattttgaactatctcctctctattatgacatggtccaaaatggtaacaggtccttgtttgatcatgtatattggagaactctaaagtttccttatgaaatatttattttcaagagtgtaaattccccccttttttttttgagacagtttcactctttcacccacgctagagtgaagtgttatgatctcggctcactgaaacctctgcccccccaagttcaagcaatcctcctgcctcaacctccccttatcagaaaaaaaaattgatgaactatttcataagccacccctgttgaagagtcattagaaggattcctgaacactgactaccaatttacttaaaatacttaaaaagatgtaacgcggccgggcactcatgcctgtaatcccagcattttgggaggcgatcacaaggtcaggagatcaagaccatcctggctaacacggtgaaaccccatctctactaaaaatacaaaaaattcgcctagcatggtggcacacgcctatagtcccagctactcgggaggctgaggcaggagaatcgcttgaacctgagaggcggaggttgcagtgagcagagacggcgccactgcactccagcctgggtaacagagcgagactctgtctcaaaacaaacaaacaaacaaaaaaaagatgtaacccacatccttatgatacagaacatttccatctccctagaaagttctctcatctctctggtcagtcttccctttcagaggctaacctttttccctttttctaacctaagttttgttctagaacttcctagaaatggaatcataccacatgtattcctttttgtctcgattccttgactcagcattttgtctgtgagagtcactcattttgttgcaggtatcagtagttcattcatttttgttgcggagtaatactccattgtataactgtgacaaaatttgtttattgattctcttttgattaatatgtgggtttatgaatatgtgggtttatgaatattttaacaagtatttatgtatgatataattttttatgtgtaacataaaatttgcttctgggtaaacaataggagtggaattgctaggtcaaagggtaggtgaaagtaacattttattatctgcaaaacatttttcaaagtagttacaacatttaattttcctatcaacaagtgtaagagttcagtggttctaactcctcaccagtatttggtgttttcaacctttttaattttgtcctttctagtggatgtgtggtggtatttctttgtggttgtaaatgcatttagctgaagcctaaagatgtggagcactctttactgtgttcattggccatttgtatatttacttttgtaaagtgtcccttgaaatgctttgcccatttttattgagctattttctttggtctttatcttattaatgtagatgtgctttatgtgatattgattaaagtcctttgtcagatatgttttacaaatatttttgtcctgttagtggctctcttactcatttacgtatgtcttttgatgagcagtctaatttaccaattttgagggttataattttctgaatcctgtcatgttctgttcttgaagtatcagagttttacctttgcttttaggtctccaatccatcttgaattgatttttgtctgaggtgtgaatttagggagtgaaaatttatttttttcccatatggatatcaatttattccaatttcatttataaataagcctctccattcctttatttaattgctttggtgtcttgaaaaaaatcaatttactttataaatgtgtgtctatttctggactcttttatttccttcatttatttgtctatccttatgtcaaaacctcataatctttaatacaactgtatttttacagttataatacaactatattttatagagtcaggtagaattgctgttgtttttcaagattattctgactattctaccttctttactctcccatataaattttagaataagcttgtcaattcctataaaataaaagccattgtgatgaagattaagataaatttgaatatatagattaattcaggaaaaattaatatcctaaattgttattgagtcttctgatcaatgagcaaagtatatctctccatttattgaagtcttcttaaatttatcttggtaaattatagttttcagtataagaattgtgcacatatttcattaaatttgctactaagtattttctattttctggcattataagaaatgaaatgtttaaatatttagttttaattgtccattgtatttataaacatgattaaatttgtattgactgagatactgagacctttctaaactcacttattggttcaagtcccctttatggaagctattccttatggttatttaagtatctgtttatgtcatacgtgaataaaagctgctttacttcttgctttgcaaattgtatgagttttaattattcttcttgcactgttgctaagaccttcagtaaaatgttgaatagagatttgagaacagtcattactaccttgttcccaatcttatgggaaaagcagtctttcatctttaattatgatgtgagctgttgggcttttatgtagatggcttttatcaaatattcctacagatgactccttgctgggatgggaggaggtgctgtcccgtgcactgcaggatgtttagcagcaaccctggcttctaccaactagatggcagtagcacccttcctctagctgtgacaatgtctccagacgttgcctaatgtccctatggtcaaagttgcccccagttgagaaccactgagctaaactgaggcagcaagtcaggcacaaacacaggagattacagctaacatcatcaggcagctgcctgaatggggacttgagttttctgagctgcagactgacttgcttggttcacctatgtctttagatccccttgcctattaaaaggctgtcttagtccacctgggctgccataaacaaaatgccacaaacacaatggcttataaacaacagtaatttatttctcacattctgtagactgggaagtccaagatcaaggaaccagagaatttgatgtctaataagggccagcttcatcatagatggcaccttctcacggtgtcctcacatggtggaagagttaacggagatccctagggcctcttttataagagcaccagtcctattcatgaggatcacctaaacaccccctagaggcctcaactcctaatacaatcaccttggaggtgaggacttcaacatatgaattttggagggacacaaacattcagaccataggagaggttctgacccattcttctgggtacaatgcttacataaaataggaacattcagactcaggaccctgaagatactgcaatagcaccctggggaggaagtattcttgggcctctaggctttccatagatgtcagagatggcacagaatgacagcagcctagtcttcatctcctttatttgttttttcctgcacaattagagaaaatgtcttgaggtaccttcttacctccaatgcagctattattcaaaaaaaaatgactgggtaagcctccttttaagaagagccatatttttacacacatacgtatccacacacactttctttctaataagtaccataagtgctttccagttgtaataaaagttgacaaagttggcgtatttaaattgtacaatgagtcaatgttttccaatctccttccctcatgctattgcaaaagacacatgcacgtatatgtttattgcagcacttttcacaacagcaaagatttagaaccaacccaaatgcccatcaatattagactggataaagaaaatgtggcacatataccatggaatactacgccaccataaaaaagaatgagttcatgtcctttgcagggacatggatgaagctggaaaccatcattctcagcaaactaatacaggaacagaaaaccaaacaccacatgttctcactcataagtgggagttgaacagtgagaacatatgggcacagggaggggaacatcacacaccagggcctgtcgggaggtggggggcaaggggagggatggcattaggagaaatacctaatgtagatgatgggttgatgggtgcagcaaaccaccatggcacatgtatacctatgtaacaagcctgcacgttctgcccatgtatcccagaacttaaagtataatttataaaaaaaggtttgagtatttatacattgaatgaaatttgaatattggaaaaatgtacctgcttctctttttcaaatatttttggtattaataagattcaaaataatttaaaagcaacttttctcatcaagtattttcaaaattcatagatactaaaccttacccttcttgggtagggtttgccaagttttgtgacattagaacaggctggtaacaaggagcctaggcaaaaacagaaatataaagtaatgaaagctacaaatatggagaaatattaatcactggataattttctaagatccactatgaatagaactgattaataacagaagggagaaaatactctgaaatttaaagggtttgaagaaataagcatttacatggaattcaatatatcgagaagtatgttatggttaccaaacatgctataaatctggacatcatctcaatttcatcaccaaaacatttttaactcaatcttctgggagaaatttctttcatttcattttattatacattctatccaattgtataatcaaaacacagttccaattactgaaatacactttataataaaattgctggtattatcctataaccaaaggttagtaggttgacctccaaataaaaaggcaaagtgttttgattcataaatgagaatttctattcccagccacttatacaggaagtgccaataagatttcattgtggaaatgttaacacaatataacttctttgcatgcttaatttagcacagccaaagaagaaacatcttcaagatgttccaagtgtggggcccactccaattgtagaagactcatgtttatggatgtgattaacaaactgccagtgcattcagctgtggcgtagaatttttagctacttcaaatgtgcattcaaaataatgtatttctcaattatcaaattctttttgtactttcagataatccctctacttgagcaaaaactatgaattcatcatttggctgtggtttacatatagtttgatgattcttttctatcttaccttaaatcaacaagcatctaccagaaaaataaaaaaaaaaaagattacaggaaaaaattccaattaacttatcaggtacagaaaatttatttgcattaagcatgttatttttcctcaatctctcctgtttatgactaactgcataccattcaactaacataaaagtgtttactaaaagatcagagaagttatccaccttcatagccatttggaagagaaaaaaaatctttctactctttccaaaatgggttataaacacatccctagagaaatttcaaatgaatgtattcctctgcaatttgattctgcaaaaaaatgtatgcaactgaaaattacacacagagaatatttaagtcatgactatggaaaaacaattactatatttggatacacaaattaggcaactaattatttcaaaaatgcaatcatgcacacaaatagatattcactaatttccctcccactctaatcccttaacttccttctgtgtttttcacatcaattttagctctcctatcatttttttctctactaagaacgatttgtgaaatggttttttatcttccactaatatgtgcaattcaattatgttttcctgtcaatgtatccatcaatgaggatgattaacatccattatctgacccttcattttctatacgacctttgcaaatcagtggcataaaagaaattcttgttctttggtttgtgtcagcaataacaacaagagaaacataccaaatataagacattagaaatatatcacagtaaattcaaacacagtgcgattctgttatatttcaacagtcaccacggaactttgaagtctctgtttcacttattcttttgagggattcttatctcaaaaaaaaggaagaaaggaaacaattgaaagttcatactttaatattaactactggattgtgtcttcattccaagtggagtcggaaatttaaaaatcaaataattagcacacaagctctaaataaaagtaaaattaggttttttttcaaccttctgataggaattttaggttcaaaatagcttctggctaaaatcatgtaatgctgctgtgaccaacttgtcactaaaaccattgaagacagcctttaaaaccaaaagtaatggataatcaattccataatcttaagagaaaaataggttctaactttgaaaccgtaaagggaatttagttattccttggcatacccagctttcacttccaattgactggctcataggtatagaaaactaagaacatatccttcttttgttttttccttcaacttttaagttcaagggtacatgtgcaggatgtgcaggtttgttacacaggtaaacatgtgccatggtggttgctgcacagatcatcccaccacctaggtattaagcccagtatacattacctattattcctgatactctccctctccacaagccaccccacccccacaggccccagtgtgtgttgttcccccatgtgcccatgtgttctcatcatacagctcccacttataagtaagaacctgtggtgtttggttttccgttcctgcattagtttgctgaggacagtggcttccaactccaaccatgtccctgcaaaggacatgaactcatccttttttatggctgcatagcattccatggtgtatatgttccatattttctttatccagtctatcattggtgggcatttaagttgattccatgtctttgcttttgtaaatagtgctgtgatgaacatacacatgtatgtatctttataatagaatgatttatattcctttgggtatatagccagtaatgggatctggctcaaatggtatttctgcctcaaggtctttgaggaatcgccacactgtctcccaaaacagttgaaccaatttacactcccaccaacagtgtaaaagcattcctttttctctacaactttaccagtatctgttgttttttttattcttaatcacagctgtcctgactggtgtgagatagtatctcattgtggttttgatttgcatttctctaatgacgtgatgctgagctttttttcagatgcttgttggctgcatgaatgttttcttttgcaaagtgtctgttcatgtcatttgcccactttttaattgggccattggtttatttcttgtaaatgtgtttaagttccttgtagactctggatactagacttttgtcagatggacagattgcaaaaattttctcccattctgtaagctgtctgttcactctgatgatagtttttttttgctgtgcaggggctctttagtttaattagatcccatttgtcaatttctgcttttgttgcaattgcttttggcattttcatcatgaaatctttgcctgtacctatgtcctgaatggtaatgcctagattttcttctagggtttttatggttttgggttttacatttaagtttttaattcatcttgagttaatttttgtatatggtgtaaggaaggggccgaatttcaattttctgcatatggctagcccgttctcccaccaccatttattaagtatggaatgctttccccattgcttgtttctgttagatttgtcaaagatcagatgttggaggtgtgtggtattatttctgagttctctattctcttccattgggctatgtatctgttctttttttttttctttttctttttgagatggagtctcactctgttgcccaggctggagtgcagtggcacgatctcagctctgcaacctccacctcccaggttcaagcaattcttctggctcagcctcctgagtacctgggattacaggtgcatgccaccacacctggctaatttttgtatttttagtagacatggggtttctccatgttggtcagggtggtctcaaactcctgacctcatgatctgcctgcctaggcctcccaaaatgctggggttacaggcgtgagccaatgcgcccagccttctgtgtctgttcttataccaataccatgctgttttggctactgtagccttgtagtatattttgaagtcaggtagcatgatgcctccagctttactctttttgcttaggcttgtcttggcaatttgggctcttttttggttccatacgaattttaaaatagtttcttctaattctgtgaagaatgtcaatggtaatttaatgggaatagcatgaatatataaattactttaggcagcatgaccattttcacaatattgattcttcccatccatgagcatgaaatgttgttccattcgtgttatgtctgatttctttgagcattggtttgtagttctccttgaagaggtccttcacttcccttgctagctgtattcctaggtattttattctttctgtagtaattgtgaatgggagttcattcatgatttggctctctgcttgcctgctgttggtgtacaggaataccagcaacttttgcaaattgattttgtatcctgactgctgaagttgcttatcagattaagaagcttttgggctgaaactatctgttttctagatataggatcatatcatctgcaaacaaagataactggacttcctctcttcctatttgaataccctttatttctatctctcacctgattgccctggccagaacttccaatactatgttgaataggagtggtgagagagggcatccttgttttgtgcctattcagtatgatattggctgtagatttgtcatatatggctcttattattttgaggtatgttcattcaatatctagtttattgagagtttttaacatgagtggatgttgaactttatcaaaggccttttctgcatctattgagataatgatgtggtttttgtctttagttttttttataggatgaataatatttattgatttgcatatgttgatacaaccttgcatcccagagatgaagccaacttgatcatggtggataagctttttgatgtgctgctggatttgttttgtcagtattttattgaggacttttgcatcaatgatcatcaaggatattggcctgaagttttctttttttgttatatctctgccaggttttggtatcaggatgatgctggcctcatagaatgagttagggaggagtccctccttttttttggaatagtttcagcagaaatagtaccagctcttctttgtacctctggtagaattcagctgttaatccatctagtccagggctttttttggttagtaggttacttactactgtctcaatttcagaccttgttattgatctgttcagggattcaatttcttcctggttcagtctttggaaggtgtatgtgtccaggaatttacccattttttctagtttttccaatatatatacatagaggtgtttaaagtattctctgatggttatttgaatttctgtggagtcagtggtgatatcccccttatcatttctaattgtgtttatttgatccttctctcttttattcttttttagtctagctagcagtctcttttattaattattttcaaaacaccagctcctggatttgttgatattttgaaggatttttttgtgtctctatccccttcaattcaacactgatcttggttattcttgtcttctgctagcttagggttttgtttgctcttgattctctagttcctttagttgtgatgttagattgttaatttgaaatctttccagatttttgatgtgggaatttagtgctataaattttggttttttgttttgttttgttttgttttgtttagacagggtctcactctgtcacccaggctggagtgcagtggcacaatctcgctcactccaacctccgcctctcaggttcaagagattgtcctgcctcaggctcccaagtagctgggactacaggtgcgtgccacacacccagctactttttgtatttttagtagagacagggtttaaccatgttggccaggctggtctcaaactcctgagctcaaatgatccgctcacctaggcctccccaagtactgggattacaggcgtgagccaccgtgcccagcctaaatttccctcttaacaccgctttagctacggcccagagattctggtatgatgtctcttttttctcattagtttcaaagaacttcttgatttctaccttaatttcattatttacccaagagtcattcaggagcaggttgttcaattgccatgtaattgtgtggttatatctggatttcttttttttttttttttttgagacgggagtttccctctgtcgcccaggctggagtgcagtggcgcgatctcggctcactgcaagctccgcctcccgggttcacgccattctcctgcctcagcctcccgtgtagctgggactacaggcgcgcgccaccacgcccagataatttttgtatttttagtagagacggggtttcaccgtgttagccaggatggtctcgatctcctgacctcgtgatccgcccgtctcggcctcccaaagtgctgggattacaggcgtgagccaccgcgcccggcctctatgtctggatttcttaatcttgagttctgatttgattgtgctgtgatctgagagactgttatgatttcagttgttttgcatttgcgaggcgtgttttacttccggttatgtgattaattttgagtcagtgctgtatggcaatgaaaagaacgtatattctgttgtttttagtggagaatactgtagatatgtatcaggtctgcttgatccagagctgagttcaggttctgaatatctttgttaattttctgtctcaatgatctgtctaatattgtcagtgaggtgttaaaatcttctactattattgtgtgggagtctgtctctttgtaagtctctaagaatttgctttatgaatctgagtgctcccgtattggggtgcatatatatttaggatagttatctcttcttgttgaatcgaaccctttactattacgtaagaaaatatggaacgcttcaggaacttgcatgtaatccttgtgtgagggtcatgctaatcttctctgtgttgttccaagtttagtatatgttctgccaaagcaaacactccttcttttctttattggataaaagggacccagagttcttggtttggggaattttacttggaggcaaatgctctttctcccaccattccagcgtatttaagaaaaaaaaagtgagcagaaagtaggggagagaggcccgtaaagccacatgttccaaaaggcttagtctgcagaggtagagcctttggttgatgaaatggagagagaagggccgggcgcggtggctcacgcctgtaatcccagcactttgggaggccgaggcgggtggatcatgaggtcaggagatcgagaccatcctggttaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagaaatggagagagaaaaggtgaacagagcacagaggagcaatcctgataggttgagaattacagataccgtgtataacttcttatagtatcaaagaatcaggctgcagaagctgaatgatcaaaagccaactgagaggagatactttaaataaaaattaacagaaaatggtaattgaaatggcaactaaacccaacaatattcattaaactgtaaactggatattaagttttcaacaccattgtaatagaaaaagagctggaccaaaaaaacccactcaacttgggtatctttgtggctttacttaaaattgagtaatatatatatatatatttgattctctagttattttagttttgagctatacacacacacacacacacacacacacacacacaacacacaacaggggaaagagaatagtgctccaaaaattcagaacaaacctctgaaaaatttttactgcagaatccaaaagaaaaactcagaagactacttggtgtccttaataaagaaccaataaattggcctttatgaaaagaaaacaggatgaaatgaagaggattccaggtaggttaaacaaggcaatggacagtgggtaaaatgaaaagggagagagaatttttttaaaggaagattacatagaaattaaaagcaaagtagaagaattaattgatactgaagaaagacagtgggcttaagcattatttaacagttctataagccttcacagggagaaaggaaaataaaagtacaatagagaagaagaaagaattgaaaaacagagactagggagctaacatatagctcatcagtattcctagaggagagtccagagaaataaaacagaaacaataaccaaatacacatcccaagaaaactttcctgatctcaggaaaatgggtgacatggctccaggaaaaaaataaatcagtaaaagacctaaaccttaacatatctggcactttttaaactactgagtaaacagaaaaaaaaatcctgcaagattccaggaagaaataaaacttcttacttaaaaaaaaaaaaaactctagcttcaaataaaatatagactctaagaaaatgttgtagcccataagacactacatattacaatgtgtgtgtataaatatatatacatgtgtgtatacacacacatacacacacacacatagttataactgtaagaagaaactaacagaaatacagtactaaagtctaacaaaactctcttaaagagaaaaagtagctggaaaattaaaaggtccataaagcatatgagtaaattcaattaatgaagttggtctaacagttacatttaaaagtttggattcttcaaatcaagaaaatacttttgtaaaaagttgatcaaaaattgttcatatattagatagaggcagatgaaagctataaaacatagaaattatataaaccacaagaatgcataagtatgtgaaagacgtacacataatccagtggaattaatatcataagataacctttaaaaataaaaacgcaaaggtaaaccttaacataaaacatttctaaatggcataggctaaagaataaatccaaattgtaattacaaactattttaaagttaagaacaactgaaaaatctatataaaatctaatgatgtgtggtaaaggatggactcaaaaggaaaaaaacacatggcattcagggttctcatcattttaaaaattgaataaaataaaataacaaaatattcaactcaataaactggagaagttcaataaaggtcaacaaaataacctgaagaaaagtcacaggaacgaatcaataaaaaacaaaacagaatgacatattcatttaatgacctagaaaaagatcaggaccccaaggaaggctggaaaaatgagttaataaaaatcaaagcagaaaaacggcaattaagtaagtagaactctgcaagagtaagacaagaaaatttagatttccttaaaaattacaaagtatatttcaccaaatatagaaacaagattaaaaatatacaaaagaataccatatacaatcctattctgattaacgtgacagactaatgcagtggcaataatgtaagaaaacatgaagtgatgaaactgatccagaaagaaatcgaaaccggaacataggaaaacaaatatatagcagaaacaaaagaaaaagacttttagaaaagtcgatctaaaccaaaaaagcaaaacaaaaattgtataagaagtaagttatttcagaattacactatattccacaacatagataaacaatggaagcctattgtattcattatattacgttgttgcaaaactatttgtggtttttgccattaaaagtaatgtaatagctaatagctattacaaacctaataccatacctgacaatgattatttttgaaaagatacacctatctcactttttaaaaatgcaaacataactaattaaatatataaataaagttcaggaatatattaaaagaaaaaaattcacaacaagagttgtaaatactttaaacaacgacacagaaacagaagcattattttccatggtaattctttttcttaaaagataaaaggagaaagatacaatgggagttatgtcattctagatcttaaagtgtattagaaacctgtaacaatgaaaatattatgacactagctctagacaagaaagacaaatgactaaaagaggtttgatgccaaagacaccaaaatatgtctagtgtaagattttagtataagtaaatgtgacatatcaactcactgaagaagctatagactaatcaagaaaggctattaagaaaattgacttgtacatgccagcaaattctcaggtcacaagaagaaaggcaaaaccccagaggttagcctctaaattcagccagacaaaccatctgaaagtgaaatggcccatagaacacgccaatggaactgtgaaattgcctcaactctgtctgcatttactagtcagccctttcttccccaacctttatttatcactgttccgaagtcacactagattagcaaaggaaatattaggttggtgcaaaagtaattgctgtttttgctatgaaaagtaatggcaaataagaacaatgtccccacaaattatgcccttaaaattaaccaaaatattaaagcatagagagtgacagcctatagtttgcaaccagcctggccaacatggtgaaaccctgtctttactaaaaatacaaaaattagtggggcatggtggtggacacctgtaatccaagctactcggaaggctgaggcaggagaatcacttgaatccaggaggctatggttgcagtgagccgagatagcaccattgctctccagcctgggcaacaagagcaaaactccatcaaaacaaaacaaaacaaaacaaaaagaagtcattttgttcacaggccattacttatttccatgacaatttaaaaatggagatgtttctattctatttatacagaagagcagcagtatatagtctcataaaatgccattgagaaaaaagagaatacaaattctgtctcaacatatgggaaatattttcataacttaaagcctagtaattttcaaattctattatgtttgactttccagctaaccttctctttttcaatgtgttctatagtataatcttttgcaaaactgaatttaaattaattttattttgaaaattttccaacatcccttgttgaattctgaggtaccaaatagccaagattggaggtttccaaactagtctgacccacccacttgtgggtctgtttctaacgttgctgtagacatttaaggattgtccaattttaaaaaccaataataacaaatctttggtaattggtggcaaaactaatgctactataagattatcagcccatcagtaaaaagtagagccagaaaccccacgaaggcttgtgtttctaaatgttgccacataaggcaaaatttgatcaaagtgcactttaggatgctctccaaagaatgttccactctaacacagcatggtttataattacagtattatgggaaaagccaaagaagaaaattgcatctgtagttttcacaaccagtttttctctgggttccaagataattcagatggcaaaacaaatgccccaagactgagctgagggattcgaatttgaaaatcctccctggctcccaatcttttttccagataacaaacttgccccccgcccaccaccatttcccccagatatcctactctgcctctcagtgatttagtgataaactcttctccgaaaaatataaattggcagattacaaccaagtagaataggtatttatgttgcctctatgtttgccttcatatatattataaacatattgagctctaaaagtacatggctttctgcctggatactcactgtttagtttactctgagttcttggtgggaaactgttaatattacttaaatattgtgatgggtgagtctgtcaagaaaaagtctctaatactcaaatcaataaatgtcatttatgtgcatagcatctgcctctgaaagacagtctggggacagggagaaacatgagggaggagggggaggggaggagctgcaacaggaagctaaatttaaattcagattacaatgaattctgtttcctacaacttccattctcaaaagcagccacatttatagaaaaagagaagtataatggtcactgttcacaatgagcctaaccataaacaactggacaaactaaaactatggaaaccagtggatcctgaaactttgacattaaaaactcaatttagaaaaattatatatatttgaaataggtaatcctattagtagactagatagagagatggacacttaggctttttcccttcttctaggaattcagaaactaaatcattttcaaccagttctcttctctgataagaacattcactccctcagggttataatatttcttaacagagaacactgaaagcacaactgttgaaagaaaagaacaggaaaaaacgactcatttttttctctcctcactggatctacagatgaaaacatcaggaatggggccatagggatatgctgaaatggcacaacatcaatgccatattagcagcaggtgataaattttagtttcttatagcaatgctaatttgcttatatatcatgtaataatttggactactggccaaattattaagcataagacctagatactatgtaagacatgtggactagttaacatcacaataaaaagattttaatacagaaatccttggtgttttatttaaatccataatctaatatataagtaacatcatttgagtgcacttattctccttgacttcactttggagttttgatggaaatgaattgatttgtgagtgtgagtaccctttttcctcttggagaagtaggaaagaatagctagcaccttaccactagtgcttcccacagctgccatactgaagtggcatcctggagacccttttccttcttcaaattctctttttttaaaaatgcaaagtccccaatcttggccctctctttgacctgatagttatgaaatcaatgaaaacaataatcccactttaccagcattttaaaaaatcacatatacagtattacgttctacagtgagcatctcattttgagaagaacaataaaaatcaagaatgtttgctttatgatggccaggatagtagagggtttgggaacaaaaataaatatatgaataatagttgatagaactaacagtgtctcacttggagaagggaaggtttaaaaaatgaatgaggaggagaggaactgaagtttattctgcaaagttccagtgggtgtgtagcagagactggttaaatgctcaaaaaagcctcactttccttccaggaacacaggtaaagtatttttcagccaccctagcagaaaagtggggttgtgtgattgacttctggccaacagaatagggttctaacagataccgacattataacctcccatgtgcatctgcacatgctcctgagaaatggattagtagtagtcagcaaatccaaccttcgctcttgctctacttctgacacacttcttcctgaatcttcctttatggaatatttctgtagtctctactttctcttactctctgagcctttgctcacctctttaaacatctttttatgccttttgtacaagtatgttccctttctagccaaacaagaaattctgcaagtgggggataatcattccatgtgctctcctgtgttcccaccagcatacctcgtaacattccccatacataggaaatatgaaggttcacacttaggcaatttttattagctaatctgagtccaactcattaaaataagtcttttttttttttttttgaggtggagttttgctcttgttgcccaggctggcatgcaatgaagcgatctcagctcaccacagtcttcacctcccaggttcaagcaattctcctgcctcagcctccccagggccgggattacaggcatgtgccaccacgcctggctaattttgtatttttgtatttcgtagagacggggtttctccatgttggtcagtctggtctcgaactcccaacctcaggtgatccgcccgccttggcctcccaaagtgctgggattacaggcgtgagccaccgcgcccggctggcaagtcaccttcaaaggaaattccatcaggctaacagcaggcctttcagcagaaaccctacaagccagacgaggccagaggcctatattcaacattcttaaagaaaagaaattccaaccaagaatttcatatctggctaaattaagtttcataaacaaaggagaagtataatcttttcagggaagcaaatgctaagggaattcattaccaccagacctgcattacaagaagtccataaggaagtaccaaatatgaaaagaaaagaacattacccaccaccatgaaaacacacttaagtacatagatcactgatactataaagcaactccacaatcaagtctgcataataaccagctaacaacatgatgacagaatcaactccacacatgtcaatgttaaccttgagtgtaaatgggctaaatgtcccaattaaaagacacagagtggcaagttgaatgaagaaacaagacctaactgtatgctatcttcaagagacccatctcacatgcagtgacactcataggctcaaagtaaaggaatgaagaaaattataccaagcaaggcatgggtttgtattataatttcagacaaaattgactgtaaactgacaatgatcaaaaagacaagggcattacataatggtaaagggttcaattcaacatgaagacctaactatcctaaatatatatgcacccaacacaggagcacccagattcataaaacaagttcttagagacctacaaagagatttagataaccacataataatagtgggagacttcaacaccctattcacagtatcagatggatcactgaggcagaaaactaacatagatatattcgagacctgaacttaacacttcacctaattggcctaacagacatctacagaactctccaaccaaaaataacagaatatacattattctcatctgcacatggtacatactctagaatcaaccacacaatgtgtcataaaacaattcttagcaagttcaaaaaaacggaaatcataccaaccacactttcagaccacagcttaatgaaaatagaaatcagtagtattagtttattctcacacagctatgaagaaatatctgagactgggtaatttataaaggaagaaagtttcattgactcacagttctgcactcctaggaggcctcaggaaacttacaatcatggcagaaagcaaaggaaaggcaggcaccttcttcacaaggcggcaggatggagtgagtgcaagcaggagaaatgccagatgcttataaaaccatcagatctcatgagaactcactatcacaagaaccacatgggggaaaccacctccatgatccaataacctccacctggtcccacccttgacgtggggattatgacaattacaactcaaggcaagatttgggtgggaacacagagccaaaccatttcatcagtactaaggaaatcacccaaaaccatacaattacatgaaaaataagcaacctgctcctgaatgacttttgggtaaacattgaaattaaggcagaaatcaagaaattatttgaaatgaatgagaacaaagatacaagataccagaatctctatcttatcaatattaaagcagtgttaagaggaaagtttatagtgctaaatgctcacatcaaaaagttaggaagattttaatttaacaacataacatcacacctagaggaaacagaaaaagagcaaaccaacccaaaagctagcagaggaaaggaaataaccaaaatcagaacagaattgaatgaaattgaaatgcaaaacaaaaaaaattgaaagatcaatgaatccaggagttggttttttgaaagaataaataaaattgatacaccactagctagacaaacaaagaaaaaaaaagagagatgatccaaataaacaaaatcagaaatggtaaaggggatattaccatcgacccaacagaaatacaaaaaaccctcagagactataatgaacacctttatgcatacaaactagaaaacctagaatttttcagggtaaattcctggaaacatacaacctcccaagattgaactaggaagaaattcaaatcctgaacagaccaatgacaagttctgaagctgaatcagtaataaaacacctaccaaccagaaaaagcccaggactagaaagattcacaggcatattctaccagacatacaaagagctgactggtacaattctatctgaaactattcaaaaaaactgactaggagggactcctccctaactcattttatgaggccagcatcattctgataccaaaacctggaagaaacagaagaaggaaagaaaacatcaggccaatatccttgatgagcataggtggaaaaatcctcaacaaaatactagcaaactatgtcctggatcgaacaggacatcaaaaagctaattcagcatgattaagtagactttatccctgggatacaaagttagttcaacatacacaaatcaacaaatgtgattcatcacataaacagaactaaaaacagaaactacatgatcaccttgatagatgaggaaaaagctttcaataaaattaagcatcacttcattttaaaaaccttcagcaaactaggcattaaaggaacaaacttcaaaataacaaccatctataacaaacccacagccaacatcatactgaataggtaaaagctagaagcattccccttgagagccagcacaagacaaggatgccaaatatcactactactctattcaacacaatactcgaactcctagccagaacaacaggcaagagaaaaaaataaaaggcatccaaataagaacagaggaagtcaaactatctgtatgcagacagtatgattttttttttttttgagatggagtcttgctctgtcacccaggctggaatgcagttgcacgatctcagctcactgcaacctccatctcctgagttcaagtaattctcctgtctcagcctcccgagtagctgggattacaggaacatgctgccatgcccaactgattttttgtattttagtagagacggggtttcaccatgttgcccaggctggtctcgaactcctgagatcaggcaattcacccaccttagcctcccaaagtgctgggattacaggagtgagccactgcacccggcggacagtatgattttattttattttttattattattatactttaagttttagggtacatgtgcacaacatgcaggttggttacatgtgtatacatgtgccatgttggtatgctgcatccattaactcatcatttaacattaggtatatctcctaatgctatccctcccccacacccccaccccacaacaggccccagtgtgtgatgtttcccttcctgtgtccatgtgttctcattgttcagttcccacctatgagtgacaacatgcggtgtttgggtttttgtctttgtgatagtttgctgagaatgatggtttccagcttcatccatgtccctacaaaggacatgaactcatcatttcttatggctgcatagaattccatggtgtatatgtgccacattttcttaatccagtctatcattgttggacatttggcttggttccaagtctttgctattgtgaatagtgcctcaataaacatacgtgtgcatgtgtctttatagcagcatgatttataatcctttgggtatatacccagtaagggaaggctgggtcaaaaggtatttctagttctagatccctgaggaatcaccacactgtcttccacaatggttgaaccagtttacaatcccaacaacagtgtaaaagtggtcctatttctccacatcctctccagcacctgttgtttcctgactttttcatgatcaccattctaactggtgtgagatggtatctcattgtggttttgatttgcatttctctgatggctagtgatgatgagcattttttcatgtgtcttttggctgcataaatgtcttcttttgagaaatgtctgttcatatccttcgcctatttgttgatggggttgtttgtttttttctagtaaatttgtttgagttcattgtagattctggatattagccctttgtcagatgagtagatggcaaaaattttctcccattctgtaggttgcctgttgactctgatggtagtttcttttgctgtgcagaagctctttagtttaactagatcccatttgtcaattttggcttttgttgccattgcttttggtgttttagacatgaagtccttgtccatgcctatgtcctgaatggtattgcctaggttttcttctggggtttttatggttttaggtctaacatttaagtctttaatccaccttgaattaattttagtataaggtgcaaggaagggatccagtttcagctttctacatatggctagccagttttcccagtgccatttattaaatagggaatcctttccccattccttgtttttgtcaggtttgtcaaagatcagatggttgtagatatgcagcattatttctgaggtctctgttctgttccattggtctatatctctgttttggtaccagtaccatgctgttttggtgactgtagccttgtagtatagtttgaagtcaggtagcgtgatgcttccagctttcttctgttggcttaggattgacttggcaatgtgggctcttttttggttccatatgaactttaaagtagttttttccaattctttgaagaaagtcattggtagcttgatggggatggcattgaatcgataaattaccttgggcagtatggccattttcatgatactgattcttcctacccatgattatggaatgttcttctatttgtttgtatcctcttttatttcattaagcagtggtttgtagttctccttgaagaggtccttcacgtcccttgtatgttggattcctagattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgggctgagacgatggggttttctagatatacaatcatgtcatctggaaacaaagacaatttgatttcctgttttcctaattgaataccctttatttctttctcctgcctgattgtcctggccagaacttctaacactatgttgagtaggagtggtgagagagggcatccctctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatatggtttttgtcattggttctgtttatatgctggattatgtttactgatttgcgtctgttgaaccagccttgcatcccagggatgaagcagacttgatcatggtggataagcttttgatgtgctgctggattcggtttgccaatattttattgaggatttttgcattgatgttcattagggatattggtctaaaattctctttttttgttgtgtctctgccaggctttggtatcagaatgatgctggcctcagaaaatgagttaggaaggattccctctttttctattgattggaacagtttcagaaggaatggtaccagctcctccttgtacctctggtagaattcagctgtgaatccatctggtcctggactttttttggttgataagctattaattattgcctcaatttcagagtctgtttttggtctattcagagattcaacttcttcctggtttagtcttgggagggtgtatttgtccaggacttgatccatttcttctagattttctagtttatttgcatagaggtgtttatagtattctctaacggtagtttgtatttctgtggaatcagtggtgatatcccttttattattttttattgcatctatttgattcttctctcttttcttctttattagtcttactagtggtctatcaattttgttgatcttttcaaaaaaccagctcttggattcattgattttttgaagggttttttgtgtctttatttccttcagttctgttctgatcttagttatttcttgccttctgctagcttttgaatgtgtttgctcttgcttctctagttcttttaattgtgatgttagggtgtccattttagatctttcctgctttctcttgtgggcatttagtgctataaattgccctctacacactgcattgaatgtatcccagagattctggtatgttgtgtctttgttctcattggtttcaaagaacatctttatttctgccttcatttcattatgtacccattagtcattcaggagcaggttgctcagtttccatgtagttgtgcagttttgagtgagtttcttaatcctgagttctgatttgattgcactgtggtctgaaagacagtttgttataatttctgttcttttacatttgctaaggagagctttacttccaaatatgtggtcaattttggaataagtgcggtgtggtactgagaagatgtatattctgtagatttggggtggagagttctgtagatgtctattaggtctgcttggtgcagagctgagttcaattcctggacatccttgttaactttctgtctcgttgatctgtctaatgttgacagtggggtgttaaagtctcccattattgtatgggcgtctaagtctctttctaggtctctaaggacttgctttatgaatctgggtactcctgtattaggtgcatatatatttaggatagttagctcttcctgttgaattgatccctttaccattatgtaatgggcttctttgtctcttttgatctttgttggtttaaagtctgttttatcagagactaggattgcaacccctgcctttttttgctttccatttgcttggtagatcttcctccatccctttattttgagcctatgtgtgtctctgcacgtgagatgggtttcctgaatatagcacactgatgggtcttgactctttatccagtttgccagtctgtgtcttttaattgaagcagttagcccatttacatttaaggttaatattgttatgtgtgaatttgatcctgtcattatgatgttagctggtgattttgcttgttagttgatgcagtttcttcctagccttgatggtctttacaatttggcatgtttttgcagtggctggtactggtttttcctttccatgtttagtgcttccttcaggagctcttttagggcagccctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccaagagatctgctgttagtctgatgggcttccctttgtgggtaacccgaccttcctctctggctgcccttaacattttttccttcatttcaactttggtgaatctgacaattatgtgtcttggagttgcacttcttgaggagtatctttgtagcattttctgtatttcctgaatttgaatgttggcctgccttgctaaattggggaagttctcctggataataccctgcagagtgttttccaacttgattccattctccccatcactttcaggtacaccaatcagacatagatttggtcttttcacatagtcccatacttcttggaggctttgtttgtttctgtttattcttttttctctaaacttctcttctcacttcatttcattcatttgatcttccatcactgataccctttcttccagttgatcaaatcggctactgaggcttgtgcattggtcacgtagttctcatgccttggttttcacctccatcaggtcctttaaggacttctctgcattggttattctagttagccattcgtcttatcgtttttcaaggtttttaacttctttgccatggcttcgaacttcctcctttagctcagagtagtttgattgtctgaagccttcttctctcaactcgtcaaagtcattctccatccagctttgttccgttgctgatgaggagctgcgttcctttggagaaggagaggtgctctgatttttagtttccagtttttctgctctgttttttccctatctttgtggttttatctacctttggtctttgatgatggtgacgtacacatgaggttttggtgtggatgtcctttctgtttgttagttttccttctaacagttaggaccctcagcttcaggtctgttggagtttgctggaggtccactccagaccctgtttccctgggtatcagcagcagaggctgcagaacagtggatattggtgagcagcaaatgttgctgcctgatcgttcctctggaagttttgtctaagaggagtacccagccgtgtgaggtgtcagtctgcccctactggggggtacctcccagttaggctactgggggtcagggacccagttgcggaggcagtctgtccgttctcagatctccagctgcgtgctgggagaaccactactctcttcaaagctgtcagacagggacatttaagtctgcagaggattctgctgccttttgtttggctatgccctgcccccagaggtgtagtctacagaggcaggcaggcctccttgagctgtagtgggctccacccagttcgagcttcccagccgctttgtttacctactcaagcctgggcaatggcgggagcccctcccccagccttgctgccgccttgcagtttgaactcagactgctgtgctggcaatgagcaaggctccgtgggcataggaccctctgagccatgcacgggatataatctcctggtgtgccatttgctaagactgttggaaaagtgcagtattacggtgggagtgacctgattttccggatgccgtctgtcacccctttctttgactaggaaagggaattccctgaccccttatgcttcctgggtgaggtgatgcctcgccctgctttggctcacactcggtgcactgcacccactgtcctgcacccactttccgacactccccagtgagatgaacctggtacctctgttggaaatgcagaaatcacccatcttctgcatcgctcacgctgggagctttagactggagctgttcctattcagccatcttggctccaccagtcagtatgattttatacctagaaaaccccatagtctctgcccaaaacctcctagatctgataaacaacttcagcaaagtttcagtatacaaaatcaatattcaaaaatcggtagcatttctatgcaccaataacatccaagctgagaaccaaatcaagaacacaatcctacaatagccacaaaataaataaaatacttaggaatacagctaaccagggaggtgaaaaatctctacaatgagaattacaaaacaatgctcaaagaaatcggaaataacacaatccaataaaaaaaattcaaccatcatgtgtaggaagaatcaatgttgttaaaacggtcatattgcccaaagcaatttacggattcaatgccattcctgtcaaactaccaatgacattttccaaaaaatttgaaaaacccattttaaaattcatatggaaccaaaaaagagcctgaatagctaaggtaatcctcagcaaatgaataaagctagaggcatcgtattatctgacttcaaactatacaagtcaacagtaaccaaaacagcatgatacaggtacaaaaacagacatatagaccaatggaacagactagagagcccagaaataataccacccacgtaaaatcatctgatctttgacaaagtcaacaaagacaagcaatggggaaaggattccctgttcaataaatggtgctaggataactaactagccaaatgcagattgatgctggacctcttttttatatcatatacaacaattaacccaagatgaattaaagccttaaatgtaaaacctaaaactatacaaatgctggaagataaccaacaaaataccattctggactttggtcttggcaaagatttcatgacaaagatgccaaaagcaattgcaacaaaaataaaacattgacaaatggtatctaattaaactaatgagcttttgcacagcaaaagaaactatcaatatactaaacagacaacctgcagaatgggagaaaatatttgcaaactatgcatctgacaaaggtctaatatccagcatctataaggaacttatacaaattaacaagcaaaaaacagccccatcacaaagtgagcaaaggacatgaacagacatttttcagaagaagacatacacacaaccaacaaatatgtaaaaatgttcaacatcagtaatcattaggccaatgcaaatcaaaaccacaataagatactatctcacaccagtcagaatggctatgattaaaaagtcaaaaaatactgtttttttttttaatttgctggcaaggttgcagataaaagggaacgcttacacactgcttgtgagaatgtaatttagttcagccattgtggaaagcagtttggtaatttctccgagaaattaagtcagaactaccatttaacccagcaaccccattattgggtttatacccaaaggaatataaataattctaccataaagacacatgtatgcatatgttcatcacagcactattcacaatagcaaagacatggactcaacctaaatgtccatcagtggtggactgcataaagaaaatgtgctatatatacaccatggaatactatgcagccataaaaaatgagatcatgtcctttgcagcaacatggttgaagctggaggccattatgctaagtgaacaaatgtaggaacagaaaaccaaatgctgcatgttctcacaagtgggagctaaacattgaatatatatggacacacatacacacacacacacacacacacacacacacacacacacacacacacacaaaaccctaacatatttcaaactttttcagctcttttcacacctttacctctctttcttgtcccctcaccttcagccaataatactgtctccaaccttacaggaagatataattcccagtaggtgaattctcttatctttctcataccaaccatgcaattaagggcacttccgcaaatccctttctgcttattccccttctcatgagctaacactacccgttacctattttctctctgaaatagctgtcagagccctgtcaattaagtctttaccaatggcttttaagcatactcaagtctcttccatcttatctagaaagtcttccccaaatcctacatgtcctgttcttctcttcttataagttttgtctctctgttctcattgcatccaattttccagtcctcactcactcttcactccagtctacctttttcctcataaaatagctttcgctaaagttgccaatgacttccatgtcaataactccaaagaactggtttaaacctgttatttgagcagcattttatattgctgaccatccgatctttatcaaaatatatcatcctttcatttttgtaactctacctatctttgtgatattcttccatctcctctgtaggttgatcttcgttcacatagatgtgagattaagttccttaaagcttggttccagactctcctttcttctcactcttttgtgtatctctaggcagtggcatctatggccatgatgtcatgtaccacctgtacacttatgatacacacgggtgtatctccagtgtggacctccactctaggctccagacacagacttaagtgtctacttgatgtttcttttctccctctcaaagtcaccctaaaccaaacatatccaaaattgaattcaaaatctgccttccaaatctgatctgcttccaatgtccctatcccagtaaatggtaccaccaactgtcagataaacttagtatcaaccttactcttttgttcccctggcttttgtttaatctatcactgatttcttcccttacctcccaactacatctgatacccctccacttccctccatccttataccacagctctagccaaagctctatcatatctggccttgtaacttcagcaattctctgctggtctttccccagcataccttggcttctcaccaatacttatgtgccaagctaaaaagagctgtctaaataacaaatatgactttgtcactcagttattttcagtgactttcctttgttcttgggattaaatatccttactaccaccccaaagccttgctttgtctggcctctggatgtctcttgggcttcaattagcatgattaccaccctccaccccccacccgcagcctctctctcctgaggtctctctggcattctttcagttctcggaatttcagtgccctgatctgctacagggttttgtctcctctgccccctgctcccattctttacctagttaatgcctatttacttctgagctattccctctgaggtaatatggccccaacaagaactaactctctcattaatttcctctggtagcaccatgtgtctgtctttgacggtgcttgtcagctccaattttctgtttatttctatgaacgtttgattaagtaaatgcctcactaaaaggtaaataagctctataagggcaggacctcatctgtttcctttaccactctatctccaagacttagcttagcacccaacatattgcaaacactcaaaagaatttttgttgggtgaatgaacaaatgaataaattgactatttactattttgttctcagggatgtgctgtctctaaaatagtctgaatttgaatattttcgagactgtaagagattgtttgtctaacattttatttttcacactgcacctaacatctgtccttataataaactaggagcatctctgttacaggaatcatgttcagtagttttttatccataggacccagcacagtgcctaaaagatgacaggtctcaaaaagtgtctcttgaaagaacagaactgtcaatcccaactcaaagatgctgtattgtataaagagaggctaactccaggcatggtactgtgcacctgtagtcccagctatcagggaggctgaggcgggagaatcacttgaacccaggaagcagaggttgcagtgagcaaagatggtgccactgcactccagcatggatgacagagcgagactccgtctcaaaacaaagacaaaaacaaaaataaagagaggctaactgtgtagactgtgaagttagctttctgaactcaaattctggttctgtcacatacatgaccagggacaaattacttagcttccttaagtctgtataaaatggaggtgataatacctacgcctcatatggttactgtgaacctcatatggtttcaccgtaggatttgtgagataatcctatgaaacaacagaaaacaaagtatagtcaactatagctctcagaaaaatatgatttctaaagagatcttattcagactagaaaactcaaagacatggtaacccaaaagctggaagatcctgtgcacaatgacatagaagaggaaaaaactaaaagaacatggtgaggctccccaggctataagttacagcatttcaaaaagaattgcattggggcagtcatggaactagagaatggatattatattctaagccttaaaaacaaaccaaaattctcaatcactttattcccactaagattcattacattgcctctattattccctaagctgatccctgaaccacctaagccaaatgagaactaaacaatagcttaatgactggtctgacaggttcttctgggacagaagaaaagcaattatagggggaaaataacctcaaccaacctcccacttatttaagcagcagttcagctatactgcttcttaaagatctaagatttgtgcctgattgtatatatccctacaggtaaaataatatgatctaatggtcccctgaaagtctgcatgaagaatttcagaaactttgtagatgtctttgatgattgatattgtccttaatggaaagcagaggcagtggccttcctttaataacaatccataagatttaagaaacggatgggtaactgtttaaaaaataaaaactgatctaagagaaactacatagaactttccctgactctcttgtactttattttttatttttttattttgagataattgtagattcacatgcagttataaaaaataatacaaaatcagtgtatcttttacccagttttcccccatggtaataatatcacaaccaatatattgacattgatatggtcaagatataaaacagttccattatcagcaggatctcccatgttgcccctctaatagccacacccagtttcctcctattccttcccttcttaatccctagcaactactaatctacactaatctgttttccatttcataattttgtcatttcaacaatgttatataatttgaatcatatagtatgcaacccttggggattggctttttccattcagcataattctctcaagattcatctagatcattgtatgtatcagtagtttgtttcttttattgctgagtagtattccgtggtgtagatgtaccacagtttgtttaatcattcacccactgaaggacatctgtgttgcttccagttttaggcgattataaataagactgctataaacacttacatacaggtttttctgtgaacacagaagtctttatttctctgggataaatgcccaggagtgcatttactggatagtgtagtacttacatgtttagttttttaagaaactgccaaactcttttccagagtgcctgtactattttacattcccattatccatgtatgagtggcccagtttctccacaaccttgcaagcatttgctcttgtcattactttttatttaaccattctgctaggtatctctgactctcctttaaaggtaaaagataagtataaggacttgcctaaaatcagggataacactagacactttaattcagcaacttaaattttgtcctgtgtttttcctaaaatatgatcagctaaattcagaaactttcactcttaggccatcagaaaattttaagaattaagtaaggatgaacaaccagtcgagtgacccaatttcacctgaaacattccatcaggtacataatgtttcttatgactttttatctcatttagaactactatttgttactgtgattctcttaagcaaatggttttgcccacacagagctattcgctcactgacacaggtttaactggttaaagaactcacagattgtttctcactattaacagatattatattgttttaccatcagttataccttacttctgcttctatctttagaactgcaggcttcggtcatttttaaagtcgttcaagtttagattgcattgacattaaatcaaattatagaggacaaacaactatgtattttcactgaggtagacacagtaaaaagttcccaggctttctctcctacttttagataggtctttttcagaagcttcctaactccctaagaagtctgagagttattacaatttctttatcccctgcttacatatcccatgccatagaaaaccgtttaatagaacctactgtagcagaggcaaaatttcacctctgctctcttagagtcccaggtagacctgataatgaaattgacataagatagattaataggagaaaagcacataacttttacatgacacaggagccctcataaggaaatgaagacccaaacaagtggccaaacctaaatgctgttatacttggttgaacaaagagaggcaattgtggaaaagtaactaaattacgtgtgaagactaaaggaagatcaataagaatattttaacaaggtctgtgtgtacaggattcttctggctatgactccttgtcaaagaatgtttcttttctcttggtagtaggagagcaactttcacatgtgagtttttatctcctgttttcagggggaagaaaaagaaaatgattagactgccctttttgcatctgctgttattcaagtgcccttagttcaaactaatccttataccaaaatggcatattctggggtgcatattctgccatccttcaatattaaataacagaacatatgcttacctatgtaccagctatttaatttctggtatatgccaaacagaaacgtgtatgtgcgagccaaaacaaatctacaaaaatgtttctaccagcattatttgtaatagtccaaatggaaaacagtccaagtttccatcaacagaagaatgcatacctaaactgccatatagcaaacatatagtgaaatattatacagcaatgaaaatgaaacagtagttttactgttacaggcaacaatatagatgagtatcgcaaacatttatgtggaagttacatggatatattcagtatatgaaaattcatcacactgagcaaatgatttttatgttttttctacatttctattaaacctaacataatagcttctacaaatataatttttaaaaacatgagtaaagaaaccaaaataagaattatgatcatgacaatgatgatgacagaatctttcctctgacctcagataattgtcaccagcctattttcacaaaagtacaaccctccttattgggcattagaattcagagtcctggttttaacaaactgttcatatggctggatatctagctctagtcactgggagactaaggcatttgacctccttccatacaatgactaaagggacacaatggggtgtggttggcagcacctaggtaagtaaataataatgttctggggaaaggagattttatgaagttttggtcacctttctgagaagagtccattcttctagctctccaagggaaaaagacaggatcccagttattatctcccaaatggcaatattatctgaccaatttttgaactttatacaaatggaatcaagtcattcagtatgtactcttttttaattgatttagtcaacattatgtttattatattcatctatattgttgcctatagcagtaaaactactgtttcattttcattgctgtataatatttcactatatatttgctatatggcagtttaggtatgcattcttctgttgatggaaacttggactgttttccatttggattattacaaataatgctggtataaagattttgtagatttttttgggctcatgcatatatgtttctgtttggcacataccagaaatgaaatagctagtacataggtaagcatatgttctgttatttagtagtgaagaatggcagaatatgtaccccagaatatgccattttggtataaggattagtttgaactaagggcacttgaataacagcagatgcaaaaagcgcaccctaatcttttcccttttttccctgaaaacaggagataaaatctcacatgtgaaagttgctgtctttctgccaggagaaaagaaacattctttgatggggagtcacaactaagagaattctgtacacacagaccttgttaaaataattcttattgatcttcctttagtcttcccacataatttagttactttttcacagtcgtctctctttgttcaaccaagtataaaagcatttaggtttggccacttgtttgggtcttcatttccttatgagggctcctgtgttatgtaaaacttacatgcttttatcctattaatgtggtttagtggtgtccccacccaaatctcatcttaaactgtagttcccataatccccatgtgtcatgagagggacccagtaggaggtcattgaatcatgggtggggggttacttccatgcagttcttataatggtgagtgagttctcatgagatctgatggttttacaaagggcacttcccctgcttcgctcagcacttctccttgctgccaccatgtaaagaaggacatgtttgcttccccttccaccatgattgtaggtttcctgagtcctcctcagaccttcagaactgtgagtcaattaaacctctttcctttatacattacccagtctcaggtatgtctttattagcagcatgagaatggactaatgtacctattaatctaccttatgtcaatttcaccatcagttctacctgggactctatgagagcagaggtaaagttctgcctctgctacaatagattctattaaatggttttctatgtgatgggatatgtaagcaaagggtaaagaaattgtaataactctcagacttcttagggagataggaagcttctgaaaaagacctatctaaaagtcggagagaaagcctgggaactctttactgtgcccactctcggtgaaaatatatagttgtttgtcctctatgatttgatttaatgtcaatgcaatctaaacttgaacgactttaaaaatgaccaaagcctgcagttgtaaagatagaagcagaaatgaggtataactgatggtaaaataacataatagccattaatggtgagaaacaacctgtgagttctttaaccagttaagcctgtgtcagtgagcaaacagctctgcgtgggcaaaaccatttgcttaagagaatcacagtaacaaatagttctaaatgagataaaaaaagtcactctgggagggtacacagtgactacactcttggtgagtctccaagcaggtagatacaattacagtatagaggaaaatgtaagatttttgtgaaaggaaactttgatctgataccttaatgctagaacttttttgaaaaagtagttaatgactcaattatgatggcagtccattgtcattctgtaaaaattcattaagtattctatgtaccaggcattgtgttagatgtgatgatataatggtaaacaagagagacacaaagcctgtgcgcaaatgagcctacagtttagcaaggaagacagacaaataagcccaaacaattaagtgtacaaatgggagcacatggggaaaataccaaatgagcctatagcaggaattagggaagtatgttccatggctttctgccaacagcagagaatggtcttggcatccatgataagtgggggtgagcggagggaaagaccaagccccaggacagcacactgaccattccaggagccagcatgggtggcccacacacatggaagaactacagcccagacaagcagggccgcaccaacagagggaccctgccaatcaactcctgagaaacaggcattctcacaacttcttgaatcaccttaatactcagagtttgtgccatttttaagtaagaaaagaaaaacattttggactacagaagcatatatggtgtttattaatattttctttgagcaaaagtttgttctgggacatttgagtccttgctagccagaacatttgcagcaatttactaaactgacaaatggagagataagcccaaaagctacatggccacagggagatcaacacatccatccagtacagatggatcaggagtgaactgtccctttcagtatatttgacatgaaattcctcacctacaccactgttgtattgtatataccattaatagtaaaggtgaataaatacataaataataaataactagtaaaggtgaataaatggtctgttttgttagttactcagcaaatatttattgcatgtcaccaagtgcaaggaccaggctaggttctggaaagaactgggaaattataaaagcaaagatactgatcacaggcagcataacaaggtagaaaaatacatgcactttagagctcaatcacctaaggtttaatctcagctcaacttcttaccaagtcagttgccttgggtctgttacttaactcccctgagcctcatttccctgtcccataatgtgacagtagaacactaccctgaagtgttctgcaggattaaatgaggtaacatatgcaacgcacctaagaaaagccctgcaccagaatttacttattcagaagaagctggcccccaggctctctcctacccctccttctcttcatgccaacttattctttcactgagatttgcaaacttatgtatggacgccatggtttctcattcattcacattccctgccccttggcctccctttgtgtggaacgcaaacttccccctgaaggatagacctgtgtcttggttttggactaccctggcaggaaattctagagtccagatacccagaccatggcttacatgggagggttaggggatatgattacttggacttacagaatgctcaccctgtggggaaggggaaggcaagaggagggtttaattaggatcctctgaaatgcagggctgggcagggaatattgttgctcaagtctaagggcagtatggtttagaagtaaattctatgggagtataagaattttaaggaatagtctttctaccagactatttcactgattgtgtttctacaacaatcatctttccttagctactctgcttcagtagctattttataggaatgctactcatgttcctgccttttcttgctttgaaactcactctgaatctctaacaagtccaaggtcttgaggtgcttgttcattgttctgtgcatctcactctagctgttggataaaagaaaatattacctaaaccgtattcactgtggttgctgttagtgtgtggatttaaataactcttccagctactattaaacatactttgtataatgacaacttagaggtggaaaaagttctagaaatttaagcctaagtccaaacattgaattttttttaaaatttaaatttaaagtttagattcagcgagtacatatgcaggtttgttacagggatacactgcatgatgctaaggtttgggcttctattgatcctgttgtccagatagtgaacatagtatccaaaaggaagttgtttagcccttgcccccctccctctctgttttcggagtccccagtatctattgtttccatctttatgtctgtgtgtgtccagttacttataagcagctaccactaataagtgaaaagatgggacatttggttttctgtttttcacattaattcatttatgataatgggttccagctgcatccatgctgctacaaaggacatgattttattgtttttatgtctgcatagtattccacactgcatatgtaccacagggaaatggaagttataaaattacaagaaaaaaatcaacagtatccaaattctaataaagattattagctatctttatagccacaaccacataattgaccaaaatatattcactcaaatttataacaacagaattattaatcactcaattcagtggccatatgtagctatggctatgagttatttatcactcagtggttatatatagatatggctatgagtcattttaaaaaaaagagccttctctctgtcaaggagacatgattcatcgaaaagtcagaagcagaagagtcaaaatccctaacagagaagtcaaagggtagaatatgctgagatcaggaattataattcatgctctgtgccaggataatccaggtatagcatcctgacatccaaggggcatatgcaaagcttggtgcaagctgcccaggccaaggctggctctaaggcagatgcaggaaggtcaaccagctggctggttaaaaggaaacgatgaccttcctctaggtctcttcattaccctgatatattctccttgttcagggataactagatccacttaactcttctcctacaaagattcattcatctcttctcctagttcaggtatgactcgctcccctcactgattcactccagggctcatctttaaaatacagatgcaaacaggctgaaatatccccaaggctaacagcttaaaatatattaaagatgaataagtgcacctggggcttcaaggactaatgccataaaactgtcatcatttcccaccaaacgttatttcacccactcacttgatgtacatctgtggcctgttcacactgcatatggctgtggacagaaaatgcctcagttcaaaactgacacagtgggtctggaagaggcttctgctgtggctttctctctctggttttagctccgaaccttgtcaccctaacataaggacgatgaacaagcccacgtggaggctcagaaggttccaaatatggttccaactctgtgtctgactaactaatgtgtggcctgaacaaagtattatttaaaaatctaaaatgccaaaagcaactactctatttctgctacatttaaacctgtcaatcacgccccaaacttctaccagcttcctcaattcaccacatgcattatgtgtgagctgcatccatccacacctgttgttacaactttccatttgattgcaaataattccaattcatcataactcacaaatctcacccatttccacaagcaaacttcaggttttttttcaacatgaggttgaaagagaagagggaaagagtggaggaaaaggagagaaaagagagaaaaaatacggaaatacacaacgggtcaatatcaagtccagataagctttcttcatggctgtcacacacaaaagcactgtggctctcagggtcaccctttctgtcctagccacagtgcccaatcactgattcattctcacaatatcaatcaacacacagctttgctgccataactggatgtagtcattccttcccaatgtcaatgtctatgtgttttttctttctcaatcataatatgatatcaaggtctctccacatttctgttatctggatgtcttcctaattttatcttcttgaagacctggttatgtaaacaagtcctgtatacatcatgaaaaggcaaattctggtagcccacattcaatcattattgattactagtgccctactgataactccttctgatttgataacaactcaccccagcctgactcccaatggacccacctaataattatcatcttccaatttgagaagctaataacattaacttgttcatcttgtcaagctagtgagtaagggaatagaataattattgtaaatcacattacagacctcaggcaaagttcatcgcagtgatcccagtagccacagggtaatgtctctaagcatcaggatttctgagtcatctcctgctctgacttcatgcctagcccttctgccagaattacacaagatgtgtcctctaattccccagttatagagtccctgtgggtcctttatcccattgtgggtagtatttcctatttaggagacacaagcccagcacactcaagccactgcccccgagagctgctgagtccattcagctgccaggatggaaagaactctgaaagggaggaaactagttttcttgtaaacttgtgttttaccctcccagttgttcttaatgaggctaagactccccaaataagtataaagagaaaagaaggaataaatacgattctagatttcctacccctgtttccataagagtaattttgccttcacctgctttattttgtgcattccatataattttttaatggattccatttacaacctaatgatagtctgaaaacagctgaacagggtgaccttctagtcccagtctcctatatatagcaaaatacaccaaaggcctgttctaggagtatgagcagaagagacagccacctgtatgcaatgtgatttaaaaaataaaagatgcctaccccaaatcatctccttcccatgctccttgcaatttccaaattcttcacactgtcagagataaaggaagccagacactagttaaagtggggaggacagatttgaaccactaatacgctattgcaatagggaagggagtgcagtgtgaactgaactcaaccttgatttgcacagaggagactgtgtatttcagaagaggaatgagagagtagaaaagggaaggggtgagagcaggctcagtgaagtcagagagtgaaaaattacaaagggttggtcaacattaaagttgattagacaattatgggagttaggattctatctgcccagataccaaaagacagaggccctctctctcctgatggttactttttagaagaatggctcttgggtccttgagaaagacactcttgagcagtaggaagtgcatatatttatcaaaggttacagggcaaggattcacaattgtaagccctttttagtaaatgctctaagaaagggtggttgggcctagctccagggtgttggctagaagaaatagtaaactctcctggcaaccttgagcttcctcaggcaggcatcctaagtggggtagggtagtcctagggatgtggccttgagctgttagaaattattctagtgtttgtgtaagtcttttaatgtggggcacgagtggatgaaatcattggtgttgagaatctgtagttgtgataggaagttaaggcctagtcaagaagggggttcagaggagcatggctaaagtttggtaagttagagaatctttgtcaacacctagaaaccaaagatgctatttttaagtcattaactgatagcactaatatgtcaaataattttaaacttgtgtccctttactgatattaaactattatcaagcagcttagcagcatggtcacttggtcagggctctggggttggagacagcctcacagggtaggttattggagagcgaggaaaagaatgaagaattccagacacaactgctaccactccgaccaaacactgacaacttatttccaagtaactgtcctgccaagcttgctttaaaacagaaaggtaagacttatggtagtataaacagtggacttgccaaaagtcttttaaaatagtttattcttttatgtagagtaagaagaacccacttggaagtttctttccttggcattgctcagtaagcccttttgttccaataatatatagataaactagaggtcagtcattttaattgttaccaacttgaattttactgtaaatatgtgtttgtggcatggctatcctgagaaatagcaagtactcactttgataactcagcaaaggttcattttcttaagggtagaaccctagtgtgtgcttccaccttttccacagaccacatccacctatttcagggtgcccgtgcttcctgagtcccattcctccacaacacaatttggctgcaagctgcccagatagaactggtttataaactggaaagccaagaacttcagtcttcaaagcaggctagcatatgctgttcatgtacaaacaagtgaattcttacttcatacaaaaatctcactccctcctctctttttaggttgtcacaaagtgtctgaatggctgaatgattctgttgataggatccatggtctcttcttgcagtttccttctctgtctgccaatttcacacttaccctcaattctaacagttcccacactggcaatacccatccagtggggttgggttgggttgccagataaaatacaggatgcccaattacactgaattttatataagtaatggataatttttagtataaatacatgttattttaatttcctaatttcagcaactctattcctagacaaaaatccactatccaattattttatcttcctggtgtataaaacattattctggaaagttgtagaactatgataactgcttaaaatataaattgataggctggatgtggtggcttatgcttgtaatctcagcactttgggatgccaaggccggtggatcacctgaggtcaggagtttgagaccagcctggccgacatggtgaaccctgtctctactgaaaatacaaaaaaaaaaaaaaaaaatttagctgggcatggtggcaggcacctataatcgtagctacttgggaggctgaggcaggagaatcacttgaacccggggggtagaggttgtagtaagctgagattgtgctgctgcactcaagcctgggcaacagagagagactttgtctcaaaaaacaaacaaacaaactatatatatatatatatatatatatatatatatatatacacacacacacacacacatatatcaattcatagatcagttgtttccaggagctgaagatgtggggagacactggctataagaaggagggagagcttttgaggggaggtgatcaaactgttctatacattaattctggtggtatacacatgactatatgcatctgtcaaaacttatagaactctacaataaaagggatggattttactgtaaataaataatacctaaataaaccagacttttttaagtggaaaataaatgtacactactcggtatcagacggccctcacacatttcagacaccattttattcctcccttagtatcaccagagtaaatgcctcacaacagctattctatttttttcattctccataggttcacaattccaacaccacatctctccctgcaaacagatttgttcagtcacgcaaccagagtgtaatcttagctggatctggaactataaagatgaaaatagagttcctaccaaaaaacattcctcatgggctagtaggcaaacagaaacaaataataataaaaaaaaagacatacaatgtaaaaaaaatctgtataatgggcaattataagatgttgtactgtacagaggaatagtaaacagtaaagtctcttcaataactcaggaaaagttaaaaatgctggagttcagccttcaaagcagggagttatataggtagataaaggaaggtgagtagccggagaaaaaaggcagacgatcagctgcacaggtgggtcagcacaaacgatgaaagccgttgacactcaggtgctgtgggaattcttgcttgccgtaacagaaaccggccttggctagctggaggagaaaaaagtagactccattggaaggacatgcaggttcagactcagtagaagtcttcatcactaaggacagaaaatgagcaaaaacccaggcgcgcaagatgccaaggagcaagaatcacgaccactatcctgtagcaagaattacagccaggacactgctgctgccgccgccactgaaagccaatgggcgccaccactgacaccaacaataagttctaacagcctcttgacctttaacccattcgctctagagtcagagtcccagcctgagtcacatggctatctatgagcagtgccaggggctgccagaatgcacagggaggtaaggacagcctctttccaaggttccatacacacgacatgtccatgtgactcgcccggaggtcccttagtagccgtctctttggcagatccaccttcgaggtatggaagtgcttgtgttcaaggaactcttagtttacttaataatggcccaaagtgcaggagtggggatgctggcaatttgaatatccctaaagtgcttcctttaagctaaaaggtgaaagtttgaacctaataaggaaagaacaaaaattatatgctgaggttgccccttcccaaaataggagaggggcctgaatccctagcaccattagtatccaggggctctatacgacagtcccccattatctgcagggcatatgttccaggacccccagtgtaggcctgaaactgcactgatagtaccaaacctaattgcggtcaatcagaacacatttctgtttatgtcttccgcccacaaattcaatgccttttttatcttagctaagcacttattgcacactgtggccataacctttgcagatcaaggtgcaacagcaaaactggcatgaatttctttttccctcttcacatcttcatggatagaagattcatttttagcataaaccttggcaacctcagcatataatttttgtttttttccttattaggttcaaactttcaccttttagcttaaaggaagcactttagggatattcaaattgccagcatccccactcctgcactttgggccattattaagtaaactaagagttccttgaacacaagcacttccatacctcgaaggtggatctgctaatgagacggctactaagggacctccaggcgagtcacatggacagcatggacatgctggacaaagggatgctacacaccccaggcaggatggcatgaaatttcatcacactactcagaacagaatgcaaattaaaacttacgaattgtgtatctcttaaatgttccactcaatattttcggacacggttgactgcaggtaaccgaaaccacaaaaagccaaacttgaaataaagggtgcctccggtaatatggcctgtctggtctttctaacctggattttccccactggaaagaaaatctcttctccaactctgtgggtctcatactagcacgctttcgggacgtcacattttaggctgagtaatattctctgtgtgtcttctggctcatccttccaactcgacatgtgctttctggaagcagttatttcacggcagccatgtgtctttctattcccccttgtgctcagcacactgccttccacaaactagctgcctaatgcatgtctgtgttctgcatggatgtgttccgaggcaactcagcatgtgcagttggaaatgtgccgcttttatttggcagagtcaaatctcctccaaaccagacccttttatttcagctcacagaagatccctgccctaaaggcctctgccttgaaccaaacctcaataagccagattataaaccagccaaaaccaccggagattatgtcaatgtgcatgtggctttggagcgcctaaaaactggcacaaagcatcagggaggctgccagtgagctctctgaagaaagcaaaacagggatccgggcccacggcgcgatgttcagggaatccctgcttacagcgccttttcagacattgcataagctacagaaaagcaaaatctgtgaattatctgtcttttaacaagccaaaagaacctgtacagcatcctatttttttttttttatctagggaaaagaaacaataagtttcactaggctgaggaagaaaagggattacatttgtggagtggatagtcttctcatcccatttaaacacagaaatatttaaagagattgtaatgggaattttatctcaggcctcagatgttaccctggtataatagtttctcctttcatccatgactaggacatggtgatgccacaatcctcccacatctccaagaaatcataatagccttctttcctgacaaagttgttgaagaggaatagaagagaacacagactcattatgtcccttcacaaagcagtcacatcatttaaaaaaaaaaaaaaaaaaaccacaagtactctcatttgcggccaagttcaggccttaaataaaatttacagaataaagtggctatttaagtggagttttattaatattccagcaaaagagatataatgaaaaagctacaaagttcagagaagagtttaaacaatccaattacatataaagacaaataataataatatggattttcaaggacattgtcctcagaaaggggcataaacacaaatatcagcctttgttcctctgtatgtaatagaaaaaagaaaaaataatttcccagtcttccatttctatgagtttttattcggaacttctgttatctctcagtaagtaaatgtaagagtattctctagagagctgttttattatacaacaagtacaccataaagagccatgctggccaaaagtaatgcaaaatggaagtcgagtcagacttccctttcactatgatttgccatccagtgagtcagagcaatatcttgaaactgttctgaatgaaaaatgtttggtttttttttcttctgttgaattaatgttcatgcttcaaagaacagtagaaactacaaaactctagagccacagagatcattaaacccctattgcattacaggagagtcaacttggtttaaagtagtcaagtggcctacccaaggcatggcacagagcccaggcaggcatccaggcctcctctctctatccctgggctcctcctgctgctctccagttttctatccatgccacggtgactgtgaccatgccctttcacagaagtggccacaggcagattctgaagcacctttgtgtagagcctgagagcaggttacagtggtcagttcatgctaacccagaagtggagctggaggggtaaggaagagctatggtcaccactccccaggtgtgtgactcaaatctgaatatcaggattaaaattcctgaaagattgtagacaagccaaatgccaagtccatttaaagactccaaacacagcacctttcatacttactaccttgttaatacttaaaaccaagagaagaagcccatacacagagcgtttcccaagcaaaaacactgtgttgctattaccctgcctttaaaagggcaccatccaaggccaaaattaacctcaaagagtgtagagccacataaggatgtacaaaactcagaactatgcaccagattgaaaatgtagtaattataggatgctggagttagcttgccaaccaaacacagacccatcagccctccaccccaccactgtctaatcaacatgaatttacaggcaaagaagagcaataagcaatccactcacttaagttaaggagagaagactccatgaggcttaacttctgcaaacctcttgcaaagcaaatgcaagagaaacagtttcaaactataaaatgtttgcttccttggaacaagtaaaggacgaatgtcattttcaatctctgcttgagagtgacacaggacatggtcagaactctgtgatcatggaagacagagaagaataagtgagatgacttgatacttgttaggcagtctgctttataatcaaaaggctcatttcttttttctagagattggttttctcagctgtaaaaggggagactgaaccagatgctctttaaaatcatctcctgctttgaccatttttttgcatttacttctttccctttacgctttattgtttaacatttacaataagatgtcaacattaccatgtattaatagtagtggaaggtgcgagctcagtccagcagcatgattttgtgaccgtgggggaggtttataacctctgcgtcagtatcttagtctttaaagtgaagcacctgtctcatagggttgttacaagttcctatatcacatcaaatgagagaatgaaaccaaagtgctgggaacaataactgacgtggaggaaagctcaaaaactcttagccattattatcttttattattacttagttgggatctggtcttaaaggtgaagaatacagaaccagagaaaacaagacaatgtttaactccttgagatcaataaatgttatttctgagaataggataatcggaaaaccaatgaaaaaaaaaagactgacaatattccaaaacttagaaaagctgctatttttcatactggtaaaagtctctcagaagagaaattcccaagggctcagcaaaatgctacaataaatagtgcattctcaaaaggggagcaatttaagagggcactttggcaaagcctcgtgacttatctggatggaattttttaattttatgtctatgcttcaaaataggcaactatgtgattattcctggtgggcctattaaggcatcttgtcaagcttctattcctttaaatttattaattttaatgccatgctacagaaaataccaaaaaaattaaatatgtattctttcagttttgcaggacaaagctaagctcaactctaaagggactaggatatgtaaggaaatcctaattttaaaatcattaattttaaagttaacttccaagggtcatttcccacagggttgtgaatttttatcatgctcctaaaactgcctggattctttagaacattgcgtggctcagttcttgtcatcaatgaactaggtctgctgactctaaatgtaatcaacgcagggtagatgagaatggaaggtggaacacccctgcctcaccaaacactaaaaatgctgaaatgactagcaacctgaccacagcagggcccggaaaagggctgtaattagaaacaatctcatagcatccaacctgtaaagtacattcacaaagagatgttgctactctgcaaatggcaccaatgatgataacaatgatgatgatgatgacgatgataatggtagtgtctattaagcacatatcttccaggcactgttctaaatgctttaggcataatacctctgaggtaggaattgttgcctgtcacacatccattcttcacctttctccttctctgctctgtattaaagagaggcaatgcagagtcccttgtcagttgacttctggctgtgtttggctacaagactggagggtcgaaagatgggaacaccaagatatttctctcctctctcggtgccttgagcagaatctctaccatcaaaaagctttctcccatgcctcctccagttacaccataattccagtgacctcagtctgtggacccagtaacactgtctccaacatattgtcccttcaaattagaattagtggatgcttcctgctattgctaatattcgggttgtttaatgaccccatttggcttttcagctcttccctcagctgcatagccaattaaattctctctggttcaaatacttaagatgactcatcttttttttttttttggaccattatcatccacattttccaaattagaaaattgggagtagtttgtccaggattacagagttataaactggcaaattttgagtccagtgattcttaagtcatacctcttggccactacattatattgcctcttcttaatgagacaacataacaataggttagacaataaaaaaggttagaagtatatgaaaaggctcctatctacccctgcttcatgaacaatgatcctccacatacttgctatcttgctgccaatccttctccaacggacatagcaaggggttttgtatggactgtgagtttcgctttgctaagggatctaagtttatacttcagtcaataacaatagagctctctattcgttagttttggttcttgattttttttttctgggcaccttaaatttcctgtaacaaagtgaatatatcatgaccttccttaactaggtatcaatctcttatagagtagaaagttatatcaatggtctattagacaaaggtataacagtgaccaaaatgaaggacccataaagcctttctgattctctactaagtactctttccacaaaacatttctcttgcattttatcctataacctatgcaataaaatctttatgcaagaattgttcaaattttcaccaactacctcagtcttattacgaaagcaatacaggagctaagtagcacacaagagataaatagtttaaacacacacacgcaaacagatgaatttactcaattttaattgatcttattatctatccaaagattttttagaaaaacactcatctatatagtcttctgtaaagaagttcaacaaaattccaaccgcattttgacatagttcattcactatgttcatctgccaagatttaaaataaattatattgattttctgattattaaaataatagacatattgtggaaaaagtgaaaatacgaagagtataaaggagaaaatagcaataattattcaaatcctagagataatatttattaatactttgactttttttgcaatcttttaattttttgtctttttttatgtagttgagattatactatatacgtattacatacacgtatatatagttttaggtcttactctctaaaaaattaacattatattataaaaaagggtgagttcatgtcctttctagggacatggatgaagctggaaaccatcattctcagcaaactatcgcaagaacaaaaaaccaaacaccacatattctcactcataggtgggaattgaacaatgagaacacttggacacaggaaggggaacatcacacactggggcctgtcgtggggtgggggaagggggagagggaaaacattaggagatatacctaatgtaaatgacgagttaatgggtgcagcacaccaacatggcacatgtatacatatgtaacaaacctgcatgttgtgcacatgtaccctagaacgtaaagtataataataaataaataaataaataaagggagagaaaagtaagaagcaatgaaaagaaaattaactatttgatgagcatctaaaatgtgtcaggaattactaaataaaagagctcttccctctccaaaaaaaaaaaaaaattaacattatattgaaagagttttccttcatcatttaaataatcttacttatatttgttaaatagttgcataaaactatagcaaatgaacctgccacaaattatttatacctctacttgaatattaggtactattcaactttttattattaatagtatttctgcaaccatccttatgccaagatgactgaatttcagatttttctctaggctagattcctaaaataggataaatttctaaaactgcaattactgggccaggagagtaaatatgttcaaatgcctgaaacatattatcaaactgttttccagaataatccaaatttctatttaaatgataaaatcactgaagcatttctaaaatatgttcatagtctcttaacaaacctgttttcttttttataaaaaaaaccaaagcttatatccgttgagtaaaattcaaagctactcattcagttaagaactttaaatttatcactactgttttcttctacttattttatttgggtttgtaaaaatctttaaaaatacatatgcaacatgcatgagtttgtaatcgattttgaatttgccaggatgaacttttccactttcacaaggattatggtaatgatgaataagtttttcgtttatcttattcctactgaccttcttaagagaaattcaactggaaagttctcctagtgctgagtggctctgacagtccagagcatgtcagatgtgggtcctgctggtgacattctaacataagctgaagaaagcaatctgttgacattcagaaagcaataggcagaaaggaaagctacaattttctatgttcaccttgtagaattttagaaaaagtattcagatgctgttctctaatactcaaattaccattatttactgcctcttacaaaaatgacaggaaaatttgttcaatccatttcccatggttttgcaaaatctctagcaaattgccagtctaatattcatggttgtgcccaatctactgggcagtagccatgactcatggtgagatattaagcaacagccatgatgcaggaatcagaatgtgcatcccctggcctcagctctgccactaattgtggggtctgagccactcacagcaacccagagtctcggtttttatatctataaaatagagtctggaataaaggggataaacactcctatttgctcttacatttcatgattttgattccttagtaaagcattgtttttcaatgctaattaagtattcttcccacatttctataacccagttccccttaagaacaaaattccaatgatgatattctgccaactttggaaatgacactatataggctaattatttaaatcattaattcattccacaaacaatgcattgttcttagtaatgggcttgaagtgatgaactagagagaagagtttcctgctcctacagagcttatattctgaattgtaaacatgtgaacaaatagacaaacaaaacaatttaaggcagacaattaaacagggtgatgggttagaatgattgggtgatagcaaatttgctattttcagtagggtggacagggtaggtccttctgaggaggacacttaagctgtgaactgaatgatgcataagagccagtgtgtccaggacatgggcagaaagaatgtcaagtgcaaaggccccaagcaggaatgagctccattagttcaaaaaacagagagggccagtgtggctggaagttaaggagcaggagaaagagtgggtaagaaagaagattcttaggagccagatcatgcagacatttgtagaaaacataaagggttttgcttttaatctaagagcaatgaaaagctgtggaaggtcttaagtaggggactgacatgatctaaagtatactttaaaagatcaccctgactgttgtgtagagaataggttgcatattttatttccagcaatatactagaaaggactccctgttctctcacagaaatattgaaaatactagttttggggaaaaacaacaaaaaatgctggataaaatattctaaaatatttaaatgcagacatgatttagaaagtaaaggacatgcccagacaccaaaatcaatgagaaagcacaagtctagacagctaaaagcactactgaagccagctgctatcccgatagcttcagcccacctctcataccctggaagagtcagctacatataattccttgcacactgagaagttcacctgccatgatgggaaaaagtagaacagaggaaagaaaatacaaaagctatcatggtgccaaattgcaaagcgaaaactcaggattacacaaaacctccatagaactgtaacctggacctggtattcccttctcagttgttttctgccgtttttggagtaatcacaatcagcccaaaagattaaagctggcctttgaaattaaatgggcatgacctaaattattgcccgcctactttgctgaggtatatgcccataagccctacaaaggacacaataaacactcaagtgtttcttaatttgacttgtctcagtgaaacaacagaagtcttgatactgtcccttggccatggggagagaattcagggtgaatatagggtgaataaaagtgttcaacatgtcttcccttcagccagcaaattcctttcagttagcaaacaagaacctggggagcaacactcagcaatgattctatgattccttcttctttttccattgtttctcctcacaacttctcatctgatgctccaaacacagaaaaaaaaatccaggcagagtattaggaaacatggatttatggattgctccctgcaaactaatattaagtttaaaaaatgtctcttgaaccagtaaatctacctctgagaactcaaattttaaaaaaaactcaagtatggaaatggtctatatataaaagtattccacacagtattaattagtcttagtagaaaaaaatatttgaaacagctaagtgaactatgacacacttggtagaatcattatatatacattagagttgaaaattcttatgaaataatgtgaagtccaactgcttaaaatttcatttttaatatgatgactttcatggaactctagaatatttgttctttttttgcggcttgcctgtatattacaaaaattatttaaggaattgatattacttttataactgaacatatattttaaagacaaaatatataaaaacagaaaatgcatactttaacttcagtatcctaacattagataaggaatggaaagaaatcccatatacaaattttctttgaaaacagaatctgtaattttattttgctaagaatgaaattggggaccactaggaaaaagaggttaatgcttttaatattaatacaaatagtgtcaattatcatgtagatacaaagcaatatcttcaaggaatcacttttccaagctgtatgtaaattactaaattaaaacctaataccacaaagtaaatttggaatcaaataggtaaaatgtgatatacagtggagcatagcacaataggaaaatgttgaatgcattaggatagagcaatgacaaatactagtgaaaagccaattgctgtttttctcacatgcagactatagttaatgcactgccccagccactgaacacatctgacttaagctgaaggaactcttgcatggatattttcgtattaaatacatgaaagaaaaaaattctaactgaaataaaactaatgtaatttatattactattgttaattaaaatgttgaggctttcctagttacgatgaataaaaacagatcttacaattacagacccccacatctaaggaaaatcaaatagagactgagtgtatttctcaaggtagcaaatactttttattttcctttttcctatttgcaccattcatcagtagggcaaatttaaagatcgaatcatgccactttaaactgttggcatttactatctaaggcagaattaaaagatttcatttcaagccaaagtccatgaatacaaacgtcaatccaatcacttacttgggctggaagaaggtaagaggactctttctgaaatttataaacacaatcccaaaataaaagtttcaaatgatgaaagcagagttttctcaagccattctttccaacagagctgatagaccctgattttttttatatagcaggtaagtaaatcctaaatcctaaatctttttgaggttttcgtgtctcttttctacattaacattaaagtaattacaaagtgaatttttaagggtggcaaaaatatacatgcatgtatcagtacatgttttgagaggagagtggattgggaagcaattgtgtatacttcttgtttaaaacaatgtaatgcccacttcatgaattcagataacaacatcaatgaacagattgccaaccagttggaatacaggcctaggttttgaaccacttgaataagcctcctaagtaggttacagagtcattcatggagattatagggaaggatttcaaatagcaccatctgttagaaccagcaccctgaaaatattaccctagccaattatcacttcaaaataccacaggagttcactccacctgtgttggaacaacttggctacaacccatagttacatcctggtgtcagctttgtaaaccatggctcaggttcgagcctatcagtcagtcttgagacaccagctgctcctaggtgcacttccgtgtcttcccacagatgactcctggcaacctcatactggacaagccttcaggctttccttgtcaagatcttttcttctaggacctcaactttaacctacatcctttctcatctctccaggctaggagttctccacatactctgcccaccctgatagcaactgaggtaggccagaaacttctcatgcactggttacctcctgagccatccacagaaagggtcacagcctagatgcttacaggtattcagcaggttacattcaatgagtgaaaagtaggccaaacacaagatatcagaaatgcgtcgatggttgggggccagcaaatgcaggccccacctaaggatgacaactattgctcagtcccaggatgttgtcaacacgcaggatgcaggacaggtgtggccaaatggcctaactattcaatatatatgaaataaactaattttcagatttggctcacttttttctaaaactgtttgggccaaacaaaacatcttattttagattttttatggtaatcaaagggtcttgattcgagtttgagtggctctaaaaacacctagactgtgaccccaaaaagatccctactctgtttcctcctcttaaatttttttcaagagcttcagctgctataggcatttatctgagaacatgagccaaggttcagaggctgtgtgccaaagaattccagcttacacctgctattgtttcagtggattaaaaactacaacaagcagataaaaaggtctcaggtgccgttgctgatctcacagagctgagcatgtgctcaggcatttttggcagtattctctgaaaaccagtttagtttcctggatcatccagaagtaaatgtgagaaactccgtttgtggccctagaaaagaaagcctcagcacagagccaaaaggccacagtcaacaacagcatagtataatccccgtctagctcagtcttatgacagagatcacctactttatggcagagattagagttgcccactaaatatccactcatcttcttctcctttcataacagaatcccatttttttgctaggtatatttctgcttggccaaatagcctaaatttacaggctcccttgcagcttagtgaggccatgtgacaaaattctggccaaagagatgtaagaggaaatattgcatgggcctctggggaaggagagtacttctcccttttctgctggctggaaatcagagatgatatctagttctttagcagctatcttggatcatgagttgatcttgagaatgtgagccatgtgcttagaaaatggataacagaacaagaaggaaattgggtccatgatgaccttgcagaattgccatgccagccccaaactgcctactttcagacttcttttaacataataaacacgtatgtctgtatttaattcactatttggaaaggaatcagtattattatagctgaatataattatgaagcaatgaatagtctctcactttgctgggtcatctttcttccacctaattattttatttatttatttatttatttatttatttatttatttttagagacagggtctcattccatcacccaggctagagtgcagtggcatgatcacagctcactacagccttgaactcttggggtcaagcgatcctcccacctcagcctcctgagtagctaggactacaggcgtgcaccaccacacccggcttttttttttttttctgtagacatgtggtctctctgtgttgtccaggttggtttcaaactcctggcctcaagtcaaccctccgctttggccttccaaagtgctgggattacaggtatgagccacagtacttggccttttttatctttttaaactcctattgtgaactaaattctcctatatactcaaaatgtttctatcacacctccaccttaaccaatacataccattctccctgataatacaaatttcctcccaaggcacagtagtgagcctcctttttgcctgtctattcagcttagcatggctcacagttactggacagtttgcatttctctcttctctctggagactgactaggatgcacagtccttctagaagatgatgctcctgacccatcattactaaagaattttgagaaagtattttctgccacttttctacactttctctctgctcaaaagcaggtagtatgatgaggtaagaccaagagcgaaagctgaggccacaaaagagagtaaaactaaatggcttacctggtgataggacccactgctttggcctctaattggccctgtgccttcagccatagaaataagcagccttagacattagctagaatattggtattttcaatctctagtttgaatgacaggaccctgaaggcaaaacatttcctgtggagattctgcatttctgcctgctcttgcttttatagctcaaacaactcaattttgttgggcttcaaagtacagttcaagggatattttataaggaaaattaatgggcctggggatatcaccagtgtaactcattgattagagggaaaatatggagtacgtgtaaatattctgtgatggatttgaaaaagacacaattataattatatttgtgattatttctagtggtactcccacaaatgtccatgaaataacataatgctcaatgacttgacattgaaacaatatgtaggaagcatgtgttccaatgggatattgattatggctcaactaaagataacagaatctactgtagctattttaagaagaaaaacatttaagacatataattaaatggcttagagaatcactggggagggctgaatacatctaagttgagccttcagaaatagttcccaagcaacaccacagaaatgggctgctggaggaactgctgcctcttctgggatcaggaagctacctgccaccttgggtcactgccagttccataaccacagtgctttgccacagttagaaagcaaacaccagcaaggaagccagcggatcactaaccactttgatcctgggaccacccaatcaggaagctgctgaccccactgctactgctctcagctcccaaatcatacactcctcactgtgttcctcaccagcacaggtgataccttacatcctgcctcttaacacccacactgctagcaaatgggccctggacttgtgccagtgctgaaagcaaagcaacaagatatccccataaccctctgcatggtagatgaaatagcagaagttagtctctgctttccttccacctactaaatctcataaatcagtacctctgaactcatgtcaactaaaggatgcttcacaagggttctggtgagcagaattcccccaacagactagcactttcatggattcagtaccttatctccagggaagactaagagatggttccagctttcacagggccaggggtacactagtaagaaattggaatggatgttgagagataatccataacatatatcacagaatagtttacttttaatgtgtcatattaatatattaataagtatgtgccaaatactttatatgcatacaacactatatattgaccaggcggccaataacatttgctgagaaattcactgggccagggtcttcaatttccatctcctagagcacatagtgtctaatccactatgttttttataccaccattcacgggatcatatttaagcagctactgcatgaatgcttacttataagaatgaacatcatggtaactattctggaaagctttataaaaagatatatactctcccaagaatcttaataactgataagataatacagtagaaatatgaacatctatgaactaagtgacagaaatatgaaaaatgttccaaatcaaaccttgaaacttagttataattaccttagaggtgaataatttagaaagaaaatgggggaaaggaggtatatttgaatcatcactctcatttgactatttaagaaacattatttaagttatactgactacttttattccaaagtagcagatacagaaatagtgcaaagtaaacagaagttcatacagggaacaaagtgtgtaacagaaaatggcaaggcacactatcaaatactgtgaactgattttcagaccaatgctgagatgtgttaaagttaagtttggcacacagcagattctttacttggtagtaaagtttggctcaaagcagtctccatacatagcaagctgtaatctaggagtatacccttgttaccaagcaactgtttctccgccaatcatagcagccaaatcctcagtcaattcccaggctgaaagctgccaaattatgcccacataaggcaaacattgaattgcaccaacaaggtaatctctatatgttatttcctgttttctggttataaatctaagtcaccacaattggaggttggggcattctgaaccatttttagtctgggatgttgcccagtactaggacgtttttctggctcaaataaatttttttcaatgtaattggtctctgggttagttttcattttttaatgtcattgaaaaaatagtccaagacatttatttcattctgttggacactgaaattaatacgcttgataataaatcactagagaaaacaacaatttgactactaattaggctacccatttggcagaatccactctccaatataaccaatttgcaataaatcatgtgagaaggcagtgctggtggtaagggctatatactatgattgccattcccacagcaaacttaatacagatgagaattatggaaatgccatgtaacataggaggaataactaataagtttcctggaagctgtttctttgttactgtttatatttgtttttatttttaccgtaacagaaacacacaagatcaagaaattatgtgccactactgcactgtaaaaatcctgtaaaaagtaaaaacaagtcaaggtgtaatagtcaggagaccaaacctaaggaaggtcactgtgacctttggtcacctgactattatactttccctgcactttgcaaatgtatcttgttgcacattagactagtactctagtattcataggtaaatattcacattgtcagcaagaatatctggctgcacaactggacaagttggatgatgataatctactttccctacagtctcctggcagagggccatgtacacctggatatcaaaccattagtaccttcactccttggaattcagattgacctctaagttccttgaaccagtccaggaatagagaatctttccagacatgaaaaaccttttaatctactacagctgacccttgaacaaggtgggggttgggggcattaacccacgtgtagtcaaaaatttgagtataacttttgactcccaaaaaacttaactactaataggctactgttgagcaatactataaacagccaattaacacgtattttgtatattatatatatattatatactgtattcttacaataaagtaagctagaggaaagaaaatgttattaagaaaatcataaggaaaagaaaatatatttactatatattaagtggaaccatatcattcaaaaggtcttcatcctcatcatctttgcattgagtaggctcaggaggaagaagaagagaaggggttggtcttactgtctcaggggtagcagagccagaagaaaatccaagtataagcagacccacacattccagacttgtgctgttcaaagatcaactgtacttcactttatccctacatctagtctggttctcaattcagaggaatttgaaaataagttctctctcacatttagtaagaaatgcctcaggaggggtcctgggaatgctcccaagagagtgaaaaaaactgcagggggtccataattaactggtcaggaacccccagagccgcgtgtcagtctcacagatctagagctgcccttttatcaatccccaggaacttcagcattacattcccattaatattaacagtgttctcactgacaaaacagagtgattattatgttctcactggctctgcttattgaacagccccaataattaccttgaacattttattatcaagatgaaaatgtagcattttacctaaccaagttgtcaatgcttttctccgaataccatttgccttactcctcacgcatttaaatagactgccttgggctgcagttgttatttttatataatttatgaatctggagaaatccagatagtaatattactatcagcatattcacatctgaatgataatttttatgaatactgtgtttttctctggctacaccaatatctacctatgattaaaaatgtctgaattgaagccatttgacatggcttcaaccttcttctaatttatttcttttgagaaatttactagttttccttcttttccccccactttaaaaagttattttctcatcatttactattggaaaaatagtactgaatattcaagtgaaccaaaatgagtgagtaaataaatgatgttgatattgatgccacacactaaatttgcttcatttagctttcatcacacttgtttgattaacggtatatatcaccaggggccccatggcttggaagcaccagaagcaaggaaactggcatgttagtgcatcatgtctggctgtgctggcagggcctctgtagctctattactgctattcatctggcatgcagctatggaactggacactcacgtccatcaacacagctactagctccaatgtcataaattcactggtgatgtttttacaggttagggaaaaaatgagcttgataaagaaaaatactgcaactagaaacagaggtggaggaaagaaaagcatttcaatcccagtggaaagcagacagaaagggcaaggagagggtaccaggagacagatgtgttgcagcaataccaaaaaaaaaaaagcagggaataattgaaatcagaggcccgagagctgtcccacaggttaggtgaggccccaaaaatctaactttatcatgttgctgctccacagaaccaagctcttctcataagcctctgctactaaataattttttgagcttcattgtatttatgaatgcagaaccaagctgtgcagtgaattcacttttaaactctctggcttattttctgagttgtctttgtaaaaaaaaaatcactcttactcttttaacatctgttatgaataaaccatgccatgccttctttcaattcatttatctgtatattcaactttctattagctacaatttcaactcattaaaaaattatcttatcctgggactagagcctgatttttattttttatgccagaccaactgcatttcaaagactaaacttttatgtctttctacttggaatttttactagatttctatcttttggcttctgctacctctcagtaaagttgagaacaaaaacatttgaaagactgaagcaatgagaattaaaagctttgggttatattattctcctcataagtgaagtaggatccatagtgcatatagaaatatttttaacatctgcttggtaataacatcagtagtaatggtaacaacacaagtaataataatatgtttttattcaactagcgtttctcatacatcctcaaatactgaacttaggtggccagttatacatatttcacatctccacttaccacatatatgcagttgtcctgaccctgcctttattaacaaaagccatacaatacatagtaagtacacagtatctcatttaatcttcactacaaccctatgagataacatttttattactttctctattttatagatcaaaaccctgtggcactgagggtttagtaactatcaaggtaataagtgatagaaaaggaaggggaacccaggcagtctggcaacagagcctgcagatttgaccactctgctatactgtggtgttcccttgaccgcttcctagtgactgatgtggttgagaatgtgaggactcaggtgcagtaagggagtagcccttctgcctgcagagaagacggattatatagagatagatgctcatacactgctgattcccagggaatgagatagaagcaaaacatgggttcctggctggtttttcttcatccttttgccttttacttcttcagcagtctttttgatcactgcatttggcttttggttctcttaaccatcttgggtagctggcagaggcattgataaataatcttgttttggctgactgtatcagacatgttatggtatggtatgtgaagccaataaaatatctcattctgatagatattccctgggtggtaccaagcactgcctttggcttcacactcataaggcactttacaggacagccagccatctttcccaacccatgtcacccattgtgacataggcctgtcatcccagggcctgagtcttccagaccagcgacataatttaccaaagcaaaatgccaaagccccttagcagcaaaatataatagttaattttgcgcattatttaataaggtttcattcaagttcagtgttgagatattacaagaaaaaactacctatgtttttccctgaatttaaataacagacataaatgaaatcaaatcactagcaaacaagatatgtgtgctggtattatatgtgatatttaggaaatcttttcactgtagaaggacaaacagaagcaagtttttattctttttctatcaggagtcctaggtctgtcttcattcactaattaattcatttaattaatcaaaagacatcaattgggcacttattatgtgtgggtgacaagggtgaagatataacctctgtcttcaggtggcttccattctaagtgcttaagtaagaatatatgtggtcttccatagcctaaacagaatattgttatattgttataggcagggcactgtggctcacgcctgtagtcccagcactttgagaggccaaggagggctgattgctagagttcaggagttcgagaccagcctgggcaacatgacaaaaccccatctccaccaaaaacacaaaaaattggccgggcatggtggcacaagcctgtgatcccagctactcaggaagctgaggtgggaggatcacttgagccccggaggtagaggctacagtgagctgggatcgcaccactgcactccagcctaggtgtcagagtgagaccccatctcaataaaataaataaataaacaaacatagaagaaaatattgttataagaacaaggcaccttggaaaaataatgagtttcaaaggtgggtcttataaagaagtagtagccgattttcccctataaatatttgaatagaacaaataaaaggatggaacttcctatttatgtcttattcttagaaagggcaacaaaaaggaaaattgcttgttccctaaagacttcttaaaatatttgctcaaaacctcttcacaaggacaacactttcagtaaaacacatcttataaaatgtcttctgacctttatagacagtcagtttgcctttcccaaagctgttgttgcacactatctgtgcattatctgtgcactaatattatggaatcatttggtaaattggtgtctgatccacctgttctctttcttatccatctacccccacaaaacacacgccttctcccatgtttctagtgccatattttcttacccaacatgacatgctccttcctcacattcatcctctcatgcttttgtaaataccttttgttaaggtatttcataattatgctgcaagttgcagcactgtgccagtgctaagcactttgaaaacacaatctcgaacaccgccaataccctacaaagtgggtaagccccaacaagaaccttgttgttgaaatgtccccatagagctaaagtggatgtgatttgttgctagggcacaaggtctcctctatctgtgacctgggagcaggggtgagatcagacaggtgggattgctcacacaaaaatcaggcaaagcagacttggctttttgaagtcatgtaccaaaaacatactcatattacattctttctcagacaaagctgtaaaacactgaccagaagccctaaattccaagatctttgcagaaggaagcattaccccattaacatgatgacagcattaatctgagaaaatcatcaagagtaaattttcacattcaactaaaatgcaattgcttttgaaaaaagctaaagaagaatgtgtaacacaaaaataacttacaatcctcattcagaatatctgccttttcacacagcaatggcagaaaaccagcttaccaccacacacatctgctatttactgaagggaaaacgtggggaactgtggtcagcgaagaaaatcccttctgtggctggagaccgaagaggccaacttcaaagcaccagagagtagaatataggagttaaggatttacacctaattaagcttaaatttaagtaccttcatccatacctaatgctatatgtgggtcttcttttgtcattttatagggacagtgctgaatcatcaagtcttctcccagaaactatcacatgcatggttggcatctgtgctcttgttatcatcagaaataaatcctatgtaagtgtcccaactcaggagaccactgttagagaatgaatggtgagcttcacaacgcagtcttcactccacgactaatcatcaagtgagcagtgtttacttgaattattagttgaataaaaattattttaggaaatgaactatcaaatcctagtcaacttgcaacatcattatgaacatcactatcgccagtgctaagcactttgaaaacacaatctcaaacgccaccaacaccctacaaagtgagtaagcctcaataagaaccttctctgcatgcattgagatgtattcatttctgagctcagctaagtgagtgaagacttaacaataattcagcaaagccatacaatgtagtatctagcatagtgatcaagcacatagtagatgatcaagcacatgagacccaccttccctatgtctgatctgttcccatggactggttcccaataaatgttggatacattcaaggattgaatttagtttgtaatattatttaatttgtagaatttaataattgattagtaaatcaataattagttacttgatgtagctgtgaaaattaatcaatcattgatgcaaaatatattaaagaatgaaatcatgattcaataaatcaatggtaactacatgaggaaaataagacattctttgataatcagcttaccttctccactctaataaatcagtctgtgccaaaaatcaagcagacaaatactaagtaaatatcattagttctgttcacaattagactttctgccctcccttgtggatggttttggtggggccaggcacactgagttctgttcaatgagttttgagttgaagtgtcacattccatttctacatgagcttatttaaccacctggggtaacatcctttagagtttcctttcttcccaagcatggtaattaacaacgtttgagatggtggatgctccatcaacccatgcctgagtgacaagaatgaacagagcactcagctgacccacaatggacagacagcatgagcaagaaataaattgttgttgtttaatccacatcacagtcgcacatcttagtccacagtaattgataaagcaaataaaacgccaagatcctaaaacttgtaaaaaaataatagtgagccaggaccatgtcacagcccagactcacagttactgattttgctcacctaaattacaggctatgtccttgtctccccctaaatacctttactcttatctatttattaattccacaagaatttaaaactctgctttctgctgaagcttgtaatcagtgctgggaatagtgaggagagaaggcaatttatgtcctacagaaatgcaatacacattcttgttgaggagattatactgagagctctgctcaagagatgtgaaataaaccaaaaagtgtcatgagacccaccttccctatgtctgatctgttcccatggactggtgttgatgaaattcttttggccacagaaacccatttgctttcttttgtttcatgtcttaaaaagatgagtagaaggtcagatgagtcatcttttgggaacctgagaatttcaagctttatttacaaggatttcatatttttccatcaagatgaagcatttaacagaatttcacatttttctgccacatggtaacaataaggatgatgattgatgaggattaaatctcaatggattatttactgcattagttaaaatttcatcagcttcatgggacatctcctgtccaacatgtcttagggtacagataagaaatattattttatttctggctaggcacagtggctcacgcctgtaatcccagcactttgggagactgaggtgggtggatcacctaaggtcaggagtttgagaccagcctgggccaacatggcaaaactccatctctactaaaaatacaaaaattagccaggtatggcggcaggcatttgtagtcccagctactcaggaggctgaggcagaagaatcgcttgaacctgggaagtgaaagttgcagtgagctgagatcatgccactgcactccagccccctgggtgaagaacaagactccatctcaagaaaaaaaaaaaaaaagaaatattattttatttctgtttgatgtttaaaagattaattctgtttaccttggttcccaatgagccacttataaacaattatatgagtaaccacagagtttcagggtttaaaaactgtctctagctgtgcttatcaccggttgcttatcaccttgaatgcatgttttcccttctttctattggaaaagcatttatcagccatgcagataggctcaaagcaaactagaagttcactacatttatttaatggtctgcaaaaatgtcatcagccttcccattcttatcagaattatagaggtaaagctttgagtgtgtatgatttatataactatatctaccattagattatcatacagtctgactttcaagtagtatatatttgcttctttttctgttttaaggccgtacttggaatttgctgctcaaatcatgtagctaattccaacagtaccatcttttactatttcctcactaccctcgaaccctattctttccatcccttccatataataaaattacataccaatcaagagtcaaacagattacaagtaaagccactgaatgtgggcaaattgtaattcgtccatctaacaaatacttttgagcactcacttcatgccagatactgtccttgattctgaaaatatagcaataaagtacaacagagaaggtactgctttcacaaggcttacattttaatgagaggcaaataataagtaagataagttcaaataagggctatgaagaaaataaaacagagtgatgggatactgtgataggagaagtggcatcaccagaggagacctctctaagaaggtcatatttgacttgagacccaaatgaaaagaagccaatgatctggagaaagagccatatagaaacagggactagcaggttcaacaaagagcttgaagtgagaaagagcttagtctatttgaagaagagaaagaaggccagtgtcactggagatgatgttggagagaaaggcagaggccagcccgtgtaattcaagagcttcagtagttcaagatcttgtagctcaagatctttaccttatgtggaataaaatccaagatctttaccttgaactacatgggctggcccaagtaggtggaagttactggtgagtgttaagtagaaaagtgatattaagttgtaactatgcaaatatcactccagaagcctgataaaattggtcaaacttctcaatattcataatagaaagctagttctaccagctctaccaggaattcacccaggccttcctgagtttgaaacagagaatacctgagttccaggttctcctcaggctgctcacacttgtcttttcagaaagaccagccaaactgagggatcctgttgagctattttctgaattcttactctgccagtgtaatgtattacccaagccaggatctatcagaagatcattgtcaactactttagagggtagacagtaaggaaaaattgaagataggggaaattacatgctttatcactggtctagcaattatgtggatctttacagaatttctttaggaaagcattagaaaaataatcaactctattgtaaaatattaagttatttgtattaaataacttatttaattgtaaattaatacattgtaaaatattaaatactatcataaaatattgaattctgatcttaatagtctttgataaaaacttaaaggttttcttacacagaatcagtaaaatgtcatttttttctcaagcaaaaaaataaactttatgaaccatgcttgcaccagttctgtgaaatgccagcccaatttaaatttacctagatttgttttcaacttggcagagtgccattggtgcttagtcgttaaaacaggtggcatttctatcaagaagtttcctatttcttcttagaaatgtagattaatgtgcctaaaagattaaatatctgtttttaaaaccaaaatatacagattacctctatcccaagaagcagaaatgtaagtgtccttcccattcttctctttcttttcactgccaatcctaaacctccttggaagtccatgaagaaccacattttaaaaaccttgatagactcgcttcagaaaataaattttttttaaataacccacaacaatgtttatttgtataatccaagtgacataactagcctatcctccaaatgatagagggataagtagatgacatctctcctttaaaactcattaaaagtagagaagcttcccactcaactttaaaataatacaggaacatatttctaagggcaaacttatataccagagcagaggtcacaaactgacacataaatacctaacgtgcccaacatattttctccatcttggcatgcaacaacatgaggagaagtcttgcaatgttagcacaaacatttgaattaattgtcaatattaaataatctgatttcacatcttgatttccagctccttttgaaatgtcagaagatatggacccccctaaagctgcatgtttgcctttctgcaagacaagaatcccaagattgacagtggccactccctataaatagggaaatactctatttgtcaagtccctaccactccttacggttttttaaatctctctctgcatcattcatttacaacacctgcccaacctgtgcaagcaagccttttttggtactaaagaaatagcacagataaatagatggatggatgaatcaatagatagataaatatatcacacctaaattatcaagtttccctgaacagcaaaggcttagagcaggcactcttgtaccaagggcgctgagattacaacatttcttgaactttgtattcctcagattaaccaaatcaaacaacagacttacatagttcaggccatctaagaatctggccatttcggccaggcgtggtggctcacccccgtaatctcagcattttgggaggctgaggcgggtgggttacctgagttcaggagttagagaccagcctggccaacatggtgaaaccccatctctactaaaaatacaaaaattattcgtgcatgatggcacatgcctataatcccagctactcgggaggctgaggcaggagaattgctttaacccaggaggcagaggttgcagtgagccaagatcatgcccctatgctccagcctgggtgacagagtaagactctgtctcaaaaaaaaaaaaaaaaaaatctggccatttccagaactctaaatcccaaatcccactatttctgcttgttcttcaacaaaacaagaaccaggacttgaggagctgagcaggaaaggaatcacagcatcttccatggacttccatcctgttcctgcctactgcctttccccttgtttgtgcagatagcatgctttttttccccatttctcagggtttttatatctaagctaagctctttatgtttatttgtaggacaccaagcaatttgaggcctatttaccctcaagtataactgccccaaagatcaagagaagaagaaagtcagatcatacaccaagtgtcttcaaaggctaaaacaccactattgtttcaagcataaggcacttggggtgaagttctccctaagtaaaacacatataatgttcccactgaattgaaatatatgtaggaccatcatcaaaagcatttaccagataacaatgtgcatgaagcactgtaccaggcacatctcagggtagccatgatgtcaatgaaccttagtggcaatcaaggccacttactagccctttgtgtgaaagagaaaaagatatccctccctctgggctggcacagactcacatcacactgcatggcttggccaagccaagtgtggctgccgttctgcacttactcaccccctgcagcccagccaacttgtgcagtgaagaatctgcaaaaatagttgcagccgtacagccctgggagaatttaaacttcatgcaaatgaaataaacatgcacatgaaattcaaccaggagatttacctggcaagtcaagagattaaaagggcatgaatatctgaatttttttatcagttacttgttttttaatctcttaaatgaaacagattctagaacttttgaaaaagggaaataagtgagtgtcacaccagaccaagagaggagaaaattaaatccaagctccaaccactcatcctaatctttgagatcactctgtcctggtgaacatgccttccgggtgggtggatacacagtctctttggagaaccaatttttttttgttgttgttgggagataaaaagcaatttacaagaagaattttttgtcaataaaatttctacaacggccaggcatggtggctcatgcctgtaatctcagcactttgggagggcgaggtgggcagatcacctggagtcaggagttcgagaccagcctgaccaacatgtagaaaccccatctctactaaaaatacaaaattagccaggcatggtggtgcatgcctgtaatcccagctactcaggagactgaggcaggagaatcacttgaacccaggaggaggtggaggttgcagtgagctgagatcacgccattgcactccagcgtggacaacaagagcgaaactccatatcaaaaaaaaaaaaaaattatacaccaaatggaaactttgaaaaaacattttcttttcttttttttcatcctaatagcccaaactaggtcatctttcctactccttaatagaatatgagtttccacaagctgcccagtcatactaatctgaaatttctcctgtcctatctcacagttcaatttcatgtttctccctcctgctgggacctggctactctgggccttccagtgggagtcctgatgccctggctcagtatgcttgtcattatagtcttctgtactatttgaatctgaagaataagcactgaatactaaattaattttttctgagcccatcagaaggacacagctcaagtgctcctatgactcttttggaggaatcaccagggctaagtccccagactctaacatgatcccctgcttccccttggactgaaatagctgcctgtcctgtccagccctgacctgtcctgttctgccctgccctctccagagaaagcacattctgtacgtcattactgagcgttctttttcagatcttatagacagtgaatatgaaagaagcattatggagaaggagatttattgtgattcattgaaatgtttttgatgctctacaattccctggttttgtccaagctgcaaatatttcaaagaacagatctccattatgctcataaacttacccattttataaaataacaacgataagttttctttatttaaaataggaaaagtcgtaccctcctcctgcagacagaaggcttgtgttctgcagtttacaggtaacaacgatgtggcttcacattcctcagcaacaatgttagaaaggcattgcagttgtctaggaatgccattgcaacccctagggcactgtgcatgaaatggctgaatagtaacattctggcagtcacgatattaagtttcactgggaatatcgtgacctgtgttctggggcagggaggttggcaggatgtgggggttagggggacccttttctccctctggccacattttgctttaatgcatgaaacaggaattaccatcaacacctgttggtattgagaaagcagtgctttcctttgctctagcattcattcattttccgtgagggccagaagagggaattatttgatccttgagaaaattctgatacggtttggctctatgtccccacccaaatctcatgttgaattgtaatccccagtgttagaggaggggcctggtggaatgtgattgcatcatgggggcgggatgtcccccttgcagttctcgtgatagacttctcagaagacttggttgttgaaagtgtgtaccagctcccccttctctctctcttcttcctgctccatccaagtgaagatgtgcctgcttccccttgccttccactatgattgtaagtttcctgaggcctccccagaagcagaagcctggacagcccgcagaaccatgagccaattaaacctcttttcttaataaaataccctgtctcaggtatgtctttatagcagtgtgagaatggactaatatttcaaatatttcattacacacccataacccagccatggtgctggcagcctctctcagtttcttgctgtcccactccttctctcctctgtgttctgcttgtttgaaccccactctccctcaccctgtctgtcttcctctctcctctcctgctttctatgcctttttttttctcttcttacctgtcttcctccccttttccactctccctccactctggccaccagcctgacagcacagatgtttttctgtcctccttgtttgaagccaccagggcaggtgctgctgctttgtttgtgactgaagaggtgagttcagcacagaggggaatggtgggcagcccagggaaaccgccaccagaacaaggggtaccattagcagagaggacattttgatcctcttctgacttccacgtctttatttccccatgggttcagaacccacagaaagatgaggcaggcattaagcctcttcaatacccaataactcccacagctaggaacagagtgcacaggacagaacagtgagtcaactgaccagagcaccaaggcagagagaggcgggatgcagacaggggttgagtgggagtgaaacctcatgagccaggcccagggacaagccacgaggagcatgcgcaccatggtccatgtcatagggacttccttaccttgcctttagaaaaaccaacaaaaaccttgtgtttaatgagattgaggcttgtctgcttctattcataagaccccaacatatgaaagccacaccccagaacaaggcagagtaggacgaagaccatataagactaagtgtggggtctgcaggaacaaagctcacatgagaagtcaacatgcacacacaaaaaaaaatcagaccagacgtgaatcgaggtcattctgtgagtgatattcattcatgagtttttaaccagactcttagtaagaaagaactggtaaatcatatccaaaacctttcatgtagtatccacagatgtcatttgtaattaggccttatcatgagcattcctagcattagtttcattttttttcaattagtgcctctgtaaagtcctaaattagagaacccctgcaggatttatcacagagagaaaacctagctgagtgaacacctgtgaatttactcagtccagagtggctaggccagaaagcagctcccctaacaggacagagccttcacaaggccagctcctgccccagaggcctctgggtagagtacccatacatcccagtttgcccaagtagtgctggttcacagccattgccctggtgttcatagcaccccctttcgttcttaaaaggccccaacttgcatgttcaatcagaaggtctctttggtatgcgctatataatggactatttataattcattagaggtgttgtaacaacatatcatcgactacattcaacagaatctctggaactaaggaaaaattagaaatgaaacttacttaaaaattatcttcatgaaatttgtgggaagataagcaatatataaggaaaggcaagaatacaaatcaacctagaagagaaggaagtaataagaagaaagaaaatgcaaacctgaccttaattttccatcattctcattaacgatgactgctaaaagctggtcagccacgctatttgaaagcaattttggaaattaatcctttaagaacattttttaacctttgattcatgagacaaatggcctttctattttaaccaagatacccagatagtgattagtcattactaaaacaaggatcccaaatctagttttgtgtatatgtgtgtgtgtgtgtgtgcgtgcgtgcatgcccacttgtgtgtaagagagagggagggagagagaaaatgagagagagagagggaaggagagagaaactgagagagagaaggcgattttagtaaatacacaaaatgagtgaattgtccctttccctttaaagccacccagggaacttagctgttcacattatcatcaacctgctgcatttctctccctaggagaccacaaaccaggagaaaccatatgtgagctcacaactctagcaaaagctttgttttcattgcatatgatttgattaaaatgatattgcagccttaaatttttttgtacagagttctagtgctgaactaacaggcaaaaattaaacaaggtcaagaagtgagctatcaggatctactctgtatccaccttaaacaaccaactccttcccaggttgcactacgcgaatggcctttgctgacgtcttctgaaacaggattagatatagccatgcagctgatgtaatattgtatcatcattcccatgacaggtacatggtggactttgtcacagcaagatgctgctccccgttcagtccgccatgtggtgattctctttctcctgtcaccatcgttgtgtccctaatttcccccagctccctttacccaatataatcggagatgcattaaacaactcagcctttttttcctagctgcacttgtcaacaatttcaacactgccctgtcacaatcctagactccaacctgggccttatatttttttatcttaattctctattgaaatataatatatgcacagaaagtacacaaatcataaaggcagtggattttcacaaagtgaacacagtcaggtaataaaatttaaaaaattagaacattgcaggaccctagaagcccacttatgttctatctcaggcaccttctcccctgaaatataaccaccattctgacttctaacaccagagctctgattctaagctttatgtaaatgaaatcatggcatgcactcttttgtatctggatgctttgatcaacattttattttttagattcatccatattgtatgtattgaagctcattcttctttattgctactgcgtgtttcattttgtcagtacaccaaacattagtgagttgtttgcatttttcaccattataaataatgctactatatgcatatgtctttcagtacagaaatgtacacatttccactggactataaaaacggaattgctaggctataggatattacataggttcagccttcgtagatactgaaaatggttttcatagatactgaatctacccatttacactctcaccagcagtctaggagcataccagctgccccaccgtctcacaacacacagcattgtcagtcttttttattttagccatcctgatggatgtcagatggtattgatgtggtactgtagatttcatttgcatttcctgctggctaatgaagttgagccaccctgctttcttaaggtttcaacttttaccaagccaatggccagtcctggcactcagctcctctctggttaccacctgcaaggaatgctgaggaaagaagcaagggtctgtacattctttccactcaaagccttcctgtctgttggcctttctcaatggtccaccaattgattccaaatcatgtctccatctcctgtacaggtcaccctggtggcagcctcttttctcctgcaatatccagtctgacacctgcttcccccttataaactattcttaagcttaccagatagccttacctcccacttgcaccaagacagacaagctcctgtagtgtgaaacctgcatgttcccttgcagcccttatttcattcttttcttcaggctcagaggaagcattgttcctcttctctaaaacctgtaatcactgagaaaatgtgttcttttgagtttcctttgacacgtactctctgtgtgaccaagtacaagttacttgacctctcccggactcaggtttcttccctggaaaattagaatatttcttacctcttaaaattgttgtgagacttaaaggataatgtgcttaaaatccctggttcaatgcctggtagatattttgtgcttagtaaatattaaactctttccttccatttctccttttatctctccattattaatctcctcctttgccttagaggcagtgagatggaaaaaaacttggcgttcacaatcagacacaccgcaatttgaaaccttatgtttaccattgactagctcaattattaactcccctacgtcagtttcttcaactctaaagtggaactgtgggtgttacactcagaaccgtgaaaatacaagtcactccggctgactgcaattctagattagctgtctcagactggtggcccacgggccatacccgtcctgtgttgaggttcatttggttggttgttggtttttacttaaattgtctagagttaaatattaggataatttacattacatttcaaaatgcgggcatcttttgaaaaaactagatctagcaaaagtggtcacatttcctcacggcaacaatcaccatgaggagctggccatgtactctctggtcagccacactcccctgcccctctattctcttccaaccaggctagtctccttcatttactctacgtgtatagaccttgatgggttttctattatgtttagttgctacctctttctctagagtcttattgaactcaatgatgacttgcctgagagttgcaaaccacttctaaaatgtttaatatcacttattttacaaatatagactacctgatctccagattcttacagcttacaactgtcaggctcttcagaaagctcctatattggtttcctgttgctattgtaactacctaatggaaaacctagtgagaaaagaatagaaatttatgatcttacagttatggatatcagaggccaagaagggatctttttggcctaatcaacagggctgcattagtttctgggaggctccagaggagaatctattttcctgctttttctggcttccaagggccgtccttattccttggctcatggccccttcctctgtcttcaaagccagcaatgactgggtgatgcttgactttctcatgctgcgtcactctgacacttactctattgcctcattcttccatcttgaggacccttgtgattacactgggcccacccagataatccagggtaatctccccatctcatattcagttgattgatgaacttattccccccttgtcaaaatatattcatgggttccagagacatttttgagtggctgttattgtgactaccacagccctcaacactgtcaccaagccttcctttccttgaaagatacaggtgagccaggattgctgatttatccaatagtgctgctacacattttccttcagttcaaaaacaatcccccaaaatgacaactgagtgttggcatcataatgttgtatgggaaagcagttttctcctacatgcctataaattccaatggacactttttgccatctctctccccccaaaaaaacaccatcaacattttgaattgttagaaagaagggaggagaaaaaggagagcaaaaaagaatggcactagctacagtttcaggtgcaaatcctcttggggattctttaaaaagaagaaatactgaggagcatatcaaagaaacgtttatattgcctagggtactctaagccctcagcaaagctccgaagaataattcggtctgagagtaatcctgaactactgaagtcgcccatgaatattccaccatgttctgttctctattcaacagtgctttcataaattgctccagggaaggtcatctcacttatccacaacaccatcagaattaaacaggaaacagcaaacagaatagagcaagcacaggtcacgtaagatactatcatatctcttctccaaatagatcatcagggcattgttcccagttcaaaagggaaaaaagatgataaattaaatccaatcctgaaatatctgtaatgagctaggatccagacttcatttgctacttcataattttaagtaagaaatctttcatgttatataatatgcttaaaaatcggtgaaatatgcacatatacatatatatgtatacgtatattttttttctttataacctttagggaattttacagtgcaacaaataaatgctaaatatattattgcatgttttaatttctatcccagttcatttcttaagtcatagacaaagttagctaggtaatctggttctagctctgaaggtgggcaacatggccaaccttgccctccttcttgaaacctttccaatctttctggaatcagcttctttaatcagagtcttgttctttctacttctaaactttctcaaatattcctcattgtctacatttcctagaattcatttttataacacatcacagctttaaatcattatcagggtaaatttttgtttaccctatgaggacagggacatatctgtctctttctccccagctacagccctgtgcttctgcatagctggctctcaaacattgttgaatgaatgaatgctccctacccctatttgtctttttggcatgccttatttgtaccaggcactattttaagtgttttgcatatattaatataattcttataaccaattttattatgtagggatcattattttacagataagaaaatgggcatagaaaggttcagtaattttcacatacaacagttagtaacagatatcatttattgagtacttaatttgtgccaggcagggctgccattagctacccaaagtgactatgtgtaaatttgaaaaagatgccccttttacatggataaattacaaaaggagtctcttccctaggcacagggcttatcagtgaaagccagttcctacctgtactggcccctcaaccatgagcatttttggagggcacaggctacacaaaatacagtgtatctaatatcatttcttttataatatactaccagctgggcatggtggctcatgcctgtaatcccagcactttgggaggctaaggtgggcagatcatgaggtcaagagattgagaccatcctggccaacatggtgaaacctcatctctactaaaaatacaacaattagctgggtgtggtggtacgcgcctgtagtcccagctacttgggaggctgaggcaggagaatcacttgaacctgggaggcggaggttgcagtgagctgagatcgcgccactgcactccagcctggtgacaaagcaagactccatctaaacatacgtatatatatctcctgattcccagatttttacagcttacaactgtcaggcctcgtcagaaagtcctgtattagtttcttattgctgcttaacaaattgtcaccaatttagtaacttgaagcaatacaaatttattatcttatagttatgaatatcagagtcccagaatgggccacaaactgctctgagcactaaatggtgataaacccacagcaaccctatgagataagcatcattgttatcatcatccttatttaacagaagcaaaaaacaaaggccagagaagaaaagtaatggctcagagcttcccagctattgagtgacacaggtaagactaagcccaaacattgtggccccagagctcacactcccagcattactctatagtgaactgtttagccggggttcctgtaacagcctcctactccctagtctccaggcctcctaacgcatcccacacttcaatctactacagaagccacagcgaatttccaaagatatcaatctgctcatatgtccttcatgtttaaaacactcagtagctcttccattcccctccaggtaaagtcaagacacttgcctgtggttgaataggctctggtgatgtgatcctggtcactcttcatcggcatctctggtccttccctctgcctctacccctcactgcacacaatgacataaccatagcaaacattctgctcaatacattctcccattcccacttgtcccaggccttagcaagtgatgttctttccacctggaaactttctcttccgcctctttgttgactatctccaaatgataagtctcagcctaaatgtctcaacctctgatccatggtccttcaacactcagtctaaattggaacccttgatagagcctttcatcacaacttgtgttttcctttatagcaacatcgtacgtatgcatgtatgtaattattcagtcaacactgactttcaccaatagtaagtttcacgatggcaaggacagtgtctattttgttagttaactgtaaactcagcttttagcacacttcctggtaaacacaggcaaccaaatattgtccatgtgcctcctgtgagctcactgtgcttctcgcctatagcattcctcacaatacagtttattgtcactgcctatttctgtattccccattagatttcactattttacacactatgaggacaaagactatatctgacttggacctcactactgaacccccagtatctagcacagagtcagcatatcgtggacactcaaacattccagaataaatgaataaacaagcataaacaactggcccatttggggtaacaatcctctttattactactgccataaatcagatcaagggattgaaggattgttctactttaaccactttaaaggaatagaatctatttagaacattgagagaaagctatcagcttcaaattctgaccaaatattgtttattagccaaaacagacaacagggccaactcaggcctcgataagaaacaatccatgagtttagtcaaagatctcatgagtgaccactcagacagaaaatttggcatctacctgccaactcctacagaaaccaagagccaagaactgcaaagaatgatcccagaggtaactgactgactgactgtacctaccagtagtcattatattactccccgttaaaggcttaaagggaggtcttgaagacaaaaatttataattaaatgacgtttcatcatgctgaaaggagaaaaagatatattcaaatggaaaaaaaagcaaaggcaaagtaaaatatattaacaggatctgatgagactacagatgaaaaacaattcctgaaaaagatgatccatcttctcaatgggaaatacataggtcttttctacacatagtatttaaatgaagacaacattaatgtctctttctgacctggctccagaaagtctgctcactcttggaagtgatgactacatcctttgagtgctagaatagaactatattgttttgtccaatgggtgaatcataattgcccagttggatatgaaggaattttagagcaatcttggagcgcataaatatgaagcaagaacagttctgttatggtaatgatagtaatcccaaaatgccacaaatacactggtatttcaataaattaataagaatatttcatggtgacatgaatgcccttgtgtcttcccactagtaaaggggacacatgttgggttgatcaaacttcatcttctctataatttaaaaccctttccaaccacagtgcaattagctccatactctactcctaataccaggattccgaacataaggatccaagtttacctacttaatttaccttcgttcaatatcctctaatcacctttgccatgtttttcaacatctcattagtgctgaaattaataccttaatatgagtgacacaaattttgctctgtttggcttattccctcagtaatctaggaaccagcccccttgacacaaaatagaaacataagtaaaatacttttaaaagaaaaaaaagggccaggcatggtggctcatacctgtaatcccagcactttgggaggccaaggtgggtggatcacgatgtcaggagttcaagaccagcctgaccaacatggtgaaaccccatctctactaaaaatacaaaaattagccagggcatggtggtgcccatctgtaatcccagctactcaggaggctgaggcaggagaatcacttgaacccggaaggcagagattgcagtgagcctagagagcaccactgcactccagcctgggcgacagagcgacactccgactcaaaaactaaaaagaaaaagaaagaaagaaagagagagagagagagaaagaaagaaagaaagaaagcagtatgttgctgacaacatgcacagtggttccacttgctttaaagctgttatgccaaatttgactgagcatttactccccacactgaagcacctcccaggcagcaataaaggtcctacatacatggttaccctgccttggacaatcaaagccctattgcatgcctttctgctcttaactattgtgtgcctgctaataggcaatgctccctattggcactgaatttggaagaaatttcttgtggagcagtttttaaaactgtaaccaggaaaagaaaaaaaaaaaaacattaaaaccaatcaaccaaagaagtcgttttggctatttgctgcattgccagggactagtttttatttttagaaacactttcatgaaacagagctttaggtatttttaccaagtatagctgatccagttacttttcttcattcttatttccggtatatttttagccgcaagagttactttctctggtaaaagaggtgctgtcccaaaaataaataaaacttgggtggacaaaaaggacatggtccacaggtctattcttgggaagtgcaaagcagctctgaggacccaatctcatgaagctgtcctcagccacagacatctaaaggatgcagaggagctagttgacttggtagcccagcacttgaaaatttctagaaagcagaaccaaaatagcatttttctcctgctgccctacaataatgtccatgcatatgatctttgtggggcctacaggttctttgtaggaagtcttttagtaaacaaaaccccagaagaaaagcccccaccacactactcagtgctttaatgagattagaaaaagacacctctttctcctcatcccatctcaggacttggcttgtgagcaaagcatggactgggtttcagcctcccttcacccccttggcctgacgtctcactgtcattgaatagcacctggatttctttgaaacactgggacaatacttcttcttacattaattgattacatgtttcagccatgaccacaggtaaggtacctgggctctggagaattcaaaggtgaatgaaatggtaactatcttcaaaaaagagccctcaatctcagtgaaagtatgagcaaaggtataaaaggtgctaagataaaatgtgcccgatgctggttaattttatggtttcacttgcgtataggaaagtcatgggtgattgagcttaaaaatgagcttacgtgactaatcaagagaagaccatgatacggcagttatagagaacagaaatggtttgtcaacactgaactttgaggatgtgaacttagtgatggtcagcaggatagattagtgtatcctagctggcctctctgcttccagcctctttagatactctaatgatcatttaacacagaggctagctaggaagttgatagattatattactgctcaaacattccaagggaatagtatacatccctaatccaataacctcaggctgggatgtgtcacttactttagacaataaaatgggaatacatagtatatgcaccactttcaagcaaaattttaagagccattttatggttctataatacgctcttttctttttgccccaatgtcccgatcagggctgttccttcagtcggggtcccagaatgattatactttggagcagagctgcagtcaactcataatagacaaacggcagcatcaagaaataactctcttgttttagcaagtgataccaatttggagattgtttgttagcgcagcgtaacatcctaagttcactgatatgggaagctagtgcaccttgaaggtgaacacaataaggtcttaggctaaacataagaagtgatattggatagaaaagggcagagataataaaaatcacaacaacgagaaatcgacatcacttagtatttatgtgtccagcagtatgttaatcacatctcatttaatcgtctcaaaggcagaactcaaacacatatctaacaccacagtatgtgctctgaattttcccagtaaccaacaaagcttggtgatttttcgtgcatgtgtagtaagattaactcagcaaatctaggtggctcaagccctgcacatgcccaagaaaaacctctcttcaagactgaacttaggccagctcctgagagtaagccttgagccacaggtatattctgcctggtaagagtgttgtatgcctcaggccttggagcatgtggtaccagtttgatcagatagtttatgctaacaatgtgatgcatgatggctgcctgttccttctctgaggagctgaagtctgagtagctgaggtaagtcatacaggtgctgcatgactatgtggctggcctccattaaaaacatcaaagctcaagtgtttccctggttgacaacactttgcatatgtcacacggtattgcttgcagaattaagtgcatctgtgcaattctactggaaaaaaacttttagaagcttgcacctaatttctcctggacttttccccacatatcttttgcttttcagattttagtctgtattctttcactaagtaaaacataattgtgactataacaacttttctgagtcccatgcatccttttagcaagtctgagggtggccttgggaacccctgatacagtagtgtacatgagacaggttaatgtcaaagatgacaccaaatttccaaggccaggtgattcagaaaatggtagtttagtgaacagatacgggaaagtcagaaggaactggtgagctgggagggtgggtaaagaaagaagccgaggaagcaagtggaggatggaaggtaaatttggtagctgacattcaatttgacttccatatccaggtaggaacatccaatgggcaatagaaaatgtacaactggaatctgtgatgaaagcccagaatgggaatatagttaatggttaaaaccatgagaatgaataaggcactgaggaaaagattagagaaaaaaacagcaaggagttgaacacaaactgtgaaggatgaaacttggctgtctacatatgaaaaaacaatgagaaggaaaacaaattttacctattttcaattcatcatgaaagattctgtttaattttatatattaagctagttatactgtatacttttcacaggaaatatttgctaaagagttttttcttgatactaaataacattttaaaatcagctgtatttatttcctcattgaagcctcattttaagggcatttagaagtttgtcttatgagcaaaatattcagatgtaattatgataagcattgaaatatatatatatttatatatgaaatagtttggagttatttccaaataaactggggcagagaaaagccccagtcattcctgatgctacttcatgtatctatgtggctaacaccaggtctatttctatatgtttatttgcggttttagctaccccaaaaattagggtcaaaagaaagataacaataaagtcagtcaaggtcctatggggtttcatttcacttaacacatttctatttttctgcattttctttaaatggcaaacagagctagacaccaagagcatcggactcaactcaagccactcacttttgtttctgcttcctccagaggtgattttttaaaaatattctcatgtgcttttagacttttattcttctatggaagaacatgtttgatcatttcagaaactcctttaaataatgttgctgtcaaaatcagagtttctggctgacttcccccatttcaccggaagaggcagccccccaagtttatgacctcaggtacttcttactgaagttttagaaaatactggatctgccttcacttttcgttttcattttcttagccctactcttttgtgtgagagaatacatgtttatggctatctttcaaagagatttatgaattggttctagggctgcatatgagacagtgagcgctagggaagtcagttctacagccagttgcaccctgctacacttccttcaatgaagagttccagtccatcatcttagggtcaagttgttgagaaagtcttcaaagtgtaacattcaaactagtgtctcaaaagctcccccatgtgtgcgcatgaaaaataactcatcaagggaaagtttcactggagtacatgcagaataagaacagggaccaattttcagatctaaaaaatgtaagatacaagaaaacaccacattctataattatcattttatttacatgtgtcatgtttaacatctaaaagaataattaggtgggctgttttgtacagattataacattagcaaatgaaatgaatgcactaaaaacaattatttttctgtaaaaggtatgaaaaaacagggcaaaaaaatgaaaaacacttggaatttttccaaccataagtatactcaaaaaagaaatgataagccctctgaatatagtaactgatttatgttttagcccaagaaatgaattctatgaaaataaaccaaccaaaacattagttgtactttccagaaagcaattgcctaatggaaatgccttccatttctccttttagcccatttatctttcccttaggggaaaacacactacagctaagactactgtgtaaatcagctacttccaagcaaaaggtgtgcttcccagaatattaaaactaaggctggcttgaaagatgttctattctaacctccctcttttataggtgaagaatgtgaactcagagaggtgaatggacttgtcccagttcagagagttggcggaaaatttgagagcagaaccctaatctgttttatagttcaatcattatcactttatactattctgcctcccagtttttagtaatagtaacaaattataaatagaaaaaatactaacaaatatttctaacgctaaaatgtgctgatcatttactctgtgccatttaaaatgcctttaaatacattatatgaattagctcatttggtactaagaattaacttctgaaaaaaagttgtattctctccattttacagatgaggaaatcaaggcacagagaagcacagtacctacccagggatcttaaagagtaagtgttgaagctactgtaatagctaagcagtctaactctacagaccagattcttaaccacaaataactaaatagtataaagaaaatagaattgttattcaaaattcaaaggggcatcagctatggtattaaatcttatcttttggcaacataaaattgaaacctgtgataattcaaacagaaatagggaccaacttgaaactaaaaaacagcaactagcttaaaagaaaaacccttacctaattaggtgaacaaacttgaagctttccaagtactgaacttcatacaaatcatacaaatagaggggcagcatttttcagtatggtaacgcaaatcatgccaccctataattagaaattattcttacctattcattaaagcaatccctgtcctaggcaattattggttagcctagttttcaagtaataaaactaaatgtcttaagtggaggtaatctctactacttttctaattgatccaaattagtatgaacttcttaaataaacaatgaccactcaacttccaaatccaatgggagcctgaagtctgaccttgccaagcctctctgcagtctttgactctgtttgcttcctctctcctcctgacatgatttcctttcttggcttctacgacatcactcccctggcccttgcctggtgctacagatcactccttcactgtagcaagttcctcctcatctatttgattgttaaaggttggtactcccagaagtttgtttctgttgggttcttcctactccccatccccacactcagcttgagtgaccacagccacacccacttcttctactactactcaggggctgatgctcagcttccaaactggggtgtcgcaactagtcctcttccccaatgcctacactgtccatggaaatacctcaaattcagcataatcaaatccaaatcccacacatttcaccaaaaatcctattcctcttcttgtattccttattttgcttaatggatcccaccagtcaacaaacctaaaccttgaatcatcgaaaagtccttccctgtctcccagaatacatacagcttggccataattgcaacgaactgtgctttctaaattgaaccagagtcttccactctctcttgcattctcatgaaaatcatccagactccgccttcattgccactgttcctccacaagccaaaaacctgtcccagattggattccaccagaagtagagcctgagctaagaatttaagcatgagtagtttttcgagaagggattccaggaagcaaaatgtaggagggtatggaagaatggcaagtatgggaaggaacaatactggtgtgtaaatgaccagacaactgctgtgatcaggtgagactcaatgtcaccgggaacctccaagatattatacaaaacctgctgcagactcatcctcaccaggggtgaagaatctgagctattcatgcatcattgtctgagcgatgctctcaaggatgttaacttctggtgctttgggcctgcctcattacagtcttgcaaacttgtagtctctgagacttgtagctgttgtcttgtacagtaacagtgactgccaagggaatatgagaggggcactggcaacacttgccacagaaaccttccaaggctctcataaaatccaagtgcctctggtgcagcctgcaagtcattccatgacctgtgtcctactttcttctccagcatcatttctcagtctttctggtctaatatttatgtgctataatcctatcaacctactaacggtccccaagtccataatgctattgccacctctgttttgtacttactactcccccttctcagaatgtccacctctgtctcccaatcctattttcatctacctggaatacaccaactttttaggaagatacagctctcagatctctttctctctcaagagccttccctcaattccttgtaccctagctgggcacttccacctgtgccactgccctgccttctgtctctctcatcaaattgcacagtagttgtttgtgcacatggctacaccaggctgccagagtgtgaattcccaacaagaaaggactctgcataatttgtctctgtttccccagcaccaagcccaatgcaaaaaaaagaggaaaaattaaataataataattcctgagttatatattatacaaaataaataataaatctgtaattaaaatggcaaacaacagccagaccaaggaaactttggaaaaaaatatatagtaattttccctttagtacgtgctttaaaaaaaaatgactaattaggaattttgctttctctacctatgagctataaatcaatttttttcactctgcttcagcttctcaagctgtgtgcctctttattagcagtgatttccttaaagggaatcaaatgcttaagagcccctaataaatccttatggatttaatacattcatggatattttgtgaccacatttcaacctctctaactcagagtctcttctatgtgcctgacagtgagctgccttcacattgaacccaattagatactcctaaaaggaagaaacacgtgttgtaattgccctcctaagactctttgcaggcccctctaggtcacttgcttccgttcctctgcaggggggttctgccagctccagcactgatgggcagaaagccagtgcagcattgggcaggggcagccctgcgcatgaactttcactggatccatcacaagcaatgcatttatatgcaaatatacccaaacctgaataatgattaaattcggattctgggaacttcctggagacaaaagaggatgaaaaaggagaaagaagtaatgaactgtatatctaaaggcttctagttcaaaactgacttgatgtacattgatgtgaaagctaaacatatggtagatatctttgatctgggatctgtgacacagtttgtgcttggcatctgttgtttgtgattttgtgatgcattgatcactgtcaccatgtctgatagaaactaaattgccttcagtccatgcagacgtgattgctgcttttactctcctgcccatttgcatccttatagtttcccaatgggaaagaaaaataaccacagtggatcaggttttaacattgggtgttgcctctcatcacctgtgttttggatttgccctggccaacactaggattctttcatctgagatgataaaaatctaccaatgcagtaacaaggacaaggtgatctgttacagaaaaagcaaagaaggaaacttggaacgtcctgctcataagtcaggtctgcagttcatgttttatttcacatttgcagacccactgcaggcagccaaggagttgctatttgaaatgttttgctgacctcataagaaacaatgtaaatagactttgtatcccaatgacgtcaatgttagagccagtatccatgttcttttctattttgtgagacttttgtgtatattgtttccaactccctgtgctcaccagcagtgtgttctgttttggtgtaaactgataccaatctttgcgtgttaccatttctcctagttcccctacactgactataaaatgaaggataacagagggtaaaatgtaacatgggtgacaggggcagagatgcctgtactgaccccctctttccactcctataccctttggtgctttttccctggggaccttgttctagggttgttttatggacaaaactttgcccttaaaggtctgggcttctgtgtcaggaaaagctctctcaaaccgtgtttttcctctactctcacgccaccacaacaacagtcatcaacacagaagaagccttctgttacccgaagtgtggagttttgcccccacacatcaagcagtggacaccaactgggggtcctctaattcaattctgccactatctacctggagatagcatcagatcccataggttgagggctcagtcccaaagatgcttccacctgtagacaccagtcagaagtctggtgtcttttgaccaaccaacttcaagttggggtttccatgaccccttctttgggtttgattaactggaattggaagcagctcacagaactcaggggaacacttttacccttaccagtttattataaagtatattacaaaggatacagatgtgtagggtgaggtatgagggaagatgcatgagcttctgcgtcctccgtagatgcaccaccctccaagaaccttcacgtgttcagctatctggaagctccccaaacccaatcctcttgggttgttatggaggcttcattacataaacatgattgacaaccctgtagaaatgtgattggacaaaaagtgcatgatctaaacccatcaatgcctatctactcagacttttcttggcctctctgtgtagcattcattcctcttaggtatagagcaggactctttctggaatgagggtattttggttttttggggttttttctttattttttctaaaaaaaaaatgggataaatatgcagaacgtgcaggtttgttacacaggtatacatgtgccatggtggtttgctgcacctattgacccatcctctaagttccctcccctcactggtgtatattgttcccctctctgtgtccatgtgttctcagtgttcaactcccacttgtgagtgagaacatgcggtgcttggttttctgtttctgtgttagtttgctgaggatgatggcttccagcttcatccatgtgcctgcataggacaggatctggaatgagggtattttgaccgacaatcagattagagtcctgccttgggcaagtgaaaggaggacaggagaaggttagagggaaagattccgtttcctgaggcctaaagtgccccaacattataacaaggattatgggagctagaagccaggaaccatggatgaaaacaagtatctatatcataacaccacagcgacctaattaagtaatccattatcaataacgacagctaaaaattcaacaaatattcattgtgtacctcttatgggcaagttatggcttttctaagcatattcacttcttttttcttttttttaatttcaacattcctttgaggaaagaaaggacagaattttaatccacattttgccatccaagaaattatgatatagaatatcatatagatatagaatatgatatagagaggttttacactttatctccaatcaaagagcaaatctatgaaaggattggaataaaatacaagtctaacaatagaaagtccagtgtcttctccctcttccttccctaagcttacaccaaattgcactttataacacagtagtgagaagaaattctgaccacagaggttctcagcttggagtctatgcccatggatggatgtagaaggtattcagactcttgaaactgtattcaaaaggttggcatatgtgcatttttcgaaggagagaataaaaaaactctaaatgattaaaaaattttaatcatatgatttatattttatatacttgaataacaaagcaacctcaatattgcatgaaacctggtatttctctttcctagtcacctaaaatgcaccctgttacaatcgttcacatataacaagctaccttaaaacttagtagctgaaagtaacaacagtgatttcattttctcacaaatctacaatttggggaaggctcagaaggcacagctcatctctgtgccatgtaatgtcggctggaattgcttgacaggctgaaggatctgcttcaaagatgactctcacacatggctgactgcagtttcctctccatacgggcctttctatgggcttcttcacaacatgttggctgggttctgggagcaagcctctcaggatacacaaagtagaagcgacccatttctgaaggtctgcaccagaaactgacacctctaccccatcccattggtcaagcagtcacaagaggatacaaggggaagagacatagaccccatttcttgatggaaggagtgtcaaaggattttgaggccatgttttaaagctgccatatccctctggaggcatcttatttcttcctttggtttactccattactattctctctcgctctcatagatctttgccatgttagaaaccaagctctagcatccctcctatttcccacttcccggggcaagtgtgtggctgttgcagcctactgctgccaattggctggcccttctacctacatctctctacttcttagctctgggtgtccaacccatgcaacttcctcccttcctcccctgctggagtcacatgaggagctctgtgcagcctgcttgtttaaagaaatgctagccaatagctttagggggatagtggtggtgacttctgtctaaaggcagagagatcaaagttattctgcagtagtatattaaatacgagccacgtgcagcaagaaaaagaggccaacctttgccaacagtactctgtgacctctggttgagtttagcgcaaccccaattctgcctgtttccagtcactaaccaaattccttaccctttgaaaagtaagaggtattcaacattcaaggaaatgccaaccaggacttacattgtttgcatcactttcccccattctccttattaattaaaatgactgatccataaaattggttatcagcactgaaacactctctgatactctctgcctccagctcccttaggctgccctttggaaatggtctgctttttctctgcagtagaaatgataatttaaaaaaaaaaaaaaaacaagaaccaccagctgaggagaaaatctccaaggcttggcctgagggggaatataagctactattaaaaaaatcaacctggcaccttggaagttttacctacattctcacctattcaccatctcccatccctcccgtgccaggaaccctctgccctcagagcctttgcatttcctttgcttgggatagaaagtcactggctgtttcttccttcctaaaagaagtcctcgggtctttatttacatatcaccttctcagtgaacctgccctagaagccccatctaaaatttacaaacctaatataaacatgcacacatatacacatgcatattcacacacacacactgcttcctatcactgttacctcctcacagtttcctcatcacttatcgctatctaatatatgatgcattttacttatttattatctttccccttctacaatgatagcttcatgaaggcaagattttttatgtcttgtttactgtttggcctagaacagtgacttgtaccaagtagatgtgcaataaatgtttattaataaataattgaataaatgattgatctaacctataacatccccacatggtgatcacagggggctcccagtcacactgtctgctctgaaggtagatagctataaatcaggctctaacagccaccccgcagattagtttcctactgctactttaacaaattaccattagtggcataaaacaacaaaagtttatcatgccacagttccataggacagaagtcctatgagtctcagtgggctaaaaccaagaggttcatagggctgagtttctttctggatgctctaggggaaattctctttcctcgccttttccagctctagagatcatccacattctgtggcttgtggcccttttttccatttttaaagaacgcaatgttatatccctctgactactgccccttagtttccttagtcacaattccctctcttttcctgcctaccttttaaaatattgaattgggcccaccaggataatccaggataatctccctattataagatcatctgattagtaatcttaattccatccacaatcttaactctcctttgtcctataacgtattcaaagattccagagatgagaacataaacctctttgggggccattattctgctcacatcatcctcttgagcaacctaagaagtgataaggcctctctcatcaatttgatagctgtgatgttccatgtttagcccttacctttagtccttgttgaggtatagtacaaacttccctggattgaaaggcagaagatatttcattcaagacccttctgaaactgttggttttataacctgggatgactaactcaatcacaattactgagactccatattttcaacagaaaagtagagttaataaaacctactgacaggactattataaaatgaattgtggagaaatctttttatagaactttcatacttcacacagtgtaaggaatcattgtgaatagagatctctaggaccaaagataccctgagtttgtactgatggtttttattgttttgctcctcaaaataaagtaccacattatcacttgcaagtttgaacaaattacaaactgaaattggcaatgtcacactcagtccaagtcctataataccattacatgatttactgatgacaatattgtacagacaatccaactgtgaatatgatttttgttttttctagttgaagtttcttcatttatttgtcctcagaaaaacgacattgagaaacaggtaagcctcacctctttcatttggtagtgtgagaaacaatgactgtagttaattgtatatttccttctaggctccctcaggaagaaaaatgtgcctcattcacttttgtaactctggtgcccagattcttgcctggcagagatactcaatgaatatttgttgaagtaattaataagctaatacaccaatatttaattagagatgcacattaggaaattgtccatgctgctgctatgtagctataaatccctttccatcttcattttctagccttttgttaatcccaccctgaaattcccaatatcaaggggaaactggcctttgcctgacctctggaaagccatttaaaaaaaaatttaagcaaaatttctttaaatggggaacaccgtactccagttcatgcttccagttaccactctcatgatcaaacatttcttcctagagttcccctaagaaggataccacagggaagattgtaaacttcttattcaagtaaaagaggtgaagatgtgcaacacatttaaacgggttcttcccctaaggaaggtgtaactattgcttctacagggagccagggaagatttccttgaggctgaaaaatatgcccagtaaacaaagctttgattgtgaaacttcaagtctctgatggactttttttgaaggaaagcttataacagaggggtcagtcaatgacacaccaccagatatgttcaaataaatcaaatgcttataccaattccacaacctgcttttgtgagcctcaagacacaaccaacttaaacctccataaggtggatgtgtcacacatcggaacaacttcataggaaaacagtgagaactgggcccttactgatttcacattgcctgatttgccaagagaggagaaaggcttttctaagccaagagagtctttaagcatcgcacattgtgtccaatacttgaggtgtgacagtaagggtctaagaggaaataagtttcttttttcctttttttccccttgaagctgcaagatttatgaagaagaaccttcaagttttatgaaaaagaactctataagtagcctactacaaataaaaaacactaccaatttaatcaagaagttcaaggaataagatatgtttgtattgcatttcacttaaaatactcttcaatttaaaaggaggacttggcaatgtgaattttgccagcaacaaaaaattcaaattcaacaaccaattccacaataatcattttgccacactcacagcaaatatccctggattcactcaaacttaatactgcaaaggtagcacttaaaactcttttcactttaggtacccactgaacactgaggtggccagagtaagtaataaactcttggtgataatgaatggctagtccatttttctttgccaacatacaatagattctggtgtggaagaaaatagtttcacagtaaaacactaatttaactctcttagggtactaatctatgtgttgaaaaagaggtttcattgaatgttttcctgagttatattccaattatctacagatttacctaaattttctaaatccatgtgtattttctactaatataacctcttattttttgcagcttaagtgctcaataaagctctaattagcaaaagatgaaatatgtttcagtcatctggatttttattcaatcttatttacatgaattcaaatctatattctccccaaaatttcgacaaaattcacctttgtcaagtaggtctgtcctatacttttaacatgaagactccaaaatatgcacacaaactaacacatacaaagaattttttggcacaaatgctaatttttcctacacaaggtcaccgttaatgaactgctttcaagaatatgtaaaaagagtggagaacaatatattttaaattatagtggcagctcttgcctccttttaaagttttctccccataacttgggtttgtagcactgaaatggggataagaatgctcacagttattgtaaagttaatttaggaattgtgtttttatgaagaactttgaactcgaggtttgatatgttgaaaataaaatgtatacatttcaattgcctatcgatttgtctatattttctgaatccatttgtattttccactaatataacattttatttactgcagttttaagagctaaacagaactctaatcaacaaaagctaagtttcatcatctagacttttatcctattttattgacttcaactcaaatctgtgacctccaaaattttccttagtaaattcaggtaatcactcagtacaaatgaagtaaagactttcagttaccagatactaaattacaatttataacttgtcttgtctatttacatatgtttaagatctttcttcagggatggagcagcagtaatgacattactttggcagagctcatgaatctacattaatatcctctcatctggggttttccacatcttgctccggtacaaacattttcttgatggcaagaaccaaaactcagcaacccaaggaattcttgcagagaaatattagctgtctcacattttcgccttcagggtagttccaagagctaatgtctaaggctatactaatactcctaaagtgacccacccgagcctagattttcttcaaatggctcggtcccaagaccttcctcatgctccatcttaatgtacaggtgcggtgggattctcttaaaccaaatccaattcaacaaagaggtgatgctgagttgcataaaccacccccctccaccactgagttacaaaaataatcgtaccagcagaaatctgacagcctccatctgctgaataacttgttgaaaaccaatcaaccagagaccactaattattctgaggtctttttaaaatgtaaggttttttttttaatttctggaaacttgactgctattatttaagatggcccattcaacaacaatggttcataattatatctatttattttgacagtccatagctcctgataaaaggccatctgcaacattttcaaattaaggattttttcctacaaagaacattattattaacaatgtgaaatattgaagctttggaagggaagtgtaatcaaagaccacaacataaaattccattatcacagtgtctggttttgcctctgctttttcaatttaaagaggaagaactagaagtaaatgtaataagtagtgaggcagaaaggatgagggaaaggaattgctgagttagactgaaaacatctcaaaagcaaagattacgccttttatttctctttctttttcaaaatacaatgcataatctacactgtgttctgttaataaagggtgccaagatagaagaaaaaaaaaaaaagcaaacaagccaaactccccttcagaactcctccctccccgctctgcatctctctaccttgcttaggtgcccattccatgagttgtttgagccccctaaccaatatcacaccgcttaagcctgcccattaccaccaccaggggaccatgtagagtggtccaggttgtttaccacacaaaggtactccgctcaagcaggcatgtgatagctaaaacccagcccacggttaccaagagaatcagctactagtgcccagctggaacagcctccttggttgttttgtgggcttctttgagaataccaagctgtgtgcactggtacagggctacatccacccaaagggggcactgctcttttctgttttgcataaaataacagctttatccactgcgcatgttcccaaattttcacactcactcttcccacaaaggagcagatatgttaaaatagatgatcctgagagtttattattagacaacattttgcagatggtggagtctaatgagaggagtaaaaataagaaaagcctcctgtgtcttcctttatgaagtcaggaaggtgaactgggttgggctgctgccacctgggaaagaccctgccacatatttctttggcttcttcccttattttcttacgggtcttcttctcatggggctagaaggaaagtcaaaccagggattaccccatctgagaagacctgttccctctctctctggttctatattaacttttaactccttttttttattcttttctctttttagagacagggtcttgctctgttgtcgaggctagagtgcagtagtgtgatcatagttcactgcagcctcaaactcctgggctcaagggatcctgcctcaagggagcctgcctcagcctcgtgagtagatgggacttcaggtgaaagccaccataacaggtctgactcctattcaaggctggagattttgcccccagacagagaagacccagagttaggtatctatgccagcttggccttagacaacaggtagatctgtgtttccttagtcttaggcttgcttctgctgacttgctggccgacttatcccaggcagacctttcctttccttgaaaattaaagccttcaacagccaaattcagacgtggacctcaaggtaggttgggaattgtatggaaacaaagacgaacactaggtcattctgactcttagcccattttccggcctcacaaaagaaattcttcacgtggtccaatgcaaatttttaggatcccacatttactactagcactcacagtatttttaaatgtgcatttcccttacaaattaaaactgcaatgagctatcacctcatatctgttaaaacagctatcatcaaaagacaaaagttagcaagtgttagcaagaatatggaaaaaagggaacatctgcacactgttcatgggaatgtaaattagtgcagccattatgggaagcaatatggaggtttctcaaaaaattaaaaatagaactaccatatgatccaggaatcccatgactaggtagatttctaaaggaaatgaaatcattttgaagagatagctacactcccatgttcattgcagcattattcacaatagccaagatatggaatcaacctaagtttccatcaatggatgaatggtaaataaaatatggtatatatacacaatggaatcctgttcagccttaaaagaaggaaatcatgtcatgtgcaacaacattactgaatctggaggacatcatattaagtgaaataagccaagcacagaaaaacaaacactataccacatggtttcactcatatgtgaaaattttaaaagtcaaacctacaaaagcagagagtagaatggtgtttactgggggctagggacagagagttgtaagtgggagagatattggtcaaaggataggaaacttcagttagctaggagaaataagttcaagggatctattacacaaggtgttgactatagttaagaacagtgtattatgtacttgaaaatcatgagtagatctataatctcatcctttgtgctattctgcctgagctctcatgttggaaaaccatcagataaaataattccttatagtataatttaatcacattataggcaataacttaccctaatcaatttgttcatagagtttagaccttgaaattcttgcactgtagcaaaactaggtgagcactcttacagttattcacagcacaggctctactggaatggacaagatttctcaggattaccccagaagatataattaggatagaccatgaatccaagaggttttgctttgggaggagaaaatgccattcttttttgttttttaatcttctatggttgaatgcaataaaaaaaattgcccaagagaattagctcttagtgcccagctgggaagacctcctatttttgaactgatttgcaaatgatagtggtacctcaccattattgaagaaggccatagctgtattagcttcttccatccaccactcacacaacacattggccaaatcaagtcagggaaagtggtcagagctataatgatggtggtaaaagtggctgtcacttttacggatctgttactagttggacagaccaacaggcttctaccttggcctggtcagttcatttccagattagggttgacattgatggacactgcctgagtggctggtgtttcaccatcaacatcaggagtagcccagctgagaggactaatccttgtctgagttctcaagagagttactgtaccatagagttagctatcgaagggaacctgggacatccctcagtccaccacacttactccccagtgctagatcttcctctacaacacccattgcattgtcaactgacctctgcttgacatttcctccaaaagcaacccatttttactttaagagaaccaacttctcctctattctcctataacaggaattagaatgagaatagctatttactaaatacttaatatgggatttacatatatgaatttattcaattcccataccaactctgtgagataaagattaccactgccctttttcaaatgagaaacagactcagagggtgaagaaatgtgccccaagtcacacagctgaacaaggacttgcacccaggtctgtccaaccccaacaccctgtttgtaatcactaaactctacttcctcatgttaagcacccacctatctttgaattgcaatgaggcatacatcccaaaattaacattttaggtccctggagatctataatttgattatttatagaggaggaaaagccaagtttaagcaacatctaagccccacttaaataattgctttttatttcctttcatctgatccattctaggcctattttatagttgcactctcagaaggtgtgttcacttctccaatccaatttcttggggtgggggtgtgacagaggctatattacctcttagtattgcttatagaaacttcaagaaagctataaagaaaaggaactgaaggatatctctttatattttcttctcctacttgaaatacagactattaataaggggcttaaaagaataaagatgtcagcaagaaggaaaattaaaggttcaaaagaatgcctttagataaaatgagttgattatgtattgtcagactgtggccttctggtatctgaaacccttcctatatttgatgaatttcctgccatgtgaatcttagtgggaaacaaagccccttccattacagcagtcaagatagccagattctttctttttcagactctctggcagtcatggcacagatcatggtcatagacaatgatatacatccatcctggggcttcaaatccggggccagtggctcagagaacagagaaacttcatcctggcaactgtggtggcagcagccagttgccaggccagtaggtccagcagcaccaagcaaccgtatccaaggccaacaccagcagtggccgtgccggccccatgcccagtgttcagcaggagcagcagtgatggctccccaagctggctctctggtgtgacttttaatttggctctggcttccctttttccccacccatattctaagtctggttcctacaactttacagtgagtccaccagataacctggtatctctcaagaagttacttttatgcctaagccagccaaagtctgtttcaattgcttgccttgaagatctcaagtggatatatgatataaaaggacacatttgtgctcaaccagagtaacagcaagggcatcaggccatatcaggacccctcactaaattcacatcagcatctgaggcttatcctacctttggatctggaaaaacacaagtatggccagattctctcctatttatttcatgactgcatcacaaagtgaccactgcctcagaaccatactcactacacaagaatgtggaatggtaaaacagaagtggatgggactggggttcgaaagttttcattagttttctgctatattgaaatataaattctcgcctgtaatcccagcactttgggaggctgaggcggacggatcatgaggtcaggagatcgagaccatcctggctaacatggtgaaaccctgtctctactaaaaatacaaaaaattagccaggcgtggtggcaggcgcctgtagtcccagctactcgggaggctgaggcaggagaatggcgtgaacccggaaggcagagcttgcagtgagccaagatctcaccactgcactccagcctgggtaacagagcaagactccatctcaaaaaaaaaaaaaaaaaaaaaaagaaatataaattcttatcaatccccaagtatatgtaatgacatataaatttcttgtcctaacatcctactataaaatccattaatttatagaattaaaactgaggggctgggtgcgatggctcacgcctgttatcctagcactttgggaggccgagttgggtggatcacttgaggtcaggagttcaagaccaggctgaccaacatggtgaaactccatctctaacaaaaatacaaaaattagccgggcgtggtggcaggcacctgtaatcctagctacttgggaggctgagacaggagaattgtttgaacctgggaggcacaggttgcagtgagccgagatcatgtggtattgggggatacagaggtgaagtttgcttcgtgcacaaatttcttcatttaattctgcatcagagaataatcaaaacacaagcacttgggataaaggccatctaagctattttaaaacagagccagtttttgcaaacaggggtactgtttacaaaaccgtggtactggggtagttttgtaaacttggtactgctatggagtccacagggctttattacacaaaagccacattttaaatacggggaagatgtttagcaaactatcttatgtggtaaaactgtccagaaaagtcaggacatgataagcccaaatttcaaggagtggttccaacaaggagactgcacaaaaagccggcttcatgctccatacagtacagtgggcatactcaagacttattttatggttaggcttttgatgacatgatataaagtcttgaatatataacacacttcacaatgaaaaatctagaaaaagggcaaatgatgataaaaagaaaagtccacctttcacgaacatctttcttcagtctactcaattgctgaagctgcaaagagtaaatgacacacatctctggagtgtgcacaccctcctgcccttatgttaaaaaagaggatggagcctccctctcacggcaagcccacggggcagggggaggctttgaactgataatgatgtacaggtgaaagtgatcacacgtcagtgatccgcaccaatgttgatcagcactctgtggcatctccctccaggccgcatctcaggagtctacgtgttaaacgtgagcactggctaattcttcatcttaataggcacttcccaggaaactccaaccctgctgagacccctccagtttgcccagtcctgattaatgtgctacttattacagaacattgaaatggttcccagaacatgtttgcagcatctgcgtcaatcaacagatatgtctagcccaataaactgaaacactctgtcttcttccctgctgcatcttaataagaaacccagagagtttcaggcttcttgttaaccttttaaagcactatgaaatgaatctcaataaaatctaaatgtgaatacccaaaaatgggaaagaaaacacagattataactccaatcaaccaagagtaaagagaaaaagatccaacataaaacttaaattggaaccctgacagctggaaaatacgactgatgacttcaaacgctctctctcagagtagatggggccactggtggtgattgtttctttgttccagcaatgcctgaaatagcaataatgtgagaacaataattccaccctaaatgcccatgggtagagaacattgaactataacagcaagtgatatctgcagaacatcctggaggttgtgcgacatacatgggaagacatgcgaattttggcatccaaaaatcttctcaaatctcacctctacttctttcctctctgagttgcagttccccatttgtgttgtgaaggcagtaatgtctactacatggaacagctgtgagtttacatgagacaatgtgtgtgaaatgcccactatggtgcctggcatgtgggaggtgttcagtaattggctctacccttgttccgtgggacacctacagccacgaagagctgcttcattcctgctttctatgggctaggccagttgctccaggccagtagcttctggcagtccgtggttgcaccaccgagtggacagtcacgcttcagaatgtcctggagcagttttccacaatacacacaagccttgctgcataagggcacccagttttgaagatcacgtttggagcagtcaactggcttcattccaggtgatcttatgttgatgcttaatatccaggaagactcctaagggatgtttataaaccaggttggtatctaacaaagctgtgaaacagtcctaaaactgtcattgttgatcccctgttccttcatggtatgtcccttatgctcttattatcaggcaccctgtaaccacattggacagaagctccctgtccttgcagggctataatccccacattgccaccttccaaagccatccaacccaggcattgccccatgcctcaacatgaaaactcacttgcctggtaacccacttataaaaccagaaaccaaaccatttacagaagatctagtctaatcctccatttaattaataggaaatctgaggtcaaggcccaggaaaggccagatgctagcacagccaggtctggaggccagaatatccagctcccagatcagaggtgtttccactccacagtgctgtcttaggaggctcggcaggtggaccaaaaccatggcacacaatagcttagtgtgttccttctctaaagtaatatttgcttttaacagggacatataactgaatagaatgaagaatacttaaatttcaaaatagcagccagagccagtgggatgatgtttgaggttgaataagagacttttggcctccccaaatcattgtacttaggcaaccacctacactctcaggaaatgttctgcagatgaagaatgttttgtagatgtgacttccacccttccatccacctatctattcaacaaatacttgctgagtgtccaatatatacaaggtacaattcagtagggacagaaaagatgacctcttcccctgtattcatgttctgtgtgccaggtcttgcaccaagcacttcctttgccttgtctgacttaatcatcacaacaatcacatgaagcaggtatcatgtcccccattttacagacagggaaactagagctaatagaagttaagtaaatgcccaaagtcttgaagtttagtaagtaacacagctgaaatttaagcccagtctgctgtactccacaacctctgctttccctccttcctgatgctgtctctccagcaggtaggtgcacagctgacctttgtcaagaaagtattgtgaaacccacattagaaaatgcacgtgaagcaggcagcacaatgcttggcatatagtaaatgccttctctttttaaggttggacaggacaaactgtttcataaaacttttgtttagtttggaactcaatgactctttggtttgcaatattgcaacaaatgccaatattttatataaatgacaagcattttagtgtaaactggccactttgttaaaactgagcgattctcctcagaaaggaagatctaggaaaaaggaagttctagaaaaaagatctagagagattttctgatcctacagcctaaccaagttattttgtgtacccagcaccccgagtcagccaattctttttttttttttttttttgtctctctctctattcatttatctggagacagagccacattcattcctcatttaactagtacacaattagtgggtggtatttaatgaaactatgttgactgcttggataaaaaaaatcatcagaatggaatgttgagcaactattattttggttggaacaatgggctttgttaacctgaatgtaattgaaactggaagtcttccccagggattgcattacctctgctcaagtgactacaaaaactctctgatgtcaggtcgctgaatacaacttcagtggcctaaagcttctagagcagcactctctacaagagtagaatttctgtgatgatgaaaatgttctttctgtgtctcctctgccaagtagctactagccacatgtggctattgagccctggaaatgagattgtgtggcccaggaacaggatattttattttcttttattttcattaatgtggaaagccacatgtaccctgtggtcagcatagtagataacatagttacagaagaattgacaacaggaaagttgttttatagaggagggaataagggctccgtaacatgacatcataatttctagacaaacgcttaacttccctgaagcagattccgccaagagggattgggccatgttggaaagagaccagtttgcctgtaatattcttcctttctctaatcctgggctcccttcaggtagaacccagatcaccatcaggaaccagagaatgagaaaaagtagagagattgtggaacctctaagccatcttctcacagaggaggaaactagagttcaaagatgcagccacctgccctacctcatataatgaaagaacaatagagccttctgacatacagactacccgctttcaactaaatttggctgacatctgtcagttctcttctctaattaactgtgggcaaataagttttcaggtgttgcaagggccaggaaaacagtgaaaatgtctaaagaatgccaagagtaaggtgaaagggatcagtatcctatcaggagtgggcatcccatcaaaactgggcagctgccccttgcagccaattgcagccaggcaataatgtgtcatctgactgtccagttttcccaagaggagcaaggaatgagtttgcaacctgtagcttaacctatttcacctcactctcataactctcctccattctcaactaccaagaatacttgcattataatagaagatctggcattttggaagtttgttcaaaactcaggggactgaatctgtaactggcgcaatttttggctctatgaaggacaatgaggtcactggccctgtcgaggactcttcaaaccattccacataggtgggcaccgctatgctatatccagcccaaagctagtcaggagtttcactcccccaactaagaaaatttaacaaaagacagcaaataggtcattgtgcagaaacattcaaatgcttatggtattgcttattaattataacatagtggcctacatctatttgaaaaggaatatttgctgggtataaagcagatacttctactgagtataagccagatactttaccaaggttattataatatgttaatctctaaaacaccatttctagatagtgattattattcccaatgtatagatcatagattattgaagttaagtatcttgctcaagaacacaaaggaaaaacatagaacgtggactcaaaaacaagttgggcttcaaaacccaagcactttccaccatatcctgccccttcttcctgccccaattacacccacaggggttccttattctatccaacagatgggctctgggtggctctctgtgcaatagatcatcttgcacttttttttttctttcctaaatcatagtttcagacttaactaattacaacatttccattctcatcattggaaaaaaaataataaagatatttcctgctaaatcaaaacaacaataagacaaaatttcatatctgcagtgacatagaatggataagcatctcctatccaaatttaccccattcctgatgcctgtcagcagtggatgagaagtatgtgccctacatatcttctttttaaaacttgccatgtctaaatatttaaagtacaggattctgaaatgcacaattaatttttaaaactaaaaggaggaaccagagacaatacatctgctatcccaaactctttcaactgttttctctatctaaagtaaaaaacaactctcagtgcacgatttataaccgccataactctcttctgtttgagatgccacatctacaatgattaatgggaagagtccagggtttctaatactgtctactctgatggcaaattgatatatagtcctcagcaaattccatttgagtctatgattttcctgtaaatgtgccccagagttgctgccacattcctaaattccagctaaaatttatgatcacacttccacctttgattattgtgtaggagtttaatgtaaaactcccaaaatagtaatattacaattgtgtttctttattttattccaggctgcctggtactctcagttttacattagcaagctttttgatgaaaatttgcctcattttctatcagctgcattaataaaaataagtattgctgagaaaataggaccacgtggcacaattagctaatacacattccttctatttcttgtaaattatgttgaaaaaaaaatggcagtaaaaatgagtgtggggagttccatgtgcttcccaatggctggttgaaaaagtactataaattcaacacaactagccttccttgctgtaagcaccaagagcagtgtgttcaccgaaatgtgactgaaattggaaataaggtagggatgaggaatgaaaaaggccaggagatgagatgtgacggaaaaagcggaggccaagcaagatgagctggaggtggaaaggagagagtgtatgtttggagaagttctgatgaggagctgcttggtgacaagagggtcgttgagtacctgagagtacctttacctattttattatgaccaccaaagatttcaaatgattttctgcagctcttagctcccgagcacactggagctgaggaaggagacgtttctctcagaagatcatcaaaacactctagctgcaaaaaaagcagggcacatgtgcagtaaatgtaacctggatccgcgcagtcacaagcctatctccctttccagaatacaagacccctctcttcccctctgcttgcttctttcatccttacatttgtattacattttttctttttcctttttttttttttttttttttttttttgagacggagtctcactctgtcacccaggctggagtgcagtggcacgatctcggctcactgcaaccttcgcctcccaggttcaagcgattctcctgcctcggcctctgagtagctgggactgcaggcgcacggcaccacacccagctaatttttgtatttttagtagagatggggtttcaccacattggccaggctggtcataaactcctgacctcaggtgatccatccacctcagcctcccaaagtgctgagattacaggcgtgagccaccacgcttggccccttatattacttttaatggcaaaaaccgcaattacttttgcaccaacctaatattagtttaaaacatggctgcaaaattcttagaccctcctcccatttagaagggcggtctatgtcatctcccttgaactcggtgggttttgtgactattgcaaccaagagaagacagtggaagtgaggccgtgtgatttccaaggttggacatgaaaagcagtgtagcttccgtcttctttactggaactcgtatgcttggagtcctgagctccacacccagtgtctgacaacatgcaaccaccaggctgtaaggacactaagccacacggagccatcctgatcaccagacatgtgagggaaggtgtctttatgtgaccccatcctggcatccggtctcccctgcccttcaagtctgcacagctggagcagagacaacctattcccgctgtgccttcactgacttcttgacctgtagcttcctgcgtgagcataaaaaaaatggttgttctcagctgctaagttctaagataatttgttacacagcagcagtctctggaactatttcttgtttcattcccacctctgatctttctctgtggaggctccaatcctgaaataagtagtttccacttgggtgtggccctaaaactctctgttcaaatgaaaatttccacataagccattgccaactgaggctctgaggctcctcagcacacaacttgacaattactcttcttctagaaagtacatatgtgaccttccttctgtcaatcacataatttctgaagcactgctttgcctggaaagtcttgccagtttaatcatatgcaaatggagggcctgtaattttccctcacccactccccactccctccaccaatgatcaccaacatgtttgtattgagcagctaaatatcaaaaaaagtgtgaaagaaatacgagcatgatgtcttccttcaaaggacttcttatcatttttaagaggcagtgctagcccactctaccaccaccatcactatagaacaaaataataaagggagagagatattctcgccattactatggttcataataaatataatatagaaaatccttatttctgtgcttatgcaaggtacttttgctccatgcacatccatgtcaccaatgttaataatcataatgattctttttatctgaaataagatagcattcagtcacttatcatgtattcaataactatgtattgagctcttttttgtgccaggtcctctgccagcccagtggggaataaagcggacacagcccctgtcctcttgaggcttacattctagtggagtagaaagacaaaaaaatgtgtaaacataaaatagtgacttatgcagaaaagaaaagaaaaaggaggatgtggtatggagagtaactggaagtggggatggctacttcggttagggtggccagaaaagatccaggaaaatcgaggtggcagcttttaaggcagggactgaaaatgagaagtcagttaagaaaagatatgggaaacagggcttcaggtgacagagtagtaattattacataccccaaagcaggaaaaatcatttcatgttccaggagcagaaagtcttgtgtggccagagagatggggagggggcagagggggtgagaattgtgagaggcggagcaattacgtgtcatgatgccaagtgcacaagtgctctgaagttatggtctcttccctaaaaccagaagctatccaagggtaaaaacaatctatatagcaattatcctgtgctaatggttactttatcatcatcatcatcatcatcattataaagcttgtattgattatgcgcttactttggattaatattttggaaaacatcactgtgctcttccttgcttttcaaatttataaaacattcttaagacagataaaggaagaaggagttaatattcagcatctggcattcaaaacaggccatttgccaagtcttactgacatattgtcttgaggaagaatgtttaaatgtctgtattgcttttcacatatccaaatgatttggctcaaagagttcttccatggtgaaatgaagatttggcctagaagagtgtagaggaaactgtcatctctctttctcatcccaggagtgtgagaaggaaaagcagggaagaacaaagcagtcagatgtgtgtgccttaaagactcttgtgtggatagaggagagcccgagggatgaaggatttctgccccattcctgttcagggctctagaaagatatgccctctcaggctgccccataccaaggacatttggagggagttaggcagagggaggcctcgatgtttagcttttctgagcagctctttgttccctatggcaacctttgaggtagggctgggagtccaggtgtttaagggggaaattagaaagtgactagctgagagctagaacacaagcctggcaaataatgtgatggcaccctagcaaaggctgggtgtggagagtccatccagaggcattggtctctgttcctgaagtgcgatcagtggacaccatgactatgcctatgggtccagacttttctctcccaccaagaggctgcctaagcccctcccctcccctacataccagacatcatcttggagagaaacctggaaaatcctggaacacagagatctgaaagtctgagcaccttttcctagagacagagcattatctaaaatcaatacatcagactaagacagcttagacatttaatttatttttccttctaatcagcagtggtttgctcaggaggaagatcacattagttaaaatcaaaactaagaagctacctcttctccgcccatctggatgagatgtcagtgaactttgtgactcaccacaagtcttgacaaatatcatctcatttaatcctcagcaaccacacaaagcagacactatgactgacttccattttacaatgaggagagctagtctaaggttaagcaactttccaaagctcttacagctgtcaagtaacagaactgtcaaagattttcatgcttggccactgcaggtattgcctccatgtccttgatacaggctctgtgataatatgatggcaatgagcctcagacatttatatttattttaaaaacataaggcacttgccatgggagagacactgttcttactgcttctaacaggaattcatttaaacttctcaataatcatatgaagtaggtaccattaccccattttacgtatgagaatagtgaactaaaaaagctgcatacttttccccaggtcagttttgcagctaatacatggaagaactgacatttgaacataggctgactggccctagagaatgggagatgagatattaactgctgcactggacaaagagggagtcaagcaacttggtaagttctaattttttcaagtcacactcattctaggttgtaataaagcatgcactggtataattttcattgctgataaaaaggataacttccagaagggttcattttccattaactgtaaaaatctatgtgaaaatagttacaactggtagctataaccaaaataggttatgatgtttaaaggaaaaacggactaaaagactagcttaagtataaagcaaacttatgtaagggctagaactatcctggcctttcacgtgtattattaccaccactgtatgacataaccagaagaaattcagacatgtcacaaagggaagtatcacataagtgttagctaatctcattatcatcatcatcatcattgcaattattatataaaaccaaggcatcacaatatatgaaagtaatcaccatgtaaaaagaatttttcaatgcatacatttattttatactaaaagcaacgaatttcacattttaacattatttccgaatatttaagtccaattcaaaccatttagctctaaaaaagtaaaatgacaatttaaaagatcggctctaaatcagggattaaaaaccagatctaaatgaaggaaaacgtgagtgaaattaaccctaaagttagaaatatatttttcttattgctgcaataactaagctatgatccaatggtgttccccagatattttccacctttcctagaaatctcaatttacatactagtttgttccactgctactgacccaaccacccgcaaaaaaggtggctagataggtgttatattgaccacaatctttatcttcccaaagattccccatgccaaattatattcaaaaagattaatattttaagtcactaacttaataaaacagtacaattcttagagtaactatctctttttagctgagggtttttatcccagtgaaggagctgttggcttgtttttgtttctttcacttttcttgaggttttctccattcatggctgggttcatctgtacattcagtctcaggacaataggactacaattatacgtgtcttcaaaagaacactaggaaaatgttatctccactattccatcttgcaagtagatcaactaaaacacaaagaaattaggggaaaaaacagccaagggagactgagaccaataattttgttgccgttacccaacactgcatcgtttttatagacatatttacacattcacttgaaagagcaatccagaagagatagaaaaaccagtcaatatctttttagagagccttactccatctggaggtatttgggcagtctcaaataatttagtgtagtattctaccacattccaccttgtttttgtcttttttctgcatgtctggatcactgatttgtattattcccaaggagacagaactttttctcaaatcatcctcgttcttcgatgcttagttcaaaccctgcatgttttgtgtattcacatagatacttatagcaaaaggattccatcacccagaattatgttattggttctagaaaagtacaatactccttatgtttccaatgatgactatgaggcactccaagatcttaagttatttactaaatcattttgttaagtttttctgttaattttatgtcaattattttggttatttaaaaatatgtaaccactgtaaggtaataacagccagctgattgttttttatttgccaaagcctatagcattatttcctataacccttacaacaaatccttaaggtaggttttaatcaaatactttttatagataaggaaactaaggctaggctagaggtggagtcatttgctaatgactaggtgaatattaagtcataataccaggatttagatccacttcagtctgattctaaaatgatgactttaactacaacattatatagttgaagtcatggaatatatgtataattcatttaactaagctatttaataaatgcaagctccttcatcccctcactagctgagctcacaagcacataacgttcatgctatcaacagttttatttatcccaggacatacttcctagattatattcctactgactactgtagcttactttcattacatcattcactcaaaaaccctcaggatttttagagagcaatatactttataacattacctcatcaaacctataggcagaaaaaggtatattgtcaggtctgttttcatttaaatccactttttttccaatctgaaggagaagcatcccttgcatgcatattgctctatgttttacattggtcccaaaggtactcacacacaatagacttccagagcctttcattttctgaagatgagaggaggaaggaggaaggagaaggaggaagaaacgaaaggagaaatagatgggaagactacacagactcaggaacgcagtggtgcacacttggtaaaagggcataaggtacttttaatattttgcactaagccttgtcattccttccaccttcataaaaccagattctaaaagggccaaagcctatccttataaattcagaatgccatggatgtaagagaatttgggagtggtttgttttaattttgaatttcttttttcgtttattttttttttttttggaaaaacagcttagaaacttcaatctggtgaaagtatcattgacttacattgggttgtttcagccctgcatcagatcccaaagtaacaaataatcttaatgtaactactatttccatccaaccagttataagcatctcctaacccaaagaacacttccagatttttcttgctgctttatcagagttcaggttcactttgtcaaactttttacagttctaaaatagaaaacagaaccgatgccctatgtcttacaattaattgcatgcacttctgtttgttccaccaagtttctcgacagatacaatttctcccctttcgaaggtaagcagaaggggtcatgtattccttagtacatgctgtgataacagtccttgtctgtcatacacagtagggccgatgctaagacgaatctcctcaaataaacaaaccaaagcttctgtgcactagcagtccttggttttgtactttataccaattatataccatttctgccatattatccatacattgtttttatattctttaggtagtttttatgtgttaatctgcctccctagagaatgcaaataatagtcataaaaacaaaaattgatattattgagtatttttatgggtcataaaactctattaagattttttatcttaactgtttttgatcacactattaagatatgcattgcccatccagagataaagctacttaaaaataaaatcaaattaaaaagttaaatatacatacacacacaaagacaggcaactataatttggacctattataaaaattctccctggcatcattccaagggacatatataagttaaagatcagcaaagtattgctttcaaggagaaagaaaagacagaatatgcaacctacttctgttggtacacacaaggctacaaagcagtttgctggttaacactccaggtatctggagtaaaccaatcctagctattttctgaactctttcttttaagtgttataaatatggtaataaggaataaccaagaaacaaagttgtgcctcttatgtaaacctacttgtaatggaattacattaaatctgggagtcattccacatgacagccttcacttacctatctaaggtcataacatccccaaaccaagaagcacctacccggacaaattcaaagtgcctcttcgtctctggtatacgttttaaaatctctccttggttaagacacaggaagaagggaaatgaaatttgagtcttagggtaatcatttgccattgggcagacccacatcaagctagatgccagtaccttgtcacatggtaggaatgcctaagtggttgcactcaacctgggtgagacaactggaagtccaaacctttaaagtgccactgaaagggagcaatcaatggtactcattaatgtgcatgggttcccttctttcagcacctatttcctagaccctctgcatctgatcaggctatgagacaagttctagccaatagaatgtgaatgtaagtcatatgtaccccatccagacctggttcctaaaacctccaaaccacctattaagaggtgacagcatgctgacagccctcacagcccttgctggctctcagcgcctccttggccttggcgcccactctggccgtgcttgaggagcccttcagccctcccctgcactgtgggagcccctttctcggctggccaaggccggagccggcgccctcagcttgcggggaggtgtggagggagaggtgcaggcgggaaccggggctgcgcggcaggcacttgaaggccagtgcgagttccggtgggcgtgggcttggtgggcccgcactgggagcggcaggccggccccgccaccccgggcagtgaggggcttagcacctgggccagcagctgctgcactcaatttctcaccaggccttagttgcctccccacggggcagggctcgggacctgcagtgcggccacgcctgagtctccccacacccccaccatgggctcctgtgcagcccgagcctccctgacaagcgctgccccctgctccagggcgcccagtcccatccactgccaaagggctgaggagtgcaggcgtagggcgcgggactggcaggaatctccacctgccgcccggtgcgggacccactgggtgaagccatctgggctcctgagtctggtggggacttggagaatctttatgtctagctaagggattgtaaatgcaccaatcagcactctgtatgtagctcaaggtttgtaaacacaccaatcagcaccctgtgtctatctcagggtttgtgaatgcaccaatcagcactctgtatctagcccaaggtttgtaaatgcaccaatcagcactctgtgtctagctcagggtttgtaaatacaccaatcgacactctgtatctagctaatctagtgtggacatggagaacttttgtgtctagctcaaggattgtaaatgcaccaatcagcacactgtcaaaacagaccaatcagctctctgtaaaacagaccaatcagctctctgtaaaatggaccaatcagcaggatgtgggtggggccagataagagaataaaagcaggctgcctgagccaccagtggcaacctgctggggtccccttccacactgtagaagctttgttttttcactctttgcaataaatcttgctgctgctcactctttgggtccacactgtctttatgagctgtaacactcactgcaaaggtctgcagcttcactccggaagccagcgagaccacaaacccactgggaggaacgaacaactccagacaccctgacttaagagctgtaacactcaccgcgaaggtctgcagcttcactcctgagccagcaagaccacgaacccaccagaaggaggaaactccgaacacatccgaacatcagaaggaacaaactctggacacactgcctttaagaactgtaacactcaccatgagcgtccgcggcttcattcttgaagtcagtgagaccaagagcccaccaattctggacacactatcatacactcttccttcagagaaattaatatccaagactctggggctttagaggataatgaactaggtaaaaacagcttgggaatctgaataactttgtggaacatgctgtgtcccactttacccccaatccacattgtaatgtgatacgaacaagaaataaatatgtaatatataaagccattgagatgtagggattggcctgttaaagtcttcatgctaccatgactaatcacactgtgcgattccatctacaaatggcctacatggttattaattaatcaaacatccaatttacctgaagtagatgtccagactcatttgtactgccagaacagccagaacatgaagtagtcatggtaatagccacaatggtgtttgggcaaccagattttaaaaactgattgacagcaattgaaaagaccacataaagcaagtgtgcccagagaacagcctctctcaattctggggcggattctccccacagatttatcttgtttaatctgtgagatgagtacaattgtatcacggatgagagaactgagatttagtgtacctcacccaagatcatccagcctacatctgtctgcttgagttcagatcctacactcacaaccattgcactcctggagggcaaaaaccagacttctgcatatctttgttctgttttttgtttccctcacacagttctaagcctagagcttagtagtgccagtagtaccagttaatacattctccaaagaagctaacacacttgtttctcagaggaaaaatcaactacattcgcaacatcttttcaagccattcagttacagtgttttataataagttggaacaataggccaggaagggtatttgacaggaggacatagaagagtcaaaggcaggtggcaacaggaatctcaacatgggaggatggggcttgggggcttagagctttagaatataaagaagaattttttttagaaagcagttaccaagaagaagaaaaaaaactcttctgaatgggctcttttgagtgttgattccacaagtatagtacaacatcgtgttgggaccacacagtttaaagtactaacagatttagagaaagacaaacacatgagaaatgtccttgtctataatgtttaaatggtcagggtttaaagggaatgcaagagagagggaaaaaaaaaacactctaagctaacattaaagataaacacttccaaatttcataacaatgagttcacaattcacttttcagtatactgcagacaagaacctgaaaaagagactcctgaattacctagtgacaatttaatgttccaggaagtggagaagattccatcagagtcactgtttccacaggaaaacattgattcggaatgttcattgagtagctaagtcttgtcacaaatatctttagctcctcaaattcagaagagcaagtgaggtaaagggaaaaaaaacaagaaagaaagaaaagctagaaagctcacaggacatgattccatacagaattaataaagttagactgtgcatttgaaagacacgagttcaaattgggaacaggctagcatatgttatatccctatttttaaagcacaaaaaggggagaataatttgaaaatcagactgactaaaatggaaataaaattgcacttttaaaatggatattatcagctgattcgtgccctggaatattaggaaaatcaaccacagcaaccacagtaataataataactctaatttatataaatcgctgctgcttatcttatttgtttttttgttttgttttttatccttctatagactattttcctttattttctgtgtgactctttttgtctttttttgtactttaaatttttttatttttaattgttctgggtacatagtaggtataatatatttatggggtacatgagatgtttacacagagacatgcaatgtgaaataatcacatcatagagaatggagtatccattccctcaagcatttatcacttgtgttacaaacaatccagttacactctcggttatttttaattgtagaaataagttactaactctagtcaccctgttgtgctatcaaatagtaggtcttattcattctttctattttttcctcattaaccatccccctcccccttagcccccttatttgttataacaagaaacttgtaagttaatcagggaaagattattaaaagattaagataaacataagaataaaaaatagaagccaattttgtagatgtaccatggagaaaatggatactgcaggtaaaacaaaaaagtcagcattcctcccatacatttttaacgaggctacagccactaacacagctgctggagggaaatttggcaacatttaactaagtaacaaatgtgcatacattttcaggtagcaattgcacttttatgaatgtatcctacagatatactggcatataccaaatggtttacccaaagtagttcatgaagcattgtttataataaccaaaaagtatgagtaaaaataggaatctggtgagataattcatggtatttcataaaactgagtatcatgtagcccaaaaaagaatgtagaaattctttatatattaatatgtatagcctccaagatatgtcattaagtagaaaaaagacaaaacacaaaaaaatataaagtatgcacatcatgctatcatttatgtgaggaaaataagaagagggagaggatttcatatatatctaaaatatgtctgaaagggaacaaaaagaactggtaatatctatcacctctgaggagaagaattaggctactagattagaagagagattttttgctacatattcttctatagcctttgaattttattcatgtgaatcaataaatacattccctgatcaaaaataaaatgattagaattacaaattttttaagataggcagaatgcattgtaaactagaaacaattgcaaatcaaattgatacctatatatttctgcttccagctatgatagagtaactagtaacagattatctgtctcacagaaaatacttacaaaactaagtaaaatatatgaggcaaccgttttcaaacagtggctaacaagccaatccagaactgaaatccctctgcccacgaatgtccacctctgtgaataaggatattttcctaaacatgacaaaaagagctggagtctgaggcagctggcatggctggcatctataaagcagagtcttagagagtaaagactttaacacagagaagtctcagaagttttgcagagatttgtcccagacatgggacaaatctgtgactgagatcaccaccatacatttgcagagtgagaatactggaggcttaacagagagaaaatgttatcaggttgagagaacagaaatagtggaggtcaagtaatgctggaagaagaatagtactagacatcattgcagttcaggtcctatgggtttgagagagctcataaataaatactactttgacacccctgggatctacctgagaaacagaaagttggtacctctctacaagtaaagactatgtcctaaagtaagtcctatgactccagtaaagtctaaaacaaagcctatcatcaagaaaaacatcctctatcaacactgaatactgccaggttgaataggttgggaaagcacctgggatttctcaaagatttggactaacaaagcctaaaaccatgcttaaacatgttcaacgtgatcagccaattgaacagcatgctaagataacaagcaaaattcttcagaagaaaataacacaatccagaggcatgataacacattgtccaaaatgtccagtatgcaataaaaaatcaccagataaagaaataagatctccattccaagatggccaaataggaacaactccagtctgcacctcccagcgtcatcgatgcagaagatgggtgatttctgcatttccaactgaggtacttggttcatctcattgggactgattggacagtgggtgcagcccatggagcgggagccagcgcagggtggggcatcgcctcacctgggaagtgcaaggggttgggggatttcccttttctagcaaagggaagccatgacaaacaggacactcccgcccaaatactgcgcttttcccactgtcttagcaaccagcagaccaggagattctctcctgtgcctggcttagcaggtcccacacccatggagacttgctcattgctagcagagcaatctgagattgacctgcgaggcagcagcctggtggggggaggggtgttcaccattgctgaggcttaagtaggtaaacaaagtggccaggaagctggaactgggcagagcccaccacagctcagcaaagcctactgcctctatagactccacctctgtgggcagggcatagctgaacaaaaggcagcagaagcttctgcagacttaaacatccctgtctgacagctctgaagagagcagtggttctcccagcatggcgtttgagctttgagaacggacagactgcctcctcaagtgggtccctgacccccacatagcttaactgggagacacctcccagtaggggctgacagacatctcacacaggcaggtgcccctctagcacgaagcttatggaggaaggatcaggcagcaatatttgctgttctgcagcctccactggtgatacccaggcaaataggatctggagtggacctccagcaaaatccaacagacctgcagctgagggacctgactgttaggaggaaaactaacaaacagaaaggaatagcatcaacatcaacaaaaaggacatccacaccaaaaccccatctgtaggtcaccaacatgaaagaccaaaggttgataaaaccaaaaagatggagagaaaccagtgcagaaaatttaaaaattctaaaaaccagagtgcctcttctcttccaaaggatcacagctcctcacgagctatggaacaaagctggacggagaatgactttgacaagttgacagaagtaggcttcagaaggatggtaataacaaacttctccaagctaaaggggcatgttctaacccattgaaggaagctgaaaatctttaaaaaatgttggacgaatggcaaattagaataaacagtgtagagaagactttaaatgacctgatggagctgaaaaccacggcacgagaacttcgtgatgcatgcacaagcttcaatagcctgttagatcaagtcgaagaaaggatatcactgactgaagatcaaatgaatgaaataaagcaagaagacaagtttagagaaaaaagagtaaaaagaaacaaacaaagcctccaagaaatatgggactatgtgaaaagaccaaatctacgtctgattgatgtacctgaaagtgacggggagaatggaaccaagttggaaaacactctggaggatattatccacaagaacttccccaaactagcaaggcaggccaacattcaaattcaggaaatacagagaacatcacaaagatactcctcaagaagagcaaccccaagacacataattttcagattcaccaaggttgaaatgaaggaaaaaatgttaagggcagccagagagaaaggtcgggttgtccacaaagggaagcccatcagacaaacagcagctctctcagcagaaaccttataagacagaaaagagtgggggccaatattcgacattcttaaagaaaaaaattttcaacccagaatttcatatccagccaaactaagctttgtaagtgaaggagaaataaaatcctttacagacaagcaaatgctgagagattttgtcaccacaaggcctgccctaaaagagctcctgagggaagcactaaacatggaaaggaacaactggtaccagccactgcaaaaacatgccaaattgtaaagaccatcgacaccatgaagaaactgcatcaactaatgggcaaaataaccagctaacatcataatgacaggatcaaattcacacataacaatattaaccttaaatgtaaatgggctaaatgctccaattaaaagacacagactggcaaattggataaagagtcaagactcatcagtgtgctgtattcaggagacccatctcacatgcagagaaacatataggttcaaaataaagggatgtaagaagatctaccaagcaaatggaaagcaaaaagaagcaggggttgcaatcctggtctctgacaaaacagactttaagccaacaaagatcagaagagacaaagaaaggcattacataatggtaaagagataattcaacaagaagatctaactaacctaaatatatatgtacccaatacaggagcatccagattcataaagcaagtccttagagacctaaaaagagacttagattcccacataataataatgggacactttaacaccccattgtcaatattagaccgatcaaccagagagaaggttaacaaggaaatccaggacttgaactcagctccgcaacaagcgggcctaatagacatctacagaactctccaccccaaatctacagaatatacattcttctcaggaccacatcacacttattctaaaattgaccacataattggaagtaaagcactactcagcaaatgtaaaagaacagaaattacaaaaaactgtctctcagaccacaatgcaatcaaattagaactcaggattaagaaactcactcaaaactgctcaactaaatggaaactgaacaacctactcctgaatgactactgggtacataatgaaatgaaggcaaaaataaagatgttctttgaaaccaacgagaacaaagacacaacataccagaatctctgggacacatttaaagcactgtgtagagggaaatttatagcactaaatgcacacaagagaaagcaggaaagatctaaaatcgacaccttaacatcacaattaaaagaactagagaagcaagagcaaacaaattcaaaagctagcagaagacaagaaataactaagatcagaggagaactgaaggagatagagacacacaaaaaacccttcaaaaaatcaatgaatccagaagttggttttttgaaaagatcaaaaaaatagactgctagcaagactaataaaaaagagagaagaatcaaatagatgcaataaaaaatgataaaggtgatatcaccactgatccacagaaatacaaactaccatcagagaatactataaacacctctacacaaataaactagaaaatctagaagaaatggataaattcctggacacatacaccctcccaagaataaaccaggaagaagttgaattcctgaatagatcaataacaggctctgaaattaaggcaataattaatagcctaccaaccaaaaaaagtccaggacccgatggattcacagctgaattctaccagaggtacaaagaggagctggtaacattccttctgaaactaatccaatcaaaagaaaaagagggaatcctccctaactcattttatgagcatcattctgataccaaagcctggcagagacacaacaaaaaaagagaattttagaccattatccctgatgaacatcgatgagaaaatcctcaataaaatactggcaaactgaaaccagcagcacatcaaaaagtttatctgccacaatcaagtcagcttcatcccagggatgcaaggctggttcaacatgctcaaatcaataaacctaatccatcacgtcaacagaaccaatgacaaaaaccacatgattatctcaatagatgcagaaaaggccttcaacaaaattcgatagcccttcatgctaaaaactctcaataaactacataatgatggaatgtatctccaaatagtaagagcaatttttgacaaacccacagccaatatcatactgaatgggcaaaaactagaagcattccctttgaaaaccagcacaagacaaggatgccctctctcaccacccctatgcaacttagtgttggaagttctggctggggcaatcaggcaagagaaagaaataaagggaattcaattagcaaaagaggaagtcaaactgtccctgtttgcagatgacatgattgtatatttagaaaaccccatcatctcagcccaaaatctccttaagctgataagcaacttcagcgaagtctcaggatacaaaatcaatgtgcaaaaatcacaagcattctgatatacaaataacagacaaatagagagccaaatcatgagtgaactctcattcacaattgctacaaagagaataaaatacctaggaatccaacttacaagggatgtgaaggacctcttcaagaagaactacaaaccattgctcaacgaaataaaagaggacacaaacaaatggaagaacgttccatgcttatggatgggaagaatcaatattgtgaaaacggccacactgcccaaggtaatttatagattcaatgccatccccatcaagccaccaatgactttcttcacagaaatggaaaaaactactttaaagttcatatggaaccaaaaaagagcccacgttgccaagacaatcctaagccaacagaagaaagctggaagcatcacgctacctgacttcaaactatactacaaggctacagtaaccaaaacagcatggtactggtaccaaaacagagatatagaccaagaaatagaacagaggcctcagaaataacaccacacatctacaaccatctggtctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacataaaaccataaaaaccctagaagaaacctaggcaataccattcaggacacaggcatgggcaaggacttcatgactaaaacaccaaaaagcaatggcaacaaaagccaacatagacaaatagtatctaatcaaactaaagagcttcggcatggcaaaagaaactaccatcagagtgaacaggcaacctacagaatgggagaaaatttttgcaatctacccatctgataaagtgctagtatccagaatctacaaagaacttaaacaagtttacaagaaaaaaacaaacaaccccatcaaaaagtgggcgaaggatatgaacagacacttctcaaaagaagacatttatgcagccaacagacacatgaaaaaatgctcatcatcactggtcatcagagaaatgcaaatcaaaaccacagtgagatatcatctcacaccagttagaatggcaattattaaaaagtcaggaaacaacagatgctggagaggatgtggagaaataggaatgcctttacacttggtgggagtgtaaattagttcaaccattgtggaagacagtgtggcgtttcctcaaggatctggaactagaaataccatttgacccagccatcccattactgggtatatacccaaaggattataaatcattctactataaagacatgcacacgtatgtctattgcggcactattcacaatagcaaagacttggaaccaacccaaatgtccatcattgataggctggattaagaaaatgtggcacatatataccatggaatactatgtagccatgaaaaaggatgagttcatgtccttttcagggacatggatgaagctggaaaccatcattctcagcaaactatcacaatgacagaaaaccaaataccacatgttctcactcataggtgggaattgaacaatgagaacacttggacacagggtggcgaacatcacacaccagggcctgttggggggtgtggggggtgggggatggatagcattaggagagatacctaatgtaaatgatgagttgatgggtgaagcaaaccaacatggcacatgtatacatatgtaacaaacctgcacgctgtgcgcatgtaccctagaacttaaagcataatttaaaaaaatgaaaatatgatacataggcaagcaaaaaagcagtaaatacaaacaaatctcaaaattacccagatatgtccaaacaaagaatctaaagcagcttttgtaaatatgttaaagaattttaaatatatatgtccaaagaatgacaggaaatatgatctcaaggagtgaatagaggagtctaggcagagaaaataaccaaatgaaaattctagaactaaaaaaaaataaaaatgaacaatttagtggacaggtctgaatagctgattagagatggcagaagaaaagagaacctaaaacagatcagtagaaattatttaatcttagaaaggaagagtggggaaaataatcaggaagatgaactaagatttaggaataggtaggacaataccaaatagtcttaacgtaaatgtaattggaatcctagaaagaaaagcgagtgagaatgggccagaaaaaaatatttgaaggaataacagctgaaaacttttcaaaacgatcaaacagatccaagaagtttagcaaaccccaagaagaataaatataaagaaaaccacacccaggcacattgtagtaaaactgcagcacatccaagataaagaggaaatattaagggcatccagaggaaagacacacattacgtacagttgaacaaggataagaatgatcatgggcttatgagaaacagtggggactgaaaaccccaatggcatggaatttttaaatcgctgaaaggaaaaacgaaaacaaagctgttaactcagaactctacaaccaacaaaaatattcttcaaaaatgggaagaaaataaaggcactttcagataaataaaagctgagaaaattaatcaccagcagacctacactataagaaatacaaaaagttgaagataactgataccagatggaaattcagatctacagtaagaaagaaaaagagcactggaaatgttaagtaaattactaaatataaagtagtatgttttctttcttagaatttccttaaagactactatttaaggcaaaagtgaaaacactctaaggttggggttatgacatgttaaaataatgaatatgacaataaccatacaaagaaagggagatgaggccaggtgttgtggctcatgcctgtgatcccagcactttgggaggcagagcagggaggatcatttgagcccaggagtttgagaccagcctgggcaatatagtgagacttcatgtctactaaaaataaaaataaaaaattaactaggtgtggtggcacatgactgagtcccagctactcaggaggccgaggcaggaggactgcttgagccccagagtttgaggctacagtaagccatgattgtgccattgcactccagcctgggtgagagcaagaccctgtctcaaaaaaataaaaagaaaataaaagaaagaggatgactaaattgaaataaaatgttgtaagtttactacatttgtcaaatgttaagtgtgaaatgtggagaggtacaatactgagtatgaatagattctaatgcataggggctgcatatttttagcccttgagcaatcaagaaaattaaattaaaaaggaagataaatgataaacagagagataagggggtataactaaaagccaatagaaaaaataaaatggcacactaaaaaatattcaaatgctctgaaaagagcaggaaagaaacaacagaggaacaaaaaacagaagagataatgagaaaaaaaaaaagtttgatacctggtgtttagtggaattcactcaataaattcattcatgcaatgagaggctactatactgatgcctgaaggtatgtaaatgttcataagccttgcctcctactctcaaaaaccttacaattatacatgcgactatgcaacaaaatggcatatgaaaaatacaaataaaattatagttatcactgaggacttcctatatactgaaaatcctactaaatgcttcacaaatagtatttacttctcacgatgatataaagaattttcataatgtaggtatccttggccccactttgtagataaagttggatgtaagcttcatgacagcacaaaccataaatattatttaccattgtgttaccaatgccttacaatttgcacacatctaatacaagcttagtaagaagctataaaaagaataagtgaatggcaaaggatataataatctactcaaagtcatgctgagaaccagaatttggaaccagacagacttcggtccaaagtccttgatactaacagttaggatcccaaaaggcaataacttgggtgacaatacatccagtttacacaggatagttccagtttatgattattgtcccaatgtgactactaatagttctcccattcattcaccctcaaaaaatgccaaatttgtatgataaatgttatggtttctctagctataagatttcagaggagattcttcctatccatgagcatggaatgtttttccatttgtttatgtcatctctgatttctttcagcagtgttttgtaattctcattggagagctctttcacttcactggttagctatatttctagatatgttattttttgtggctattgtgaataggattatgctcttgatttggcactcagcttggacattatcggtgtagagaaatgctactgatttttgtatccagaaactttgctgaagttatctaggagcttttgggcaaaactatggggttttctaggtagtttgacagaggtagtttgattttctctcttcctatttggatgcctcttatttctttctcttcccttattgctctggctaggacttccaatactatgttaaataggagcagtgagagtgggcatccttgtcttgttccagttctcaagaggaatactcccagcttttgcccattcagtgtgatgttggctgtgggttttgttgtggatggcttactattttgaggtatgtccttcaatgcctagttttttgaaggtttttaacatgaaggttgctgaattttatcaaaagccttttctgcatctattgagatgatcatgtgttttttgtttttattccgttcatgtggtgaatcacatttattgatttgcatatgttgaaatcagtcttgcatcctagggataaagcctgctcaatggtggtggattagtttttttttttttgtttttttttttaaacaattttataactttatttggtatatttgatgattagcagttagttcacattcacaccgactgtagatttttttaaagtggtaacaggtacgtaggcaaccaaagtatagagcttgtttggtaaatctttatcttcattacattttctggacaaccgaacatggatacagtatgagacgttgcttattcctttggcccagacagctttgttgagcctggtatcaaagtgtgcatctggagttcccatctccttcagggcaagtttccggagctctttgagtgcctgaggggcacgcttcttgaagcccactccatgaatgcacttatgaatgttgatgggatattctcgggtcaccatctcgttgatggcgaatgacccttcttcttctcatcacccttctttgcaggagccattctgccgggcccaagttggaaaggaaactggccactattcttacatcataatcagtagtaaagctagtctcatcttccactacttcccctcttcctccctctactccagccccttggccttgcttctttccctgagggcctcgaccctagctttcccttctgcctcgcatgccattcccccagatatccttctgcttgactaatttccttgtctcctgcaagttcttagctcaaacctttcttttttgtttgtgttttgtttttttttgtttgttttttttttttattgatcattcttgggtgtttctcgcagagggggatttggcagggtcataggacaatagtggagggaaggtcagcagataaacaagtgaacaaaggtctctggttttcctaggcagaggtccctgcggccttccgcagtgtttgcgtccctgggtacttgagattagggagtggtgatgactcttaacgagcatgccgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacagcaaccatccgatttctcaatcttttccccacctttcccccctttctattccacaaaaccgccattgtcatcatggcccgttctcaatgagctgttgggtacacctcccagatggggtggtggccgggcagaggggctcctcacttcccagtaggggcggccgggcagaggcacccctccctcccggatggggtggctggccgggcggggggctgacccccccacctccctcccagacagggtggctgctgggcggagacgctcctcacttcccagacggggtggctgccaggcggaggggctcctcacttctcagacggggcagctgccgggcggaggggctcctcacttctcagacggggcggttgccaggcagagggtctcctcacttctcagatggggcggccgggcagagacgctcctcacctcccagacgggttcgcggccgggtagaggcgctcctcacatcccagacggggcggcggggcagaggctctccccacatctcagacgatgggcggccgggcagagacgctcctcacttcctagatgggatggaggtcgggaagaggcgctcctcacttcctagatgggatggcggccgggcagagacgctcctcactttccagagtgggcagccaggcagaggggctcctcacgtcccagacgatgggcggccaggcagagacgctcctcacttcccagacggggtggcagccgggcagaggctgcaatctcgacactttgggaggccaaggcaggcggctgggaggtggaggttgtagcgagccgagatcacaccgctgcactccagcctgggcaccactgagcactgagtgaaccagactccatctgcaatcccagcacctcgggaggccgaggctggcagatcactcgcggttaggagctggagaccagcccggccaacacagcgaaaccccgtctccaccaaaaaaatacgaaaacctgtcaggtgtggcggcgcaggcctgcaatcgcaggcactcgcaggctgaggcaggagaatcaggcagggaggttgcagtgagccgaggtggcagcagtacagtccagcttcagctcggcatcagagggagaccgtggaaagagagggagacggagaccgtggggagaaggagagggagagggagagggagaggggattagttttttttatgtgctgctggattcagtttgctagtattttgttaaggatttttgcatctatgttcatcaaggatattggtctgaagtttttacgttgttgttatgtctttgctttgtctttgccaggatgatgctggcctcatagaatgagttagggaagagttcctcctcctcaattttttggaatagtttcagtaggaatggtaccagctctactttatatgtctggtagaattttgctgtgaatctgtgtggtccaaggctttttctggctggtagcctttttattactgattcaattttggaacttgctattggtctgatcagggtttaaatttcttcctggttcagtctcgagaggttgaatgttttcaggaatttatcaatttacatatgcaatgctattcctgtcaaatgaacaatgatattctttacagaactagaaaaaactattctaaaattcatatgcaacccaaaaagagcccaaatggccaaagcaattctaagcaaaaaagaataaagctggaggaatcacatcacttaacttcaaactatacttcaatgctacagtaaccaagacagcatggtataggtacaaaaatagatacatagaccactggaacagaatagggagcccagatataaacccacacacttacaaccatctgatcttcaacaaagttgacaaaaacaagcaatggggaaaggactccctattcgataaatggttctgggacaactggctaatcatatgccaaagactgaaactggacagcttccttagatcatatacaaaaatcaactcaagatggattagacacttaaatgtaaaatgtaaaattataaaaaccattgaagaaaacctaggaaataccattctaaacataggccctggcaaagattttatgatgaatatgccaaaagcaattgcaacaaaaacaaaaattgacaagtgggacctaattaaactaaagagcttctgcacagcaaaggaaactatcaacaaagtaaatagacaacctacaggatgggagaaaatatttacaaattgtgcatctggcaaaggtttaatatccagaatctataaggaacttagacaaattgacaagcaaaaaaacaaacaagcccattaaaaagtgggcaaagacacttttcaaaataagacatttacacggccaacaagcatatgaaaaaatactcatcatcactaatcattagggaaatgcaaatcaaaaccacaatgagatatcatctcacaccagtcagaatggctattattaagaagtcaaaaagtaacagttgttggtgatactgcaaagaaaagggaatatttatacactgctagtgggaatgtaaattagtccagccactgtggaaagcagtttggcaatttctcgaagaacttaaaacagaaccaccatttgacccagcagtcctattattgggtatgtacccaaaggaatataaatcattctaccataatgatacacacatgcatatgttcattgcagctctattcacaataacaaagacaaggtatcaaccaaaatggtcaacaacattagactgaataaagaaaatgtggtacatatacattatggaatactatgcaaccataaaaaagaatgagatcatgtcctttgcagcaacatgtatgcggctggaggccattatcctaagagaactaacacaggaacagaaaaccaaatactgcatgttctcatttataattgggagctaaacattgagttacatggacacaacgaagagaaggacagacagcggggcctatttgagggtggagggtaggaggaaggtgatgatcagaagactacatattgggtactatgctcattacctgggtgacgaaataatatgtacaccaaacccccaaaacacaccatttatctattagagcaaacttaaacatgtgcccctgaaactaatatttaaaaaaaaaagatttcagaggagaaagctctctttgattgacatgatcaggaatcttcatttaagagatgacacttgaattcagctttttaaaaaataaataggatttgctatgcagacaagaggttaaggcttaaaaattgaaaagagttctgtaactttaagaaaacatgacatgaatttataaatggttgtaagattcggcactgtaagaaatctttaaataaaaattattgttcacagactttcataagtgatggggattgaaagctttctaaattatcagaaaccaaaggctgataacaaagactactgtgtaacacatctcactgggctgaggggaagacaccagaacatgtctcttttttttttaatatttgtgtgttttaaaaggcagagtcagtagcatgaattgtatagattactctaattttaaaggcaaaagtaagaaagatttaatggatttaaatggacacaaaaagaggtaacattaaccaaagtggttttcaattagtcggacacaacttagttttacttgttaaatacaatttgtaattcagatattatgcagaaaacaaagctcataggcatcctaatggtttttagttgtagaatctgaatccattcctaaatctctctgattccatctctcactcaaacctccagatttcaatgcaccaacaatgatgagtttgaatggaaaaaatcaaggtacaaaaagaaaggccagggctttcctctctctcccttgctctcagggatgggtctgtatgtcaaattaagagtattgaaccctgcaaagaaaatgctgatggagatacagaaatgaaaaagggagttagagattaactgcttggaaaaaataatgatttataaatatgttcagagtatactttgtcaagagcactgacttatggcatgaaattaaagggaagtaaacatgggtcaagaaactggaaggacaattatgagatgtgtttgccattagcctgtaaacttctataacagaattgttgtctaagagatacaaaagtagttcctttatgtctgcaatgtaaaaccgaacttgaaaaactatctaagaatattcagtacagatggttccttttgaatgatgggaattactagaacaatgtgttatgcatttttcaactctgattactaaatctctatcctgaatttctttggcacaaaaagcattttaaatcaaacaactagagcatatatttaaattgtttaaatcttccctttttctaaagtacctgcttgatagacacaacttaacatataacttaaatgtttaaatttccagagaatctttaagatgttttagaaagttcacagcttttcatttgtttggcttttttatttttactcctaacaaaaagtttaggtttacatttggaagctttatgacaattggtgttagttatgaagatgattgtctcttgactctctttgcttagaagtctatggagcatgtagctttcaagatttttttttgaaactgaagcccaatattttatttctaattggggaatacctctttctatttgcaacttgaataaatgagagaattatttaggacgtgaagattaatgaagattcaagaagatgaatgtctcttgactctctttgcttagaagtctatggagtatgtagctttcaagatttttttttagaaattaaagtccaatattttattgcaaattgggaaatacctctttctatttgcaacctgaataaatgagagaatcatttaggacaagttgagtgttcttccattgcagactttcttaagctaacatttattaaacagaacaaaaaagacagatctttaatttttcagagcctccagggctggtttataggtttcaggacaattcagctaagaagcctaccaaggctagtagggaaaaggaacacagcagaaatgattgctatgtaaacaaaagttcagagtagataatgaaactctggagaagcctgccagagaagcttttcaggtagcatttctttaggtaggcaaattcatctgaatttatcaaagtgctgaatattgataatttgtgaattagttttctggttctgctgttaaaaaatcttttggggaatgacaacaatcatccattgatcccaagtagtaccaatttattaggaacaagaaatgtggccatattatttgttctgaaattactaatagtgtcttatatgaaaccaatagcccagaaacaaagtcaaaaatcagttagactgtacagcaagtttctaatattaatcctcaataaagatttttagaaatccaccagctttcatttatttccctgagctctcctttgaatgttttcaagacattcaaattttctcctacacaaaatcctatgctttcaatacaagagcactgtatttgtatttaaaaattaatagtaagccaaaacaactcatgatgtgttccaagtagagttcaaagtagattaagatcaagaattcatttaatctagcttgagcttcaaacagaaaatactcatcccttccacaccctttagaattgaagtatgattgcccactgcctaagctacttgcaggtggcaaccattattcatacatgtttagaagcagtaggagtcttctcaggccactaggatgcattcggttcactgaagcatactgaacactacccacagaacttatgctgtttttagaagcatgaaattaggctcaatgaagtaatgggctaaataacgggaaaattcagcactgtttttaagtgctgatatttgacacttttctgcaaggaatctctgctaattatccctttacctaaagggagcaggcaactggcagaaaaaatattatgaacattgtacagagaatagactatagtcatgttttaaaaacaaaattcataggtttggagctagaggtcttgagttcacacatattctgactcgaccactctagatgtgtgacctcaacacaatcactttttctcccccacacaatcactttttctcccccacatcatttcctcatcttcaacagaatatctactctatctggttgttgtgatagttgaacatatgtgaacctatttcaaactgttgcttggctctttggaaggtactcaataaacactggttgggcacaagctttggaatcagacaaatctaagtttaaatcccaattccatttattaactggttgttttgggcaggctatttgaccggtctctaagtctaagtttattcatctgtaaggtacaatgaaattactacccttcaggctcactatgaggatgagacaatatataatgtactgagcaaagtgccttatacaaagtattaaataaataaagcctattgtttcacatttgactctacagcacaagaaaagctaagtggccagcttgtggtttcattgaaagttagtggtgggtatcctctcctatctttggactccaaggttctctctgtttcccaataacctactggtagacttttccactgcaatttgcatggcaggccttgaatagtcttaatacacttgggctttgtcttattttactttatgtttatattaataccctttctttgaacataaattcagaaagaatatgtaaattgaggatattctttagatctttgaatccattatggaaattcagttgccagtgcttccatggtgaaagtctttctttctagcttcagaagcatccagataaacaaattaataaaagcttatgtttccatatcaatcctgctgtagacattttatgtctggccatagaagctatgatgaatttttatttctactttccttcattagaacaacttttgcaaaagaagactgactttgtcttaaggaaaaaagtcataaaccagcctcattaagaagccatctcttttgtgattgacagcaggcaaatgcaggacagtgggcactatctgagaatggagtgaagtgacccttggtgagggctggaatatgccctataaatttaacagattttaaaaagcctttagatagcattcgtctgttctgacatgtcagataattcatagtggagagaaatcattttaatgcaattattacgggaaagccattaaccaaatgctaaccatgttctgcattagggaatttacacttgcaagtaataatagggatcaaacaagggagggagagtaaaactagagcacacagatgagaaagaagcagggagaagtacttggaaatgcctttcctgttaacctcatgtaaaagagcagctctcctatcttcaccatctaaacccttactctgctttattcttctgtgtggtactattaccacttgatatttatatttttagctaatttattttttgtatgcttccccctttaaaatgtaagctctatgagggtagaatattgtgtgtattttgttcattgactgtaccccttgtgtctagtactgagcctggcatatacatgcttcaatacgtgtgttcatcaacagaagagaggccattacctgagtaacccaagtcagtctacacagacctggaaattaggacgtctattcagggccttgaaagatgtcagaaaaaatgagcaattttttttttgacagtcattactttctcataattgtagaggttgaagaatggttaaaagtgagaagaggaaataaacatattaataggaggaaggtgcttgattgtactcctgacaaaagaaacatgaattaaaattaaaacaaagtagcattttttttcctatgagattagcacctgtgttggtagggtggtaagaaaagcagtcattcccagacaatcttctggaaaggaagattggtaaatttggtaactgcttttatctaataattctacccttaagattttgtcctacggatatacttgcacaagcatgcactgttggagataggaaaaggttgagacaacctaaatgtccaccaggaaggaactggctatgtacatgatatgacatataagtagaacaccgtgtggcctttaaaaagaacaatgcgtccccgatacaatatttcacctctccagaagttcccagttgataaccaccaaacatttgtttaaattcccaaaataccttatggcttaattagggaccattgttttcacaccaatatcaaagctcttataactgcggaaatacatgttttttacaggataatagacatcccagaaaattgatacaaatggactgtggataatgaatataaacttcattccatccttaataattttaaatttagcttgatattcattctagatccacctcaagatatatcttctccatgaagctatcctcctacacctcagtgagtactgcatgacaagcacccacaatgactcagtctctggaagtcatataggaacaattcattctatcccaaatggcatcagagttttgtattgtcaggtaaattgatgcctaagaattgttggaaattatctgctatatgaaaccttctttcatccataagttaaataagaaatatggccacaacatccatgtagatgtttgagtgagaaactgagacatcatatcaaattgctttctttcttttccctaacatttcttcagcaaatcctgtccattctactttcaaaataaatctcaattccacccacctctctccatctccactgttgccagttgagccccggccatgcagtctctcacctacaagagtgcccaactgttttctctgctttcactcatcttcccactctctgtcttccatccatcctgggtgcaattttaaaagtaaagtattatctttttattccccagcttaaaacccttcaaaggctttccattgtttaaaaaaaaaaacaaaaaaaaaaaaccctaaactgcataacttggcctgaaagttccagtgacctatcctatctctctccaactctctaacttcaacccatggtactttctccctccttcacttcactacagcattgatgatctgtgagtttctaaatgtgccaagctctttcctacttcagagtctttgcgaggtaacagccagagcccagttagcagcaagctaacgacaaaaacgtcttagtgggggatgagtgagaggtactaattctatacttatgcatccaaaacaatactcttgtcatttttgactagtttgataatgatgatttcttatccaaaacctacacccttccttctatattcattcaacaaatacctattacatttatgtttggagaactttccttgttactttagaatacaaaaaaaataaacacaaaccctgttttcaaggagtttacagtccatcaggcaacacaagatttcttcgtgtgtaattaaactaagccaacatgaatcaagtaaacaggaaaagtataagataggctgtgaaatttcagaaacataaacaatcctggtatgataggtgaaggatcgtggaggaagtctatttgaggttcatttgaagaactgatagaatttctaaagacacaggagagatagggcgtagaaaagggtattacaggcagaggaagcaaaagatagatattgaaatgcatatatattgaaaaatgcacaatgtgtttagaaatagtgagtaaagagaaggttggatttgagacaaaatatgaaagcccacaaatagcagactaataataatagcataaattcattgactgtttactatgtgcaggataatcatttaattattacaacaaccctataaggcagcactatgattatccccatttttcaccgaggcaactaaagcacaaaggagttgaataatttttccaaggttacaaaactaggaagtagtgggaccaggatcaaaatcctggcagtctagcttcagagtacatgttaaacatgtaggaaattaaccattatcacatagaaatcaagattcattgaagatctttgagcaagaatgtggcataattggacctttgatgacttattctggttgcgatgtaaagaatatcctagagaagaaacaactaaagccaggaaaagcatctttatggaaccaaaaaagagcctgtatagccaagacaatcctaagcaaaaagaacaaactggaggcatcacgctacctgacttcaaactatactacaaggctacagtaaccaaaatagcacggtactggcaccaaaacagatatatagaccaatggaacagaacagaggctcagaaataacaccacacatctacaaccatctgatctttgacaaacctgacaaaaacaagcaatggggaaaggattccctatttaataaatggtgttgggaaaactggctagccataagcagaaaactgaaactggaccccttccttaccccttatcaaaaattaattcaaaatggattgaagacctacacgtaagacctaaaaccataaaaagcctagaagaaaacctaggcaataccattgaggatataggcatgggcaaagatttcatgactaaaacaccaaaagcaatggcaacaaaagccaaaatagacaaatgggatctaattaaactaaagagcttctgcacagcaaaagaaactatcatcagagtgaacaggcaccctacagagtgggagaaaatttttgcaatctatccatctgacaaaggactaatattcagaatctacaaggaacttaaacaaatttacaagaaagaaaccaaacaaccccatcaaaaagagggtgaagaatatgaacagacacttctcaaaagaagacatttatgccccctgcaaacgtatgaaaaaaaagctcatcatcactggtcattagagaaacgcaaatcaaaaccacaatgagataccatctcatgccaattagaatagcaatcattaaaaagtcaggaaacagcagatgctggagaggatgtggagaaataggaatgcttttacactgttggtgggagtgtaaattagttcaatcattgtggaagacagtgtggtgatccctcaaggatctagaaccagatacaccatttgacccagcattcctattactgggtatatacccaaaggactataaatcatgctgctataaagacacatgcacgcgtatgtttattgtggcactgttcacaatagcaaagacttggaaccaacccaaatgcccatcaatgatagactggataaagaaaatgtggcacatatataccatggaatactatgcggtcataaaaaaggatgagttcatgtccttttcagggacacggatgaagctggacaccatcattctcaacaaactaacataagaacagaaaaccaaacaccacgtgttttcactcataagtgggagttgaacgatgagaacacatggacacagggaggggaccatcacacaccagggcctgtcagggggtggggggactaggggagggatagaggaaatacctaatgtagatgacggttgataggtgcagcaaaccaccacaacacgtgtatacctatgtaacaaacctgcacgttctgcacatgtatcccagaaattaaagtataataataaaataataaataaatagccaatacaatattaaaggccaaaagtaagggtttagataagcactataaaagtgggaatgtaaagcaaagcctgggtaacagtagaaatcagagaacattgaaatggttggctatgagagaagaatcagcaaacaactcattcttaggtctcaagtttgggtggatagaaaaatggttgcatcattaatgtaaatatttcaaattaaacatttatttgaaagaaaatataggtggaattttgttttaaattatacggaatttctattaatgttgaagcttttgtggggcagatggtagagctttccagaaacagtagatctgaacataggaaagaggcctgacttgaaggttagggttggggtgtcatccctgcagacatggtgcaacttaatatccactctcaggacatcagaaagaggaccacggaagaaacagaaaataaaacagaaagatacgagcaaatagacagttgagtgtgatagacattaagaaagagcccattcaaaataaaggggaattttaatggtttcaagtgttatcaagaggtgaagaaaaatgaaaactgagaaattgactttttaataatttggagactgagagaagaaaccaggtaataaagatttccagacctcagtgtatgaagaaaaggtgtagatagtggtcataggtcattcaagaagtttggaggtaaaaagaaaagtgaacgttaaggtattcaactagtaaagtcaagcaaaatttttgtttattgagctgtttcaaggatggagattctaatgatgtctgcaaacaaagaaagaggtaaatggacaatgagagattaaaagttaaaaagttgcttaggcaatatttaagaagaagagaaagcacacttaaatgaggaggttctttttccccagggtagagaaaagaatgctgatgtagaagaatttgaggagtgaaattgagcggcttatgtcagatgaacttaacattctcaaaaaaacaaggttcatttgcccagagtaagacagtgggtgacaccacaggtaatgcgataaagaatccaagaagtaaacaaagcaagtaataataagaactagctaaaattaggcagtatgaacagagggaaccaagtaaaacagtgatgctactttctccagcaaaattagcattgccatctcagagagctgagaaagtagacatgacagttagctggctgtcatacccccagctacacactcagcattcaattactcacaaaatatttactcaacatccactgggtgctagaatcatgaaaacaatggctacacatcaatgtggacagctttggtccaaaacatggcatatcccacctcacccaccctacccacccactcacccaaagccatgctttcattacttgtgattactgataactcttggtgaccaactcataattaggtatgtgttaggactctggtagctcaggaaataggtcctccatgttataaacaccccaggaaatttagaaaagtatttggtgaaaagcgccttcatttaaggatcctagaacttcaaatgtggtttcttaataaatggtgatatttcaaagttgacattatggcttcacccattctgtccttacttctgttaaactcaaagctggtcccttcacctctaacagcatgctgtttttttcttatgcagttacttcacacaagcccctgccagtgatttcaccagggctatgtcctgccatacattcattgtttgcatccattcttctgttcatcaagcattcactgagtgcctatgctatgccaggcagtgggctctgtggttacaaaaacacagtccttattcccaaagatattatagtaccagtagaggaggaagagtagaagagtcacggtaaaatacagattaagtacagtggttaaaaataaaggagagagatcagcattgcttaaggggatcagacaaagtttcatagaggaggaggctctttgattgttgtttgaaggacaaggaaccattttccagatgggcgaggtatgtgtgggagaacactttggcagaaggaataacatgtaaaaaggcactggggtgtgaaacagcagactggatagacaattgcaagcagtccaggaggggaagggtggggatgtggaagagtggtcagggagagggcaggcaggtaagaaagaaatgtcaaccaggggaggacctgctactgacaagccgttctggggggtctgactttcttcctgtggcacagaggttattaatgctttggagtcatggctctttcaaaatctatgatgctatcaatcctctactcagaaaaaaaaaaaaaaaatcaccgaaatggtgtctacaaacactctgaagttcagaaattgcttggacttcaggttaaaatcttgttataggcaaagggctcatttttagttgataaaaatagctggaagtatgtatacacaacaagcagggcgtaacgtgatccaatttgtgttttagaacaacaattcagccaactttgttgtgaatggattagaagcaagtgagaccaatggtagaatgagcaattaagacattatgacgaccatctggtcaggagatgatgaaagaaactgccaagaaatgtttgaaaaagataagaatgattcaagctatcagatgtttaactgcattacagtaattaaaacaatgttatgctgtccaacaaaaagagaaatcaatgaattatattaaaaaactagatccaaaattttatattatgttttttcaaggtaaaacttaaaaagcaaaggatagattattcaacaaatcattattccactggcaagtggaaaactatctgagaaaaatataaagttaaattcttgcactcctatacaacaaaataaattccagatggattaagatttgcatgtaaaataaagaaactggaagaaaatgtaggaaaagtgtgtgtgatcttgggatgatgaagtcatttctaaactaactccaaaggcagaaactttaaaaggaaaacatcaaagactcaaccactgcccaggggctggggaagggggaaatggggatttgctattcagagggtataaagttccagttatgtaaaatgattaagtcctagagatttgctgggcaacattatgcccatagttaataatactgtattatagacataaacacattttaaagggcaagtctcatgttaaatgttcttaccacaattaaaaaagactcaatcacatgcacaaaaacttctcatgtaaaaatatacccaagggaaaaagtcaaaaagtgactaagaaacttggaaaaaaatatttacattataaacaacctatagacacatggattactatctgtactatataaaaattgtcagtaaaattaattggaaaataagcatctcaaaagaaaaataagtaaggaacattgataggcaatttgcaaaggataaaactacccaacctcactagtgacttaacaaacacagaaaaaccacagtgaaatgccattttccccatatcagattggcaacatttttagaaaacaacactacttaagatacgggaaaatgtgccctctcatgcactgctggtaggagaataaactgaaggggaaaaaaactttctggagagcaatttggccaaaaaaatcaaacctttatgaataactatactccttaacatacaagctctgcatcctaaggaaataatcctgatttaactaccaggagatacacaataatttttacagtagcaaaatattttaaatttcattggctaagttaatgttatttaaccattaaaaaactataaaaaattatcttggagaaaagtgtttaaaaggcatggatagatgttcacactagttcgttaaatgggggggaaaacagacttcaaaatcatattatcatatactagcctgagacaacaccactaccaccccatactacctaccatagctagacaagaaattctaggttggttgagatattaatttgaagtacaagtcagttgcattgatacaacaaatgataccaatatcgttagcagtaacagaagtaacaaagggaaaaaatacacaacaccgaaagcagcaggctgattcacagtgatgtgttaataagagaattcagatggagagctaagtttctataatcccttcattagtctaatgtaacacctctggtatagcacaatggaccttggtatgcctgctcatactggcctcttcaacctaattctgcgcctgccccctgccaagctttggcccagaaattagagaggaaaactacaggtagttagacctgaaaatgttgaagggacagaaaaagagatttgtggggggcgctggaggcctcagcactgccctgggggccttggcaaattctccaggaatgataaagattgaaacaagaaggaaaaccctacctcagatggacggcctgatggcaatgtggtgattgttctggtgtcacttcagcacaggagcacttgcacaccataccgtggcctccagctctctaacatgtgctgattgctaggaatcaaagtttgtatggagcagggcaagtggcatgttctcatccattgccaatataacattttcatttcaaatggtccatatggggcctctgaaaatctacaactatcatcatatggataaatttatcaatcaataaaaccatatcacatgcttcagaatagcatctcaagcaacttacattttattctgagatatgtcagcatagggattacagcctatagtagttaagcataatttgcaacggaaaaacatgtttctacttagtttgcctttgcaggtttatctttgtgattgctaattcctttgcttctcccctcctttcaaaactacagacaagagattcatcagaagactttactctgtgttgaaagcaactgaatataaagtagaaaagaaggaatagcttttgaaaaaaaaaagaaagaaaacaaatacccacacaaatcagtgtgtgtttaacaagggaagttatctcaaaggtcacagatctgcagaggaaacgtgctatttaccaatggcggggaaggaaaaatcccaaagacacataaaactcactctaaatatttgccactctgttttatttaagaccagtgtgtattagcaggggcaagctgagtacacactgaggacttgacaaggacaccaagctacaggatccagtcccttcatcggcagcgagaagttgctttcaacagtgcctaattggtttcagcagaattaccgttactatactaggagggtagcctcagagagtatctatcttactggccacagttctttgaggatatatgtttttaaatttactttgtttatagtatagtctaactcaattatttgggttgggttttctcatgattttgcttattatcattcatctgtaatctcactcataaaacttgcttgaatctattttgttgattcaaaatagattcattttaaatctatttgattcaaaattcatttgaatccaaaatagattggaacatttacatctgttccaaatagaagaaaataatgaatgatattttgttaaaataaaatgcaatcagtcaattcttaaagttttcattgatgataaaggcatcctctccatacattaaaccatatgtgactttatatttaaaaattcaaaaaataattacttaaaagcaaaatcattcatttaccagaataactcagaacaaaatggtaccgttaaagacctgacaggatttcttggaacagaatgttattagttcataaatttaaggcaggcacacagatgtctgccctgcacataacataaagcattttgcaacagaaaaaccttcattcatattttggccatcaacactactcaataatcacaccagcaggaggtttagactgtgttcagtgttcttctttctcacacattcagacagacaaagacgtacactttcattctgaagatgtccatttggttttcccccacgtttcatcaacaaactcatgcctcaccgaaattccttttctgacttacctcaagcatacaaatctggaacaggagtgttgcttcagggaagccagcatcagaatgggatgaaggaaaatgaaatctcagtttctaccaagaatacaaatctctgacatttgatagcatcccatctaatctcagtgctttcatagcagatattttaatgaaaacaattcaagctcctgacgcaacagagggtagcctttgcataatgtttagtttctaatgcctccaaaaggtatctgatatttatttatgatccaaatatattaagcctgaaatggaaacacttctagaatttccaaagagctttcataaagctgcctgaataattattagcaaataagttagtagaaaatatttttaagttccactattgtttctttggttattgtttgttctccccatatcccccttcacccacccccccaactgcccgcgcacacacacacacacacacacacacacacgatcatgaaaatatgttttaaaagagttaaacacagaaaccattaatttgctaaaatctccctagatcccatttttaaagatcacctggaaaaatcttaggattttaaaatgtcccaaattcagaaaccagagattcaagtgcaaaggtcctataggatggccactgagaaagcttcatttggtgttctgaaagaaacaacctccttctaaatggaattgaaaagtgagaaaccattattctctctcttcataataattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagggatagcactgggagatatacctaatgctagatgacgagttagtgggtgcagcgcaccagcatggcacatgtatacatatgtaactaacctgcacattgtgcacatgtaccctaaaacttaaagtataataataataaataaaataaaaaataaataaaataaaaaataaaattagggataagctcttgctatattgccaagcttggtcttaaactcctgggctcaagaaattctcctggctttatggcagtatgatttgtagtcctttgggtatatacccagtgacgggatggctgcgtcaaatggtatgtatacatatgtaactaacctgcacattgtgcacatgtaccctaaaacttaaagtatgataataataaataaataaaaagaaaaaaaaagaagtcatatgtgggagtttgagggtttataaaagagttttcatatgattgtggtgatggttatatgaatgtatacatgtgttaaaatatatagaactatatacaccaaaaaacaagtcaataaaattttttttcagtaaaaaaaaaaaaagaaactaaagtaaaatcctgtttaactggaatctaaataatcagaagttcacataccataattttattgtcatttttatgagaaagagacaaataaaataaagcagctgattcagatacttacctttttaaaaaaatctgttaagatatgattggtggggattcaaccccatatttagctcatatatatcaaaagacttctaaacctgtgattgatattcatgacaatgttagtattaagtacatttcactatcttctaggtattcaaaaggtggttttgccccaatctgacataaattctaaccccatgttaatcactatataattatttaattaacctatccccagcctagtttggacaaactgaattcacaacaaactgaaaaataggggttagttgttttacttggagaagggagggacaaaagggctgagtgagccatttaaaaccataattttaatatgcagcatttctttgtggaacaattaaataacacaaggttagagaccaaaaaacttgtatctgcaatttactttatatcaaaataaatttgggaaaatcacttaacctcaattttaccaaaagtaaattagggccactattatacttcttctatctcccatgacacaagagtatgacataaatacaagtttcattgacctggccaaattgaactggataaagataattggccatatacatggtgatatctatcttcaactgcagaaaataggatgaaccaatgatttgactacaaatatataaatgctatctttatgtctttatatgggtatattagaataagatgcttccccaccatcaacctgcagttccctgtaaggttaccaggccattactattactgtcgcctacatataaatgacaaagcagaagcaaaaatcataaaaataaatggcccaacatagaagatgggtcaaaaatagaacttataatcttcaaagcattaaagatagtgctctgcattaagtaagcacttaatgtattcttggagcagactcttgaactgacaccccacagttctggagatcactaggcctcctaagcaccctatggtagacggaagcccagtgtcttgtcaaaaatcctagatgctcaaatgcgatgaaaattacataaggaatatatttctgctactgtttttgatcactttttaaactgtttttattgacatgtaatagttgtacatatttgggaggtacatgtgatattttaatacctgtacacaatgtataatgatcaagtcaggaaaattgggatatccatcagctcaaacatttatcttttctttgtgatgatcatgtctttttgcccctgtctcttttttggcctctttgctacttctataataacacaagtttactccaagtgagttcacagcaagcaatatattcataatagcagaggcccaagttataattctagtcttggccgctctctcaataactacaggcctttaggacgtcataatagatgtctttattttcccattcttagaagggattaaaggtggaatttgaccaaaaggcaactgatattaaggatgttggaaccactccatatctcccaaggaggaaaacttgcagaagtttgaatggagttgagagatttttaaaagccaaagaagaattcccttttatccctacttccatgggaccctctgctatgctgccgaactctctacagagacaaaagggggaaactggaccagttacattatcggctcaataatgtcttacagcacaactgatacaggatctttactgaccagaatgcctggatgatgttttgccaggtttgttgaaaagttatgctacgtaaaagtgaaacagaaatattattatgaactatgtaatgacaataataaagacctcttctacctggactctcaaaaaaacaggaaaagtgaccaaatagtttttctcaatagcccaaaagacagtccaaacagttttaagggatggttcaattaacagcaaaaattcatgtttcttattccttctcttggaaagaattaataagcagttaaatgagaaatgataagaagaaaagcctcaggatttggatgtcctataggcaagaatacacagcccctggaattttgtaaatctctgagaaaacactaaaagtttacttatccaaagaaccaagggcaaaatccacaattgtcttcaactaatttaagtgtcatctcatttctcaattattttcaatgtaattgatcacattgaattacattttgaataacattgggaaaaggttggactgcagatgcatgttttcacttcattttccatcaaagaaccaaattaatctgcaggatattatgagcacattatccagcaatagcccgccacatgtctgcccactctcagaagacaatgtatgtcttatcttcattcaccgattccacaaacatttcaccaacccagtgaaaagcccagggtaaagaagacaatgatatgaaccctgtcctcaaagagtttaaaatttggtacaaaagatatgtttgcatgccaaattaccataacatgaagcaaaacgtaataactgccacaaatgaggatttaaaaaatgcaaacacctatggcatttcagaggcaacagctacattatggaaaagggaacatttcttgccattttaaaaatcactcgaaaaagtattccaggtgattaaacagatctgagacaataaagcatcatagctgaaggaagaaaaaacaaaattaaaaaattgtttaaaagtagcatcttcatgttttcattcaactatacacaccccagaaaaacgtaaaatgtggccagatttctccagtcaaacttcttccattctctgtgagaaagctaggttcaaatgcctccacaatcctgagattaaaatggaaagtgagagaaccttacatcattgtacatgtgcattggtcaaattacctttaggattaaaaatcatatttttattttttcaattaacactgtaaacatgggcagtcagaagcctcttacctttgctgtttaattatccatctgattgcagctcagatcagctctttataatccaattttgagaaaatgatacatctatttaaaagcacatatagcttgttttgttcaagtagaaagtgaccaaattctcctagactgagaaaagattggcatgtttgcttgtgcatatcagattgtgtagtcgcaaacctgggaattattccacagatgtgaatggatttctaatttatgtcacaaaggagagattatactcttaggataagttatttacttactcattttcctaattcgatttcaacacacatgagaacttcaagtcaggaaagcattgccaacaatgcttcaacagagacaaccaaaaagagatcataaatgtcttattagctgtaaataatgataaaaatcaaatctttgggaatataattacagctggtctagcttaaagggttttacatttatattagcccaagtaaatcacagtatactaattttaatttatacattcaaataggtttgttgtactggttgccataaatttcaaaacaagaaaaatcaagaaggatcagcttcgttattttttttttaatcacattttccaattgtaaggtccatagctcctccttttctgcctgttgacaagtgtacttctcccgctttctaactttaagtacactcctctctgcagtaacttgtctgagcttgtttgtcatagttcttactggcaatttctaagctatcctttcatgatcttttgaagaaacaatgtataagtgcacctgtgttattttatgttcatgccttccccttgttttctttccttggcaccatagaagcagacatacatgtctgtaacttatgatggcttatttattatttttacctgcatatattcagaaactatttttaagaaaaggactggactgataaatcagggctaggaagcctggtcattgtgtgggcttggacaagtgatataattcactagaactatattttcaggtacaaaatgaggacgaccctgccagagaatcaatcatcaaaactgcgacaactctgaaactgtatgactctctagctctttgacttcggacttcacacttagatgtcatttgttactttaaaagatggttggttccattgtggaagacagtgtggtgattcctcaaggatctagaacctgaaataccatttgacccagcaatcccattactgggtatatacccaaaggattataaatcattctattataaagatacacgcatgcgtatgtttattgcagcactattcacaatagcaaagacatggaatcaacccaaatgccgatcaatgatagactgaataaagaaaatgtggtacatatataccatggaatactatgcagccataaaaaggaatgagataatgtcctttgcagggacatggatgaagccagaagccatcatcctcagcaaactaacacaggaacagataaccaaacaccacatgttttcactcgtaagtgggagctaaacaatgagaacacatgacacagggaagggaacaatacacaccagggcatgttgggaggcagtgaggggaaggagagcatcaggataaatagctaacgcatgcggggcttaatacctaggtaatgggctgataggtgcaccaaaccaccatggcacacatttacctatgtaacaaacctgcacattctgcacatgtatcccagaacttaaagtaaaataaaatttaaaaataaagatggttggtctttcccctggtagatataaacacaaagacgaagcggcacatacatgagcggggagtgtaaacaagagagaaggggtgggggaagaaagtgagagagaaagaaggaaaaatgaggcaagagagacaaaaacccagagacaaggcagggaaagggtggggaacagggtgaggaatttagagaaagaggagagaatttgggaaaacagaagagtgtatacagtaagagagctaaagaagaggtctaattaatagtatacaaccaattatagggtataaaattttaaaattcttgcatgcattttttgcatgtcaacaaatacctacaggtgttagtttctctccagaaaagaaaaagcaaaatacttggatattgaagtgctaattttaaatgtctgtaaaaatttgtgagggaacaaagttattttctattatgaatttactaaacactagatgacattttaagccatcatatgttatcaataaaaattagcacaagagaaattccagcacagggcacaggatatagtaggcaataatataccttagagagagagaagaaggaaaatgagagacagaggaaggctctattttaaaatgacataaatcattttcctgatcttgaagactaatggagatagggagaaaggataaaataagcccatgtaaaattgcctagactctgaacaagcaacaagtacaaactacagtaaaaagttaaataaccagaactcaattaactacaattctcaatttgctagaacacatccacacacctttacagtccagtattcaaggagacaactttacaaaaaaataaaagatttcaatgttcatgaaataataatagcaattaccaccaccaccattagcaactccctaggaatgtctctggagaacagtcacatctagtacctacagcattagagtccagagaacaataaccactgttgttacacatgcagaccaggaggccattcaaggacctctgcgatcaagtctagttactcaaagtagtgcctgcacttcgtagtcaatgtgttgactgctttaaatggtttcccactggagagttagaaatgtcagcccatgcctaaaatttttggagccagggttctccagccagtagcccactcccttctcttctcttccccaccttcagttcttttctgcagtgaggggccttgcacacacccccaaggacatctcagcccaaacatctaagattcatgcacagccccacactctttggtcctaggagtgctcaacacaagtggtacagttcaccttcgggagatgagaactcaagagagacccacgtaggccctggaagtcatcttgggatcacttaggtaggaattgtggggtaccaagtggtttagaagagggaatggggtgctttggattgacaatatccacatggctctgcagaatcgtctccccataaggcatggcacagtggaggaagaccagtagggccctctaaagcaagtgacacgaggcaagagcctctttccccaggtttaagggtgctactgttaacatggcatttctgccttaacctgggttagccaggaaatctaattagccatatctcattccatgcagccagactgaatagtatttggttgtgctatacagtgaaaataaacaacctaagctctaaaattactgtaactcaggtggtcaaatgattttggttttaatcccttggaatccctgcccaattagcacaagaggatgaattttcttcagcaataaacccctaaatgcctcatgcatactgcttaagaataagctagcacaaagagaacctttactctcagtgaccaaacagagagtaaagtttttgtctcaacttctccttccttactctcagtctacaaaacatcatgcaaggctgacccaaggccagaagccaaatttaatggtgagcctcccctcttgttctctcttcttgtaatacctcatcctgacacgcccgagttatcctctgtaggaacacaagaagatccactttcccaaaacagtgtcctatacctctgttccccactctctaccacctgattttttttcttgtctttttgggctttaatctggtcacggtcaactaactaagagaataaactacttaccatatactagtgagctagtgagtgttatcagtcgaataggtcatctacccaacttaattaacattgcaaaaatgaggtcagagcagtggaggcacacaagctccttggaacacttcgaataaactgtacagcctgctcgactgagagaccaccacatatagacacagtagaaggaatacataaaagagacgagacttgtcctaatagatttgcagtacagctgagagacagaatctatataacatggaaagagctttaataatattataaaataacacaaggatacaaatcagtgagtaataaggcctttttccctcctgttttctaatgtactcccaaaagtctcatctgccataagctttccctgaaattttgatttaagagatagaaggcttggcctgaatagtaaaagaaacagcttggaagaatttagacacatttccttccttctctgcttcctcatgtttcctgtccttagaagttaggccttttgaaggatgtttggaagtgttccctgcatgtccatgtgcttctgctacctcagtcttgtttttattactataatatatcagggccctcaagagttatctttattcttcctatgtaagagtgaatagtaatttcatttcagtttttccagctgttcctttatattgttctgccccatgacttcaaaaagataggaaacccttgaagtcctagaatcctagactcagagtcagaaagcacacattcttattctagttctagtgcttagtagctgtgaggaaattatttaactcttccgagtctcaatgccgtctgtaagatgggggcctgtttcagcaaatgccaaatcaaatccctttctgcgagagcaaacaacatggtgctgcttaataggcatggttgatgtgagcacttgtggcagatattctctgctttggaatttctctgaacaagatccgattgatttgtttattcagttaacaaatattttcttgagcacctaatatgtatcagactctccactgagcgcttattagaaccactggagctatgagccatccagttgctactggacagtttctattttcaaattaccacttttctagtgttctcccttttggagaatagctaagaatatgtgtcatggccaggtgcagtggcttacacctgtaatcccagcactttgggaggccaaggcgggtggatcacttgaggccaggattttgagaccagcctggccaacacagtgaaaccccatctctactaaaagtacaaaaaaattagctgggcatggtgtcacatgcttgtagtcccagctactcaggaggctgaggcaggagaatcacttgaacccaggaggcagagatggcagtgagccgagatgacaccactgcactccagcttgggcaacagggtgagacttcattgcaaaaaaaaaaaaaaaaaaaaaagcaaaagaaacaaagaatgtgtgtcatgttgcttgcttaaattctattcgcagcattttggaatgacacgtctccctctcctggcttcattatacatcaaaattcccaaagttaaagttttttcaagacataagtcagcatagtcgctaagaaattctcccttgggcttgatagaagagaattaaaatatatctggacttcatcaagtctggttttttagtctgtcatgggaggctggagtcactagggataaattaaattattaagaatgaaagtttccaatagtgtaaaggagagacgtggtagtgagcagcacatcaagataatgagtgagcacacgcaccacacccggactcatggatacttatgctgcaatccataagtgcacctcctcaatatgccacctctgaaaaccaaaaatgtaacaagcaaatatcagaatagtcattcctgctcagtggagtccctagcgacagtcaaataaaagaagacgagcttctttgaagctcgaaaacaaagagcacctttccagtggacaactaactaaagtggtgtgattttggtataagtttgtgtgtgtgtgtgtgtgtgtgttgtgtgtgtgtgtatgtgtatacatttagttttattgtaacaaagcaacttgtacttttcacgtttaaaactgagcatcatctttcctttacagtgaaacaaaaagaaaacttaaaaataagcaggaacaaaattacaatagagaaagtcaattccaaataagatcctacaggttcttctgattctccctttgagtggcagggctcaagtcatcattaggagataatttattttaaaagtgtcatcttaaactacaaagatgcctgttaaatatcacaataaacatgccaaaggagaagccatgttgtcaaaatgcccacttaacctacccaaacatctcagatccaccctttgctgaccttctataatcccattttgttttttagtttttttctttttttaaacaagagaaaatagacagatacatgttggtaaatgctaactgtccatattcacatagagacaccgtgtactctctaagcccaagatacagagaaaggagggaaaaagctagaattctatgcactactacacaggggcctagcaccctccagcttccagcagaatgaaaggagcaggtttttcttttttcccacagagctcggtggtgttgattccatacagtttttgttcagacagaaagggataaaaatgaatttcaaacagaaaggcgtagagacacttttcccattgtattctgcaataagttgagaaccatggtgtagagcaaagagacctcaacaacagggcaacagagcacaagaggaaaaagaaaagactggaacttgctcccagggactggagaaaaatttttaaacaggaaagttggaacctatcagtgttctagtaatcttttccttcatccttctctccttcctccccttcatcatcatcttcatcttcaccttcatcttcattgtcttcttcattagtatctttttatccttcctcctcttcatcatcatcatcatcttcttctcattctgcttcttcatcatccatatcgggaaccaagtagtactgtaatgagtttgaccaaatatcatctttggtgacctctcataactcatcagcacctgcatcagaatggtcagtaaaccaggtaaagaagctctctggttcctcatgctgcctcttcctgctggctttattctgcatttgacttgaacatttcatcaaatcctttccagatgaacatttcatcaaatcctttccagatttccatttcatttcagtggactttgaagatggatcaccactctcattcagatgaaattctttggatagaagtttattttcaaagtaaagattttcatcaaaataaaaatctattctgtaacctgatttaatatcttcaaattctgtcatttcaactctgctcaaataatgcagtgcctcttcatcctcctccagcagggcagacacttgtggatgcttgacaaatgttgttaccccaaaatttgggattttggcgatcaattctgacatcttctgaaaaaatggttggcagagtttgtcatatttctgttctactttcaaaatctcctcactggcttcttcattaagtctgtctatttcattttgtacttcatcaatgcattcaattgcttcttgctgttctttttctcccttcctcagcaagcctgcagaggccaatgtctcctccggtcccagagcaggaggcattcttggtttcttcttttgaggcaggagtggagactggcatttgggggccatgctgctagggaagtccaagaaccagaccacaagtctccttgctcatccggaagcaggcagaacactctggtataagatttattggttaaaattgagcaataacacatgggtatttgaaggatccctttacactattaattccattcttaattaatagcataaatgtccattcttaattttataaatgcagaaccatttataaaaatggaaaagccatagctgtttggaccccccaaggaagctaatcaacccaccaagatagaacaggagtttgtaaacatacctttggcgtaattgtttgataatttattatataatagttagttctttaacaaatggcttttattttccctgatctaaattaatattagaaggagaatgagtgctctcaaaaaatgggagaaaatgcagaaaataacattattttcccttcaaacatccatcttctccatatgcttatgatgggtgacagaaagaggaggaaaatcaggcctcccaggaaatacacagttggggggaatccctgccccaaacatgcataggcagggctaccattttgcacaatcccacttatactcttggtgaaatttacctccaggactatgcggtgcacaatctgcctgctgtgcacagggactctatctacaggcacccaatagtccacgaagaggaaagtgcacctagcccagggaaataatattgtgttgccctgcgggctagttcaatccaaagggagtcaaggaaaagaaagagaaagtgttcactgactttaataattattcaagattcagaagtatctgggaattataaaatatttgattctgtaatcacatcagaggaaagcctttccatttgactgattctccaacaaaccaaaccacagagggaatggctgagcaaacagttttcctaccttcatgctcacacacatggtggaacataccagcaaacaaaaaaacattcaccagatttcaattgatgaaacacactgggaagaggtgccttccctttggttgactttaaaaacattaactgatacagtttaagtttttgtttcaacctacaaaatagagttgttaccttaaatatatgacatttaaagacaagggatttctatcagaccagatgaagaatacgctggacctcagtctggtgaccaagcattattcacatgagaaacgttcttaacccaaacacttcagaatggcataggaagcttgctttactgagatgctcaaggatgtgttagaagcaggatctctgaaaagcaggagtgaaaaggccaggaccactctagggccaggtatccctaatcagggggctgatgcttcagaatgccctctcctgcccttctccagccatgcctctccatggaaccagcagtctgcagggctgtgatacatacccacctgcagggacaacttcccttctagactcttccccaagtactcatgacccttgaatttcctgccccaagtggtccgaaaccagcttccagggcctgggtgtgtcttcaccctcccgaagcagatcaactcacaggtgtgcgcacccctaggcctgaggggtgttcatgggcagctagtggatgtgggtgtgaataaagttgaatgagcaggctggctcacccacacacattcttacaaggatcctccagttgcacagtggagccagggcaagaagagaaggaataggttgtggaataggggggtcttgtcctgggccctcaaatgttaggggtgagcctggaatgggataaatcatataatgaaatgagtactattcagtgatccaaagaaaaatctcctctctctgtttcctatcctcacggtgaccacataaacggagtatctcaaccaggacactggggagcatgaaaggtatcttaactagatgggacaccagctcaacaggtgaggccaggactgtcttgcaaactaggatataaagtcatcccagctacaccgaactgtagaatagtgtcttcccttaagatgatcattcactaccactgagcccagagttccataaatcattgccatccattggcatccagcattttccccctcattgggttcttttcctcattagagagtgtttgtgtttggtgtaccaagaagtaaataaaacctcattttcatcatatacaacagactttgggcatataatagaaagcatcatatgtggttccaacttctgtagttttcctacaaagtttgctcaatcttttaagtttgtaggttgacattccaaataaaaggagtagaaaataagaaggaaacccgtgaaacaagagaaccatcagaaacccctgcaaactcaccaaagaaagttggatctagggattcctgcaggaggtagaaaatcaaagataaatagtatatggaattttaaaagaaaacattgtggatggccttttctggagcccagcctgcactgagcctatgcatacaggatttaatcaggactagtcagtgcaatccagacgtgcacaccctagatgagggagtttctaggaaagtctatggccacatccttggcgtctagttaatgtgtctcccgtgctgcttcttggcaaattccagtagcctgatcttatctcatagctcttgcacaatacacacagacacacacagacacacacacacacacaatttctacagtgcttccagccagtgctactgttcaccattatttacactagcagctcttaaacatgaccacacatcacaattatcctgggagcttctctaacatacagattcccaagcagctccccacagagactgaatcgggaggtcttgggtgaggctgggacctttctacccttagtaaacaaacaatccagatgactataaaagcaaaacattctaacccctggagaagctctgctagagcagtacaggctgaattccatctgaccagcatgcagtcatgccctcttgctgtttttcttggtctattcctactttgaggtcttcccagaaagagctgaagatgtgctgcccaacaccatggagacaaggccccacaacaaacagctgtcctttcctgccatggccaaactccaaccaactgccaattcaaacacgtcctgaaatggctctctatccattgactttcatgagaaactacttgagctttattaagaaataaaatacacacatacagcaagttatgaaaattttagaatggttcctcttttttatggacagtctttagtttctaatccaacaataaaatgattccttaaaatgaaattttaacccatttctttccttctttctctctctccccctccccatcccacacacactcatacaatgatctgtgggctttttgttaaattagtgattctcaatggaggtccaacccttccagaagaacaaatcaatgtctccaggaagccatgtaatttttctgtttgtgaaaatgaaccaagtgttttcaaagggaaagaaacactgccagcctcatctttgattcatccagaatatggatgggagaaaattatagcaatcaatcaacttgaatttcatgttttacaaatggtatagtgtgatcagaaataagccaaaatttataagtaattggcatagaagaattaataaaataagtaaaattagagaaatgctatcaggtaaaaatccctccttaacagtagagaagcagattatgagaatccagtcatcactctggatattatcatcacaggcaaaaatcagctaagtcagctgttgacagagcagaggaagttaaaaaaactctactcctctggcactgttttgaagttcagcgatactcagcttggtaaggcattcagtgcactgattgttgcttcccctggaagcagtcagtgcctgtctcctgtgttattcccacagatctcagggatggggccattacaagacagtccctctgatcttggctgccaaaaactcaacatagcgtgatagtggtgcctcctcgccaagagagaaaatcagtgctaaacatggtacccaaatttccactcatcatactgtggtggcattagaggatatggagctataaaagctaaaaaataaaaaagcaaggccaggccaggcatggcagctcacacctgtaatcccagtactttcggaggtcaaggtgggaggatggtgggaagccaggatttcaataccagcctagacaataaagtgagatcccatctctataaacttttttttgttttttcattagctaggcatggtggcacatgcctgtagtcccagctatttgggaggctgaggcgggaggattgtttgaactcaggagttcaaggttgcagtgagttataatcgcaccactgcactccagcctaagtgacagcacaacttcatctttaaaaaaataaataaataaaaataaataattaaataaaaatttaatttattaaatgcacccgcttgcttcctgaaatatgccaagctaaagaaatatctcttcaatatattagtccttggcattatttcactaaactatttcattaaactaacacctcattcctcttgctctattgttcttttcactatgctttagatcattttcctaagttagtttaaaagtgagactaaatgctcaccctccataagtcaagacttccttaaaacataagacataacatacatattattccacttgtataagcataaatttgacatgaaatagcttgaaacaaagtttggaaggatgtgcatggtgacattcccattggttcatttaagatggtccaagatttctgttcctgttacttacctcttttctactagaaacattaattatttattatttgtatgctcgtcaagcttttaaaaaaagagtgggaaatattgaagttacttaccaatggaagctatcaatatctgatattataattacagaagctcctcaacttacagtgggattatgtcctaataaacccattgtaagttgaaatatcattaattcaaaaatgcatttaatatacctatcctaccaagaatcatagcttagcctagcctacctaaacatgctccaaactcacattagcctacagttgggcaaaatcatctaacacaaaacctactttataataaagtactgaatatctcttgtaattttaaatgctgcagtgaaagtgaaaaaaaaaaaaagaaaaggaagagcaaaatcaactgcaccgaacaatgaagggacagagtaattcaacaggaagggaacagtttctactgaatgcatgtaatttcacaccatcataaaaatagttgaaaaattctaagtcgaaccatcatgagttgggaactgactgtatttcgaaactctaggaacaaatggctaacattagacttctgactatatcatttcttttgctattgttatccattgtttgggtgatctgccattgccaaaatgcatctactaggttgaatggaagtatttgtccacaatcttattttaaaacataggaacgagatggtcataaatgagaggttacttaccctcctgaaacagccactaattccacaaattggctgcttgttgttcaagacagagaccctcacggataaagtaaataaggatttatcctatcaatgaattgaaagatgcattcatttaaaaattacttgatatcacaattggcatttcaattttatagttcttcttgctctcacttttcttagagattgtacaacaggaggcagataccaaatatgttccctaagaaaatttagaatggctctattaatctctctctgacttcaagacaatgtttaaaaataaatgtctggcttaacattttacaaatgcatctttttaaacattaatattttttctgtgcaccacaagagagaaattttgtattgaatctaagtcaggagcaattcaatgagattgaaatcacccaagacagcctccatctctttatctccatcacttggaagatttcttgattacactttggagctcattatcaactaggattgtctcattttcaagatctgccagtctcaaatttttcaacatttcctactctttccctcctgttgaatttatcctgccccttcgttgttctcagtagttgattttgcccttacttttctttgttcttccagtcttcttaaactgggatacaaattcccagcccacccccacccagtataggcccttgtcatggaaaaatatggcatatatattttaggtgtctatttactgagaaatcaatcacctactagcatctactactttattttaacagatctgcactggaattttaaatatttttttattttattttattttattttatttatttttgagatggatttttgctttgttgcccaggctggagtgcagtggcgtgatctctgctcactgcaacctccacctcctgggttcaagctattctcctgcctcagcctcccgagtagttgtgattacaggcacacaccaccacacccagctaatttttgtattcttagtagagacggggtttcaccatgttcgccaggctggtcttgaactctttaccttgtgatctgcctgccttagcctcccaaagtgctgggattacaggcatgagccaccaggcccagccctggaattttaaatattttaaagttaaaacttaagacttgagaattttccaacttctaagaggctacttggagccccagaaatgtgctttccttcttctctgtcattatggatatttcacaggaaccttgttcagcctcctcttgccttcacagcctatggtcaaccatctccaactgaattctctctgaactctgagatttcctagtattcttaacctttcactaaaagccatgcttacactggcccaatccatttcttctgccttaattctggggtgtcacattttctctattagtccgttttcacactgctataaagaactacctgagactgggtaatttatgaagaaaagaggtccgattaactcccagctccccaggcttaacaggaagcatgacttgggggtctcaggaaacttatgattgtgatggaaggtgaaggggaagcaagcacgtcttggcatggcagagcaggagagagagaaaggggatgtgctacacatttttaaatactcagatctcgtgagaactcactcattatcacaagaacaacaagggggaaatccacccccaagatccaatcacctcccaccaggctcctcctctgacacatagggattacaatttgatgtgagatttgggtgggaacccagagccaaaccatatcagtcactaaggaaagtcctatgataataccttgtagaaccaagccactcaaccagtccaaatgctggtcctccctcactggacagtcccctttttcatctctaatacacatcctaactttctttcttttttcttttttttttgttttttttgagacaaggtcctgctctgtcatccaggctggagtgcaatggtatgatttctgcttactgcagcctctgcctcctgggctcaagaaattctcccacctcagcctcctgagtacctggaaccacaggtgagtgccaccacacctggctaatttctatatttttaataaagatgggattttaccatgttgcccaggatggtcttgaactcctgagttcaaacaacccacctgcctcagcatcccaaaatgcagggattacaggcatgagccaccatgcccagtctacatcctaacttttcaagccctttcagattctcaaatatacttctaactttctcaacaaacagcttcattgcccactcaacaaaaattgaggcaattctaggtgaattatctcaatttttccttccttcatatgaaatgtcataggtcatcacacacagtctctttcttgccttcagtttttttttttaagagtcagggttactttttaagtagctggaagtataaacatgtgccaccatgtctggctaacttttttttcctttttgcaaagatggggatcttactatgttgcccaggctgatcttgaactcctggactcaagcaatcctcctacttcagcctccaaaattgctgggactacaggcatgagccacccactgtgcccagccttccctccaatcttgaagcagtgtctctatttcttcctgagaccaatccctccagccatgctcctgattctatccctgccagctctctccatcgtccccaccatttcctgcatcttcaagcctttgcctttacctcctggatgaccaagacaattgcctcttttggagacagatcatttctttaccctgtttctttcaaagttttccttccttttattgccaatctgcttaagggaatagcacacatttataaaatccacgtctttcttcccattcttcctgagccccataaataagcatctgtcctcaccaagccaatgaaccattctcactatggtcactaagaaacccactcatcactatcccaggtctctgctctgaatttgtctgccttgtttgtgtaaagaatggccaagtccttcttaagcccttacttttcttcctttccttcactccaccccctcctgttctgtctcctacctctctgactgctcctacccagtctcagtcaccagctccccttcatcttcataccccataggcaacattctccaacactcagctttttcttctacagcttctctcttagtgactgcatacatcacatgtcttcaatgatcatctccatgtagagggctttcaactccagagcctccagcccttatctgttttattgcactttgctttattgcactttgcggatactgtgttttgttacacatcacaggtttgtggcaaccctggttgagcaagtctatcagcaccatttttccaacaatgtgtgctcatttcatgtctctgtcacattttggtaattcttataatatttaaaatttttcattgttattatatttgttagggtgatatgtgatcagtgatctcagatgctactgttgtaattgttttggtatgccacaaaccatgcccatataggacggcgaacttaatcaatgaataatgtgtattctctaactgcttcactgactggcttttcccagaaatctctcctctcctcaggtctccttctccctgagacacaacaatattaaaagttaggccaattaataaccctacaatttccttgaagtgttgaagtgaaataaacagttacatatctcactttaaatcaaaagctcggaatgaataagcttagtgaggagggcaggttaaaagccaagaacagccaaaagctcctgtgcaagttagccaaggtgtgaatgtaagagaaaagttctgaaagaaattaaaagtgctactccagtgaatacatgaatgataagaaagcaaaacagccttattgctcatatagggaaagtttgggcggtctgaatagaagatcaaaccagtgacaacatttccttaaaccacagcttaatccagagcaaggccctaactcttcaattctacaagggctgagagaggtaaggaagatgtagaagaaaagtttgaagctaacagagattgattcatgaagtttaataaaataaactgtttccataacagaaaagtacaaggtgaagcagcaaatgctgaggaagaagttgcagcaggtgaactggataatatagctaagataacaaatgaaggtagctacactgaacaacagattttcaatgaaggtagctacactaaacaacagatcttcaatctagacaaaacagtcttatattggaagatgccacctaggacttgcattgctaaagagaagtcaattcctagtttcaaagcctcaaaagacaggctaactctcttgttaaggaccaatacaggtggtagctttaaattgaagccaattctcatttacaattccaaaaatccttaagcccttaagaattacgctatatcaactctgcctgtgctccataaatagagccacaaggactagatgacagcacatctgtttaattatggtttaccgaattttttaagccttctgttgagatctactgctccaaaaaaaaaagattcctttcaaaatattactgctcattgacaatgcacctagtcactcaagagatctgatgaagaactacgaggagattaacattgttttcatgcctttaacaaaatattcattctgcagttcatagatcaaggagtaattttgactttcaaggcttattatttaagaaatatatttttgtaaggctgtagctgccataaacagtgattcctctaatggatatgagcaatgtcagttgaaagccttctggaaagaattcaccattctagatgccattaaaaacattcatgactcatgggaggaggccaaaatgccaatattaacagaagtttggaagaagtgattccacttctcatggatggctttgagtggttcaagattttaggggaggaagtcactgcagatgtggtggaaatagcaagagaactagaattagaagtggagcctgaagatgtgattgaatttctgcaatcccatgataaaatttgaagatttgaggagctgcttcttacacataagccaagaaagtggtttcctgagatggaatctactcctggtgaagatgctgtgaacattgtggaagtaacaactaaggatttagaatattacattaacttagttgataaaaagcagcaactgggtttgagaggactgacagcaattttgaaaagttctgtgaataaaatgctatcaaacagcactgcatgttacataaaaatatttcatgaaaggaagagtcgattgatgtagcaaatttcattgttgtcttatttcatgcaattgtcacaaccaccccaacattcagaaaccaccatcctgatcattcagcagccatcaatgtcaaggcaagactctccaccagcaaaaaaattacaacttgctgcaggctcagtgatcattagcattttttaacaaccagtatttttaaattaaggtatgtactttttttagatataatgctatttgcacacttaatcaactacagtatactagaaatgtaacttacatacattgggaaaccaaaatgtttgcatggcttgccctattgcaatattcactttattgcagtggtctgaaactgaacccacaatactcccaaagtatgcctatgctgagacactagcccattactatggcctattaggtatccccatgtagcgagcccggggatagtctggtaggtggaacagaatgagcatttttaccgatagttatatggttttgggcaaaccatgtaacacctgagtcccaattagcaataataataatagtaccttcctcacagatttgctggtgaggattcagtaatatgggaaaataagtttatttatattgattcagcaaacacatacagtgcttactatatgtcagaatggcttataatactttataaataataacactttacaaataataactaatctaatcttcacaatgatcctgtgagggaaacgatgttaaaattcccatttcacagataagaaaactgaggcacagccaacttaggtcatttttcccaggtcacacagctaataagcagcaaagcctgattccaacccagacagtctagcaccggagttcctactcttgatcactgccataagctgcctccaatcatactgcctttctgcctttgaaagcactatagaaatctaattattattattaaatgaaaaatctgaaacataagcacacccttgcacttcgattctctttcctgagatccttgttggttaaggacatcaatcctgtaaactacaacctcattaccagctttactccctctcttaccctaaagcccattgttgccaaatcttattgtgttcaactctgaaatggctgtcttattctcactgtcagtgcttccactcaagcctatttcattgtcacctaggctacaaatggtctctgacttaggatggttcaacttaggatttttcaactttgtgatgctgcaaaagtaaacacatttggtagaaaccatattttggatacttttttcactttcagtacagtattcaataaattacatgaaatatttatgtaatttactttattacatgatttacattaggtgattttccccaactgcaagctaatgtaagtgctctgaacacattcgaggtaggctaggctaagctatgacatttgataggttaggcatattaaatgcattttcaacttatgattagtttattgggacataaccctatcataagctgaggagcatctgaagaaagacagacagacagaaggaaggaaggaaggaaggagggagggagagacagagagagagagatgaaagaaagaaagaaagagagagagagaaagaaaggaaggaaggaaggaaggaaggaaggaaggaaggaaggaaggaaggaaggaaggaaaaagaaagaaaaaagaaagaaagaaaagaaagagaaagaaagaaggaaagaaggaaggaaggaaaggaaggaaggaagggaaggaagggaggcagagaagcaagggaggaaggaagaaagaaagggagaaagagacctcctatattttgggacaactggtgaaatttgaataaagtttggagatcagacttcagatattagatattaccacataggggtaatggggtatgatgtctgcaacttactttcaaatggtttagaaaagtgctcttaataatatgtatatgttaaagaacaagagaatgataaagtaaatgtggcaaaatgttaacaattggtaaattcagatgaagaatatcctaaaactttttgacaattcttgcaacttcctctaaattaaaattatttcaaaaagtttttttaagctaacaaatcttgctgccctggcacacacagagctgatgatggccttcccctgccactccactcctcagatcctctcaccaaagtgtcaatggctccccatgccaacccaaaaagtccaaagagctcatctggcatgcaaaccatactaccatatgctttcacctctgtcattccaatttcatggtgttcttcccaacactatgcactctacaccctccccactgtttgatgtaccatgccccctgaccccaccccagcccccgcccgccgcattattctgcttcaaagcctttgaagaggctacttcctttacctagagtaaaacaacctttttttcctaaagataagcatcagtcacatccttgcctcaaggcctaatttgaatcctattctttccaagtcatcactcagatccacccagttggaatttttttatcttcccaaggcaggtgttgacctctgtgtctggcttactgtctcagtccctttgagctgccatatatatatatatatatatatatatatatatatatatatatataacaaaaaccttagactgggcaatttataaacaacagaaatttattgcttatagttctgagagctgtgaagttcaaaatcaaggcaccagcagattaaatgtctggtgagggctcataccttatagacagcaccttctatgtgtcctcacatgatggaaggggcaaacaggctccctcaagactctttataagggcactaattcattcatggagagagagccctcacaacctaatcacctcccaaaccccctcttaataccaccactttggtgattaggtttcagcatatgaatttgagagggatacaaaaattcagactatagcacttacctccactccttatactggaaatttcattgatgtgtccttcacccaccaaattaggagtttgcagaggctggtaaaaatgtggttttcatctttataacccttgtccctttttaaataatttaaaaaacgtgtgctgccagggctgatcagcagattcaaggcaacaggggaagtcgcagttctggcaatgagcttcactaaacatgcgaagtcattcagacacactttccactctccacagctcccagctctgcaaggaaaggcagagaggagagacatcctccacaggctcaccttacccccaacaatgttcctgtatggagctcctcccctttccagaagccccttcattcagtcaggtcagtttgtcacaccctgcctcagaccttccagcaagctctgtgcagctgctgctggcagcgaaaggatgtgtgtgaagctgctctagctgcaggttagagcttctccaggactctaaatgcttgaatggctttattttcaatactttacctttttttaagaaaaaataaatttaagccttttgaaaaaacttatgtaaaagagtctttttttaactccttagaaagttctagatagaaaacaaaataagggtgctcaaaaggaatagaaattcaattgtttgctttctaggtcttctcccccctaatgttatgctccctaagcaccctgtctttctttcttctagtgcccataggttttgttcaaatcaaggctcagtttcttcttccatctcttccttctactgacagagactaaggctcaagggcaattaagtcacttggccaaggttatgttgccctaaagtggctctaggcttgttagtgggtttatacatcctacaactggagcttaggatcaaacactgagatttggggattgcacatgtagttatagccagaagagccaggtccttcaaggagaataaggagaaaaatataaggccaaggtctggacattgggaaacctgcacttaggggacacaggaagtcatcctatgacgaaaatggctttccattaaactccaagagattacttcctaaacctcattctataataaggaaaacaaaatataccactcttgagtaagatctaaatacaagaaccattctttttcctttcattcatttagcaagtattgattaatgtctattatatactagaaatgtttctatgttctaaggagacagtagtgtacaaaacagactaagttcctgtttgcagagaatttaccagagctaatcttgtaatatctgaaaaatcagagacttcctaaaacaagctatttattctctatgaacttcacttctctcatctgttaaatgaaaaaaaaaaaaaaaaaaagacaattaccacccgcatcacatagcgttgcagggaaagctgagtgaaatgtcatatagaaggtgcctaacatagagtgacattcagtagataatcaataaggggtaataactaaatctgattacatacttaccagagttatccttcactatccctcaggactcaatctaacaaataatcctgtcagcatgttctaaatccaatcattcagatataaccctagagatttttgctatttctgcattcaagtctgcactacactcaatactttttcctcattccaagtaataactgtaaaatcatagttttcacatgcaagttttatatatttctaatccacattaaaatcatcagtaactattaaaatttaaaagttcatgcatgtgacatagcacctaaaagtaactgagatgtcaccggaagtctgttgggtctactttgggagatacttctccacaggctcgacttggcagaactgatcacagtatctaaatttggcttctttaaatgaaacacattttggagagctccacagtctgccatcctctcacaatctccactgttactctcctaacacagcccctgccatgactgtcatagcctcccaacttccacccttgctccctatagcctgtgccccacgcagcagccagaatcagaccatgtctctcccctgccccaaatccaccaatggattgccatggcacttagaaagaatgtaacgagcttactgttgtctacaaaggccttgcgtgatctggtcccttgttgtctcccccacctcatttcctacccttctttccattggaagtacagctgctgcagcaccaaacgtcattcagacagccttgcatccactaatgcccctgcgtgcagcacactttgcccagattgtcatggctcactccctcacttcagaagccttccctcaacactaatcaaaaaaagcacctccgccatcattccctttctgctcaccttgctttattttctcaataacccttatcacggccaagcattaaattatgtattcacacatttgtttaatgtctgtcaatccccattagattataaactctaggatggcctccattttgtctacttttacactagtatattactaatgcctgaaatagtatggaagtcactcaacaaatatatatttgttggttgaaggtatgtgtgactgggcaaagtggataaccagtattctttaaaatacgtccagtttgaagttcctctatgacatgtagaataggcaggaagaaatgcaaacctggagttaaggagagaggaaatcaaacagcaagaacatatgaaagcatgatcaaaaccccacggactcacccagcaaatgctatagtaatagcggctccaaaatacagaaattgattagaggcagaatagagctcagggatagatatgaataaaactgaaaaagaaccaacttcattattcaacagtttgtggcttaaactcaatttgctttaaaaaggaggagttaggggagaagtgtgtaagtaaataagcaaaattttaattttagcctgtaataacaacttactccctgaccaagctttaaaaacagtgctgaaaagtaaccaggtaagttgagatttttctgtttgtttggtttgattttacacagtatgtaaaagttaaatttccaaaagggaggctgttaagatggaggaaaaaaggtgaaatgacttctggtagactgagtgtattaatggcccaactcatggccttcctatgtatgcacactttgactcataactttacaatcctccactcggactcggagttccaccacaaactgctttggccagtggggtgttagcaaatgtgacacacaaagagacttgaaaagtgcatgtgtgttgccaactaccattttacacaactggacttgcccatgcttcgaccccagacaccactgtgaaaacatccctgagctagcctgttggagggatatgagagacatgggaaggagcattgactttaccaaggaaggtcatcttggcttgccagctaactcctaatgcatgagtaaggcttgctaaaataatcagaatctgcttagataaccagaactccccagccaactggtagactcatgaaaatcttccatgattatccttttaatcatttatccatttaatccaaaactatgttttggaactgtttgttacacaacaatagctaactgatacaacttggataattccctccaaataacaaaggagattaaaagaggaggttgaaggagtcccttaaattcaaattcaaggtcataattctaaaatattttatctaaagcatttaaaaaacaaattcagcaaaagaattctggattttctggttaaatctttttaaaacatttgaaaacaagtttatgagaaaatacatttaatgtaattgcaatccaaagctgaaccgttagcatccccttaaattataaaaatggggtgattttttttacaagtataaataacttacactgagtaagctgtctggttttctttatggcctccaagaaaaacaaaatggagccacgtacgttcacttcatccttcagtaattctcctctagcctcatcacaggggacttctcatttccgtagcactagagtctattttcattaaaagaaactattccttccttcatctttaaaacattaactaccttcttgtatatataccagattcacttaaagaactacagctaaaagaaaccagcaactatttgcttctattcatgcttttgtattggcataagcactacctcttttcccctccaaggttatcttttcttttttctttgcatatttcccaggagctctgcactaaagcataaactttcacattagagaagtgaataataaagcagacaccagaggaatacatatgctgtttgaagaggctttctcacccagcctccttcatgcttgcagactcatacccagtgcagttgacaattttagttcactcagaatccattgtatattcttttccataaacatacacatctttgtatgaggagaaagtgaaccaaatcgagaacattattaaagacacaggtaataatatgcgctgtagagccttctagtatgctgagtctcatttggtcctccttttgtggcaagcatagcctggattcccacctctgttttacaggcaaggaaactgaggctggcggtggcaatgtaacttgatgtttctcctttataaagtgactaagtcaggattcaaacccaagttcaagatccttttctgtacactatgcttctgaatcttacagcgttggggaggggggaagttttcatgtaaaagaaaaggacaacagacatatttacatttactttgaataattgcatgaaaaaaggagctaccaactggtagtatctctagaacaacattctacagcacacaacagaaagctatataattttgcatcatgttatgtactgatcacactagagcaacaaatactaaaatgaagattcccaaacaacttggcttgacaatcacagcttcaccacctcttaatattcacaatgtgctactgagggctgtttgttctttatccaacatagcctactgcaataaattcttgtttctccaaaatacatttaagggatgtggtgctgcaaataattgaataggcaggttagtggagactactaaatgtagtaacatctcatttatttctgtctctgtccaattttaaagctctagaacagagtttggtaaactcttttgtaaaaggtcagatattaaatactttaggctatacagaccatatggtctctgcgggaaccactcaattctgcccttacagtgtgtgaaagcagcagtagatgacatataaacaaatgagcatggctgtgttacaataaaactttatttacaaaaaacagatttggcctacaggaagtagtagtttgccaacccttgctctaaaacataaccctcacccagaaggaaaaaatgcagtcacgtcttatttactctcaggggagaactgacaccctgagtgacacctattctctcattttatacataggttttagaaactaggctattttcttgcttacagcctatagcaaaataggagcaggaattttaaagcaagggtactagtataggcagtagactgaagtccaaacccttagaacatcgccagagggctgatgcagtagagcagtctgggccagttagtgcaggggcaaacactcttcctaaatcccttcatgtcctcttaattatctcagtatcacctcaatcagtatcaccaaaggaagattccatttaatctctctaaaacagaagaaacaaagatacagggatccttttgtaaagacccatgaaaactggctatatctagaagttttgaaactgactgaataaacttcagctatctagaaaatatattttgtgaaataatcagttccccaaataataataagatgacaaacatttataaagcactatgagatatgcatcattcgaagcaattttgaaattaatatacgtaaaatgtaaagcattttacgtatattaatttacttaatctctacaacaacccaaccagataggtactattgttatcccattttccagataattaaatggaggtacatgaagattaattagtttgtccagagtaactcaggtactaagtggcagagctgggatctgaacccaggcagtctggctccagagaccacagagttatgggttgatgcaaaagtaattgcagttcttgccattttcatgacaaaaaccacaattacttttgcaccaaccttttgcaccaataattgctacactatgctgaggcattactttatacctatatgtggactgccttagttcaaagactagaaatataatacatatacttaaaatatctattaaatagaatataatcttcagaatcttaaaactgagacatatcagtgttttcagtgcctcagggtgaagaatgcaagtgcctattattattgttcagtttcaccaaaataaaaagattgctaggatgtcagattgaggatattttactcttttggtgttgtattttaaattgcttttggaatgagctagggaaataaacaacaagtaaatggagttatgggaaaattctttttaggcattcctagtctaatcagataaatatgagaatgtgacatgagttcgtgcttctattttttaggtcaggatatgaagattaaaacagtttctatttgttgtctttatttcttaagtagcttgattgtaaatttggtttataggaggaaaataatttggttgttaaaatagctgagtttattattggcttaacacccaacaaaaatattttaacctactatatccaagataaaggactaaaattggtttgacaggcttatgacttttattgaaactgatgttttattaacagaaaattaacagatttggagagattttttaaatagaataatctgaaaaaaaattgtttactgagaggtaactgtgtttttttttatttgtgatataaatacttttgttgatccctagaagttcagagtggagaaaaatcttctagcttctgaaaaacagaaactataaaccaagcttatgttagatgcaccatttgctcaactccatgcaagaaaaatttctccaaaacctacctgtacacttactttatagcagttttccccaataagaagttagcatttactgcaaagtttataaaatacccaaggaactatggagaatgaatgaattttgattagccatttcatcttccttgacaattgttcattttctccccacctttttataaaactacaaagcaagggattcaaatacctgacatagaagaggatgggtgaggtaaagagagaaaaatatcccaggactactttttcactataagacataagtattaaatcatagcaatctctataatcacaatgttcagtgatattttaatagccttggaaattttttaacatatggatcaagaatttaaaagtaaaatcattttcctaatttcttccagatggtaaatattataatttttttcattaccttattggttacaaggcatagattctacatagacatactgaagaacagtaaggaaagaaaagagaaaagaaaaaaaggtatggcagaaatagcttagtggatcattgttgtggactgaatgttcatatcgtcccaaaattcatatgctgagatctaattcccaatgtgttggtgcttggagatggtatctttggaagataattaggtcatgagagtggagccatcaggaatggggttcgtgcctttacaaaaagaagccagagagctagctcaccctctttctgccatgtgaagataataggagaagtcagccacttgcaacccaaaagacagccctcaccagaacctgaccaggctggcacactaatctcagaattctagcctccagaactgtaaaaaaaaaataaatttctgttgtttataagacacccagttgatgatactttgttacagcagcctgaactaagacaatcaccaaaccaactttttattcttcccagacacaaataggactatagccccagcttccctttcactatatggggccatgtgaccaagctctggccaatagaaggtgagcagacttctatgagttttctcctttgccaaagcacagacaccaggaagctggtcgtgacaacaaggtgataagagtggagtcacaagaacactgcttgaatgaatgagaagaatctgcccatcaagaatactcactttaggctttgattgagtgagaaataaacttctcagttaagtcaacaagatttcagattttatatgttatggcagttaacatcaccaaaactaacatgtagaatctaataaggatatctaaagctctggaaatgtatttcctggaatggtacaactttattcctttcttgttgattttagattttataacataattgtatatctcagatgttattaccatatcttccattaaatatcatgtttgtagataattgtcctagctgcaaaatatatagatgcttataaattttgttttagcaattttaagtagcaatatatattgtcagtacatcctaaactgaaagggcagagatctggattctagttccaggtactctaggttcctgtcacagttctactgtatatgaaacttaaacctggtaacatcttggttccaccatttatttgtcaaatatggtaactgaattaaataaggctggagactctaaaaagtaaaattttataagaaaatttttatgtttcttttctgggggtgggtgggggacagagtttcactctgttgcctgcccaggctggaatgcagtgatataatcatgactcaactgcagcatggaactgacaggcttaagtgatcctcccacctcagcatcccaagtagctgggaccacagatgtgagccaccacacccagccaagaaaattaatatatttctacccagtactttttgcatatactacagattggtcattccttcattattaacatagaaaatattttgaggagaaaagtagcaacctcataataaccctttttctttgagaattatcctaaaagttctgccaacatgaaataaatgtctagtaggttataagctccttgaggaaaccatgtattgttcatctttgtgtttctagcacctaactcctgatttttgctgaataaataaattcctattgagaagttaaaaaaaaacattatttcactatagttttaaattactgaagaagtgttcttatccaatcaccaaaggcacaaaaaagtcaggtcaatggccctagatccagttttcaaatactactacaaatgaaattgtttcattcctagaaagttctctcatgaatttctgggtgagctgtgtgagataaaagtggagataatccactccattttaatacgttttacttattgtgattcctctataatttcttctatcttttaaaaagggttcaacaggtgaaatggggaactgctttagcataaccaatattgctgttaggaaatcatcaaactataacagcagtgagctgaaaccactgaaatgtaggatgcagctatggacattattccaaaaagcataatgattttctgaagcagaaccacctaaaaatttgggattcaaaactgctaattgatctttcaaatcattcagaaggtcattttgaccattcattgcatccctgagatgaaaagactactaggaataagcatcacctcaaaacctacataattatttccttagcaaaatttaataatgagagtcaagacaggaattaaaaaaaaaaaaaaaacccaagaacatctgtcagtctaaatttcctaacccactttttcctgtgaggaaaatatgtcctctaaaacttcgtcattggcagctccaaatgtaggctgtgaaggaatgcttatctaactattggcttagtgctgtatctaagtggaaagaaagcttaaccaacaggaacattcatcctgtttgagggaagcaaacatagcttagaaagttagtcaatccaatcaataagaaatatatctgatactttccattttaaaaattgaaaatttgcaaagaatttttattaatatactgataattgttgcaatatgtaatatttatacgactatggcacatggaagtttactaaatatgttttcacatacaatgccacattcgtttatcacagtaaacctatcggtatttttaatactcaagtaatagatggatcagcattgaagctccaatgggagcttcaatgggagcttaaacaaatgtaaggtccaaaagccttcataacattaggatcaaacagtgaagattttctttgcttcaaaagttttgtccattactgggaatatgttttagaagtaaagagtcctaaccctagcgtgatgagctacagtcataataatagtgtacatgtacagcacattacaaattacacattacaatgttcttttgacaagcactttctcattgtgatgtggatattcaccaatctagtaaaataccagaacatatatcattattttcattttaaagacatagagactgaggcttagaaaacgtttcatggcctgagcgtggtcccgttgactctaagattaattcaccaaaatgttctgcttcttgaaatcagatattagaggaacacagttatagttaagttggaatcactgattgtcttgaaattaaatgaaagctcctcttctaccagtgtctagctccacaaaaggagggacttaaagaaatgtagggcatttaactccttggtggtgtgctttttctgtgggaagagggacatttgtttcattcgttttgttctgcttttttaaaaacatgctcaaggtagacagcaactcttttgaaaacacaaagtaagaattattaaattcttgggcaagctgaagaaatcaaatcagtcctatatataacacaggaaaaacgttggagggaagagcaaatttttccaaaaacaaaattcaccaaaaaaaaaaaaacccactggaaaatgtaattcaatcaaaaaattatattttcttcaatttggatttatgtctttgcttcagtaggtagtgttaatagtctccaaatgccagtgtgtattcatgaacacttagcaagttcatgatgtgatacattcctttttggatacatctttcgtcaaatccatctgtctatggcagatatgcatagttttacagaaccttatctgcaaaagaacttccacagttagacaaaaatggttttagaaaattgagaggagtggatagaagaaagatcaactattgctgtttgggagattttttttgctttccccaccatgccttgcccccagcccactgtccactgggcacctggcacctctagactccatttcttaaagctctgttctttcacaagtaagagatatgactctggcatctcaggaagaactgaagtgatggaagtcccagaggaaagtaccgatgcaagacgtaaatactcctagtatacacccaccagaatttccttgagccttggttttaaacatcctctgaattatataggcagctgattaatgtttgataattaagcatttttatgtgattcatctcaataagagcccaagcaaggtaatgtaaacaatgaaggcataaaaaggtggaaggagatgtgaatactacaccaagtgggccacatggacctaaggaaaaagaggagctgagttgaagtcaggagctgattcagataaagcagcttcaactctactacttcttactcttagatgggctccagaccaccttgagggatgggattatatttattttatagatgcactcctttctcccactaatacagtcagttaggaatgtatagctaagaatgagccaaccattactattcgtgtctatggctacagaaactcaataaatcaactcactattctgggtcaataaatgaactcattatactgtttcttcatgaagtaaatgtgtttctaaaggaatgtattaaaattacatttttaaaaatctatgtattttgcatatatttgattgatacagaaaaggagtctacgttggctacttttctttctttctacaaacttcattcattggtgtgatctgaaaggggataatatttcagaaagcaaaaatatttttaacaacaaaactttgtatttccagtgtgatctaaacacaaaattatgcaaaacacaactaatatttctctcctactggctaaatcatgccagttgtttaggtgcaatcaaaaataagccactaatgttatttttataggaattggcaagtaattgccaactatagctattaaaagtttatatttgccacaggagcctgtgattttaaatactgttcaaatgatttatgcttgagagttatacatagcacaaatacatacatttgtatctacaggtctaaagaggaaaaattagacaaaaagcaacttgaaaaggaacccctttatttttaatgacctacctttgtgctgtattgagaaaaagtataaaaattatttgggaggaagaaaaatatttctaagcactaatttcataggcaaaagccctattattttttatgataggctaggggaaatcaataatgatttaaaagcaaacagtaaactgctcacatttaccagtctatactcagtattaattctaccctgcagtgtatgctatagaaggtaatgaaatgctgatgttttctggttttccacttcaatctgctccagctttatcctaaaccttgtcagcaacagaagttaccccccagcaatcatacaaacctaataacggcttccctggcttaatttgatctgctccaatcacaaattccaatccacatactttcttctgttatggttgtgtctgtatgtgtttaatgtactttttataaggcttttttacaacaagcgcatggtttttcattcagccctctaccacataaacagaaccactgaagagcatttttgttcatataaaaatgttttagttattcatagtgtatgtcttcaattggctgcagattacagtgaacaaaagtattgctgccatcattttacatttctcctgttactgtgccctatctgctgtgtacccctgtccccaaagcatttattataatatttgctgcttgctctcagttttggactgagatgcttgggggtgggaaaacttaaaacttgcctgactcaagtgctctctaagctttgatcccagcatcctgctttaacctgctcctgttggacctctgccactttactgaccccataaaacaaacagagctagcaaatgcatcaaacagcctccttcaaaatgcagcttgactgtgattcatggcacaaagctggaataaccctgccagttcttagaagctttaagattcatcgtcttgaacttgatacacatagtatagcaccttaaaaacgaatcatctgctagttcagtattttctacttacaatcactccctcccagggcatgtaattaatttactgagcttaaaaaaaaaatatcaggattactcacacagtcttgaagatgcaatgtcagctatttaggacagaaacatccaaggccgtgtcagaactcaattacgactacatatgcattaaggcaggaactggcaggcctcagggtacgccaactataggactcgtgcttctcgtacgctgggctataatct

SEQ ID NO: 264 - DNA, 30894 bp, Homo sapiens
ttttatggtatcaagttaaaaactctttaatatctcaaaatatcttatcagattgaattatatccaatatcaatttgatggctatattcaacacatattaagaacctactgtgtaccaggcatagttttaagtgctagtgatatattggtaagcaaagaccttgctctcatggagctgtggtctggtgggagagacagataacaaaaacaaacacgtatataaatctgtgagaagtgttataaagaaaattgagcagggttatgagaataaagctacagaatgggggatatctcacacaggatggttagcaatggctctgcggctccaggccctgcctactctctcacttttcctcagtttctccagatgtctcaagctcatttatgcctcaagatctttgcaaatgtttcttgtctggatccccttcctcttcctgtcaactttttccctagttacctcttacaatccttcagaactcagatgcaaatcactttctcaaggcctcaaggaagccttctgtggccctccggaacagatcaagttcaggttcctgcttatttaccccactgagctccttcattgtactgatcacatatataattatatgagtattgtttaagcctttgtcccctccagactgtaagctccatgaaagcaaacactgtgtctcattaacttattgttgagtccttaaaactttgtagtttgcggagtaggtaaccaaaaataattgtcaagtatctgaataattttcaatatcccagaatattcaattaagtaagtatggaaggcccctttcaaagcttgcttagaaaacaccatgcttaatcttataggccatctaagtaattttggtaatttttaatgtagcaaaattactcaagttggctttatttggttatgaatatcagtactaacttatgatgtcactatcctttcatttcaaccacgttcagtatcctaagagacatgctgattgaactataatttaaaatgaataatcttttatttgtaaaagattgagtcataaataggcagaatcaacccatgcttttattttcattgcatataaaaatttcatatgaaggtattgatgtacagtactatccccgtgggctgtaagagaggctaagaaaccactaaaagaataatcatttgtaattctcacacacaatttaccactctgaaaatatatccaaagaaataaaaacaactcaaatcagttaaggatgtttttgtaattatagtgtcccctttgtactgtttaaaacaaaagtaatcaaattcctttgggccagggctgctaaaatctacagtttgtgtcaaaaaataaaataaaataaaataaaataggctcatttttcctagaaaaagaatctttcctttcactgaaaagccacatgattcaagggctgggcaagtactgggaggatgtttccatataatccattataaatgtttcctgctttaggggctggccattgtacaaggtgaaattttaaaattctaaagcaatgaaagttttgcagaaacaaatcttagaggatagtgaatgctttctgctatgtaaactgacatcaacccacctttgcgtttaaatagatgggtttacatatatgtaaggacatttggtttatcttagtggaagaaaaattttaggattaaaaaacagtattttctctttaatgtattctcttaacatgtcaggaagctgatgaatagataaccaacacgagtaaactctggctccaatttcaaatcaagtccattttcctatgagctctagaagccaaaaggacttaaaaaaaagaaaaagattgtttataatcactgggaaagaatatatttccccagttgtgtttccgagttaaaaaaaaaaaaaaaggaaataatcaaatgcaagtagctgaagtagttcctgatcaacagatggcaaacaaccatcacacatgcagtgctgctccctggcaagaagtacttaagagcttctgtctcaaaagggtctcagaatctttcagaggttgtctgtggttttgtaaaatccacctattggcagaattctaatcaattaaaagcctggatgtaaaatgcccagccctagctccactgttacctttcaaatgcagcaaaacagaagaaaatattggttaaagttaaggcacagccctgggaccaaagacctgcagctatgtttttttaaatttatatatctttaagtattttatagttttcttgaatcttccataaacaagctctaaggtgacaagactatattacaggagaaaagaaaaatgtacagagtatgtatacacaccattcattctctcaccaagagtttccaaatatatcaacaccatcccatcatgggatgatgttttaataagaacagataatttacaattaacattacagtatgtacattgcaataaatacatggttgtaaacagacaaacaagactgtattacaggtaaggtcatttggtgagaaaaaaaatgcatggcacaaaaaataaataatgcattcaaaaattatcataaagctttctgtaaaatccatttcattcaagttttttctttccttgtctgtaatttgttctatctacattattgtgaattttaactgatataaaacaaaattaaaacagcattattgtgttcagtaacttgcaagctgaaatgcactggttttacacaaacttggacatttttttccccatacagtacccagatattgcattttcttatggcattttaggaaatgtaaagccacttgtaaaaggatattcttttattcttttttaaagcagtatatatttctgaagcacactttggcaagagagaagggcaaggataagcagattgtacagtgcattagtccctgtctcttggatattgagccttttctgcaatttgattgtccattagtgggtatctttacaacacggtaccattaaaaaccaacaaactggaagaaaaaaaaagagcctctctttattagtgcagttataaaccctttaccctttcaggtctggatttgttaatgacatattgctgctttttattttattcattattaagattctaggcactctgtgggggaaatactaagtgtagggaggagaggaatgagaatgttttggaaagaggaataaactctagactctttacctttctttctagacttcactcagggacaaataaaattaaaagaaacaagttcccaaatattcttgtgaaactacttggtcaaacatacgtctttatttttttcttatttgaaagattaccatctgatctttacagaggaaacagagtagaaaccttgcaattaactagttgattcctcttctgctttatgtaaaagatcagagttataaagacataatttttatttcaaaggatctaagcatcagctagatctcaggggactgaaatggggactctcttcagcatgagtcatttgcctggctgatgacttactttccagtccccaggaggctccttgagaagttccacatataaatgcttttcagagttgtaattcttcttaaacgtttgattttccacttgtcagatacccactttggcttctatctatctcaattcttgaatatcaatgtgaaaaatgattatttgggctttaaagtcttcatagagaaggtaaagaagactttattaaggctgacgtggggataaagtcagaattaaatgccccatgatgccaactgctataatcaggtaaacactaggaattaatctctaaaactgtaatacagttcctggtgctgaaatcagccaagagtgatctctaattttttatttaaccagaatttttaccaatataataaatattttaggatgcatcacagtactaaccctctggtgccagtggcatcatcttctttccctccatgtgtttaaagaagtagttcccctctgcaagatatgcttatggatcgaggataagtgataaaggacttcctacacgttatgtggctgtccattaaggaagagtagttgctacacttaaaaccgtttctcagggatgttcctgatatagttcttaatcccatggtgaaatcattaaaaccaaataggattagttgtattggtgtttgttaatatattgttaatattcttaaaaactgcctagttggctgtttaacttttctctgtaaaccaagagtaaaagctagtcatgatatacaacctcgtggttgaaatgaatgttaaccctaacttaactacctgtttcttttcaccggtgacaatggtagtgatatatttgacaagacctcatctagcaaacatggataaggttcagacacacgctaaattataaagcagcacaaggggaaaaacctttttcttactataactggctgtaaaaacaataaaaatgagcatgaaatgtgtggattattagagcatgaaatgtgtggattattagaaagacatgcacttgtgaaatgaacatctagtgacacagcaaaacgttattaggagatactaagtaggaaaacatctaaaaaagactgaccattttagctactgggtatttatatatctcccacttgcttcagacaacacgaactgatgactgagtttgcatgaagcttaagacacatttgatataacacacataaaagtattatagaacaaatagtcactttgcacatgaagaaaaacactggtgaagagcaactctgcttatctggaaagagtgaaacaaaatgcaaagtaaataataaagacttacaaaaagggtttcctgcaacataaagttgtttttctcttttaaaatatggaagtcattggtatataaaacaaacaatgaatcactacaaatcagttaattgctatgaactataaggtgcaagtaaaattcataaattagatttttatccagtgtagcacagatttgtactgaaaacttgcaagttactccttagaaaaaaataaccagtggcagatgaagttctgaacatagttttttttaaatataatacctcaatacatttaataataaaagtaagctctacaaaaaatctgttttacatatcatacaaaatgtagaggtcagtgcagctcactgaaccacactattcagtcatgtatcaggaagacttgaaattagaaaattatgcaatttctgtggctcatcctcctcctactggtaacagattcgtgctatgtcctgttcttgacatatttgttgcttcgtccattaagttcactctgtgcaatgcctttcttctgaaaatattgcaaacaaataaaaaggaatagaaaccccaagtccaataaacttttgggctgcctgatgagtcacactctcttgaaaataatttggagtagattttatctgctttgtcagctctaccaagctgaaatcttgttaaaaacgctgttcgtgaagatgtccaccttgctcggatgacatggaggtgaaaaaactggttacgatattcctgagcgctggactgagtagtcaaggtcagttttgttcaacaaacgtcctggcagatgacagtgaggtgtgaccgtggttgtggcatgtgacatgcactttggaaacaatttttctacttaaaaaaaaaaaaggcatgaaagtttttgcactgttacgtgtcaggagaacgatcatctatgacacaggcttcaggctggctttcctcttcttcccctactgcctcctcttcaacctgttcatcaaggggaatttcagtagactctgagtcttgagtacaaagagtcttggagtcactgcagctagtgtcttcttccacttgactgccactgtccttttccgtgtctgactcaccatcttcctctaaagttagttcaaactggaatttctcagtttgaccctgccggccctcctctgggtcatcaggtgcaggagaggggctctgagggattgtgctctggtaccattcacgattgtcctccaaagtgtccaaaatatcctgggcgtcagggtggacgaggtctgcccatgtctcccagaggggatgaacaatatagtctatgaagcccacctagttaagaaaaaaatccagtatgagtagaggacttgggactaagaaacaatggaaaagcttaattagatcatggcccacaaataaaacactgaacagaagactactaaacttagtttggtaaaattgtcactattttcaacaacaacagaccatttaaagtaaagtattgctactagctggtcaaaattagcttctagaacctttggttaaagagcatgttctatagcataaaaaattttccagttgttgacatggtagggcttattttacaatcaccaatttgtaggtgaatccagataactgaaataatgccatgtgctctatgtatatgaatatattaaatgaatatagtcataataaatgaatatgtctttagaatatatatatgactatatgaatgtaagtcataagaatgaaagttctttggatcataaatactaaggtgaaattgagcttgtcaaaaacaaagtaattttaaaaatccagtaaaatactatcatatgtaatacaaagtaaccaaatgctaaagcggtagctctgttctctctgaaagctatacacttcatgcattacctgtgatttttccacggaagcattgtgcttgtcacacatggggcttatctccatgccacgttccctctctcggtctccttggcggaagaactcctccattatccggtccgtccactggcggtacagctggagaggctttgttgggttgctcagatctgcacagtgcaccatattctgaagaacctaaaatagatggatgcattctctattcactcctgttccttttttttaaaaaaaaaaacaaaaaaaactagaaattcacattggatgactgcaacacttaaaaatacacgtagtgtaagatttattccaaacagctcaaccatgatgtgtctgtgtatagttcacacttgtattaatagttccaaattatgccacttctactgcatctaaatagcttaagagaaactgtttatgtgcatggctgactagattcagagctgcttaagtggctggttctgtggggtgtttgtttgttagtttttttaattaatgtagatgcaaacagaaagaccagtagaattttacctggttaattctcaggaataaaaatttggataaaaatcctgcctacaattgctgaaagtataaggtgggagaaggaagaaatacatcttatcaaagctgaacacgcagacatgtgcacatgtgcacagacacacacacacagagcaaactcaaacaaggctttacctgaatcctatcggaataattatcaagaagaagaactccagagcttgtcactttcttagtttcaaccatagtcttcaaatcagccagtagattcatgtgttttgacatatctgttgcaagtaccttaaaatatagagtatattattaagttcagagaaaacagaatttacacatgaaaatattacgcagaatataagaatgaaaaaggaataaaacaacactatgccttttaatgacagtggaaaatccttactactccttgggggcagagtcttttcccctttgctatcaagttttcccaaagcccagataaatgtgtgtaatatacagaaatgctaggcactgacaaccactttcatggtgaaaaatgggtgacatctccatggataagacatcatcacaagtttataagtttttgaaagctagagattttcctgtgtctcataatcactgaataagatgcatagaaaaaagagtaaagtcatggatgtctaaatggcactgtctactgatgagaaaaggtggggaaaaaatccatttgagctgtggcccacacaatctgcttttgttagtcatttttctctgcccgccaccagactggaggggcccagaaaataaatgatgagggtgagctgacattattctcaagtccaaactgctagaagtgaaaaacctattacagaacatcacagccagcatcacgggcagcttctataacataaagggccataatatgttttgaaatgcagttccttttacctaatactcatcttgttcttatgtctaaattataaacaacttgcatcacagttctcttctttggcttttatcagctacttacgatgtcaatgaccattttccttaaagattgtctttgttttttggtcaaattctggaaaatgtcacagttttcttcctgaagcaatttaaagcccacagccaaatgatggttctctaagactgaggaatcattgtacatcaaggcaagttcagagtctgtaaaaaagacaaaaggccaaagatcagcaaaactgtttgtgagaagtttatctgattcttaaaattctggatttaggatgtaatttcccctaaacttctctgctgcccttatcattacctgacaatatccaggagagaataaatcagataacataagagcaggaacaacactggaatgaatcttggggagtgaattctaatgctactaacatgtggcaggtcatttcactctgtaggtctcagctttctctaaagtgaaagaattggatctttaacctctcctctagagttgccatgagctcagcagaatatgacattattcttagtatctataacacatccagagcataaggttttgtattcctgataactgtgaattacctaccctgcactatataaagtgaggatcctgtgttacaggattgtttgtactcaaagagggtacaagaacaataaggaatcatatgaacaagtttagatttgctcatttgctcatgtatagctctgaaagtccaagctttattcattgttttccattttcttttccaagtatcgtggcagtcattgtatactgtacagggatattgctcttcctgcctgcttgctcacagcttcacagtgatgttgtgtttggctgtctgtataccctctggtgaagattctgccactctctccctactgccctagacctgtgaattttaggcagggagagattctgcctctctcctacttcttgtaaatagcagacccagagctacaagataatcattaaaaaacttttgatgctttattctctttccacttaatcactgtaaagactaaaagcaaatccgaggcaggaggattgcttaagcccaggagttcaagaccagcctggtcaacatagggagacctcatctcgacaaataataaaaaattatctggggatggtagggcgtgcctgtagtcccagctacttgggatgctgaggtaggaggattgcttgagcccaggagttcaaggctgcagtgagccattatatcgtgccactgcactccaaactaggcaacagagcaagactctgtttcaaaaagaaaagaaaagaaaagaaaaaggttaaaagcacaggtatttgatcttttttctaacgaatgcatagaaaatatataacgaatgcatagaaaatatatttggaaatatatatctttttttaagaaagaaatacccaatactattcaatggctattttaatggagctaggaaggagaggagaggcttaagacattttcaactgagaaattctattattttatcggaactatagaaatacaaatttgcacacttaaatttctgctcccaaactacaggagcagagctgtttagactagtagggagtaggtttgtacagtatttttttgttattttttgttttctttagataaaacaatagtgtttatcttttaaaaggcagtttctggtgaacttttatagtgtctataaatgcctttatgaacctttatctacagataggtaagcatatagaaatgaaaaatttaaaactatataggttcttagcacatattattgtatttctacagtggaatcaaataaacaaacatatattgaaaggaaggcataattattagatactggataattattagagttcgtttaaggaaggaaatatgcatgtagacaagcagtgttaacagaattgacttagccttacaaaaaccctaattggcttatatgaagctgaaggtgaaggaaattaaggctgttgaccctgcaaaagaataagatgatgagctcttccttcaaggaaaagggtgatctgttgtatggaaggtgcaacaaagagtctgagttctactggatataagtagggcctttcatgtagggcagatgtccaagaatactggcaaggcctgtcttggagagtggttatctcctgacacttaaagagtccagattggctagaaaagccaggaaaggatgccttagtggactggcaggcctccatagcctcttccatctcagatgctgttacaggaaagtggtggtgactgttgatttttaaatgaacaaatgttagcatttaagaaactgaatctcaaggaagttatttaactttctactcttctttaggactgaaggcatatggtcacatttaaattgggaggtaggagtctgcagctcctcagcagattttcatcaaagacactaatccattacttgtaagtagagtccttgaaggttcaggaatgatcagaaagttgctgtcaggatggtacagtgcacagcacagaggggcaaagaggttagcttatataacatttttgttgaaaccctttcatcttcaagcccaatataagttacctcttccatcaagtctttcttaattaccagatgaaactgcccactttctcctgtaaacttctatactactttgtaccacccatttagcatgtatcgcattctaccttttttgtctttatctctacaaatcttttaatcgttcctccccaaaccctcccaacctacttagagacttaagcccctacaaaatattaaaggttattaatttaatatgtttggttatctggcttcccctaggcacttcaattatttcaaacttacaaagtacaaacaggaatacagcaaggcacaacatttagaggatttaggtgccattgtgttaaatggtttatgtgaatcatctcatttaatcctcataactcttttaggaagatactgttgttatcgacattttaaggctatgttccattcatggatggcatggagccatataggtgggaagtaagtctttgtgtccttgggataggctgggggatagaaaatgtcccttggggacatcttttatacacataaatatttacatagacatactcatataatcctgtacaaatgaagaaaatgtacctcagagaaggtaggtaactttgccaacatcacctagccagtaagtgctggggccagcacttaaaaccaggcagtttctagagccctcaccttatactgactatgattacaagtaccttatagaggtgaaaacctgagcagtgaacactaaacatgaaccaggaaatcaacacagtccactcagtgcctggcacacatttataaagacaactttgtaagtatttattttttattgagaggccatgcatacctttacaaactcaaagccatcattttattatatatagatcaattgtgctcatttgttacaactaccctggatcatcaagaataaattaaattatgcccaacatatgctactactgaaggcaggaagaccacttttgtgtccctctcttctgagtgctaatgaaatggggggaagggtgggcaggtactaccacataactgagaacatgtacttcatctgtgctaatcttttctctctctgtattaatcatggttctccagagaaatagaatagacatatgtatgagtgtgtgtgtgtatgtgagaaaaagacacatttatttattataggaattggctcaggcaattatggagtccaagaagtcccatgtctgcaaaggtgaaccaggaaagcaagtccaaaggccagagaatcaaccaggaaccctgatgttagaggcaggagaatatgtatgtccaggctccgagaaagcaaattgcccttcccccaatgttttgttcttctctttgaggtcctcaatggattgactgatccctgccaacaatggtaagggcaatcttctttaatcagtctaccaattcaaatgctaatctaatctcttccaggaacactctcacagacgcaccccaaaatagtgttttaccagctatctgggcatcccttagcctagtcaagctgacacataaaattaaccattacaaattctgccccttgtcaccctggtacccataagcatctcctttaaccatatttaatctccataaggccataattctaccaaacaggctacaactatcctgcatacaactaaaagcacactaacacattccccagaagtgaaagtaaagtttttgagtaatgtttactcttatcctgatagcctataacttaaatactatgatataaaataaatacttaaatactaatataaagttaatacctcttatgttatataagggaataagaaaaagaaaatgaagataagttaatacctcttatgttatataagggaataagaaaaagaaaatgaagatatatgcttaatatatgtatatatacatataaatgcattcataagaaaatactcatgacaattatagtccttatttctataactggtcatatggtcatagctggtatttgtaattaccttcttttactactcattctgtattcccttttccctcagcaagcacctcagctggtcatgattctttacctggtggggtgaccgaaaccttcattcgtgaagggtatgggttattagtggtcctgcctggattgggttattttgtgctgaccttaattacagggcatggttaatactaagggatgccctaagggatctccttattccacacatactcttccttaccttcattgtggagtagtaacccaatttccccttggtagtcaggatcagtcaccccagtcaacactgtaatgcccttcttggatgattgaatcagatgcataaggagctcaaagtggctaggtcttaacttccagttcaacggaatcactgttgtgtctcctgatagaagcattcctccttctgaaactaagacctctagctagcagcacataaatttgcaggaacaggaagcaaactttgctagtgggtcactgggggtaattatgagtcgtaacagtcccatttctatccaatgattcctggacccatgaattctggttatgcgagaaatagcaccacatattggatgctgattcagagcatatatggcctttatggccttctggagaaccttgccccagccctgcaaggtcttgcctcctagctgagtaactgagtcttcaaaaggccattctaccaatttatcaagccagctgattcaggatgttagggaatatggtaagactagggacttccatgggcatgagcccagtgcagctcttctttgccagtaaggtgagttcctggttagaggcaatgctgtatggaataccatagttttggcagaaaaactgcagggaaggcacatctgtttccagagaaagtgccttttccactaaggacaaaatgctaccctttccaccatggaagtggtccaatgtaatcaaccagccatcaggtagctggctgatccccccaaaatggtgttatatgggggttcagtgttggtttatgctgctggtggattgcgcacttagcaatagtcatagccaggtcagccttggtgagtggaagtccatgtttctaagcacatcctgccacctccatccctgccaccatggccactttgttcttagcatgttgggtgatgacaggggtggctagggaaccaagttgactagtatctacagaatgggtcatcctattcacttggttattaaaatcctcctctgccaaggtcacactttggtgagcattccttttttgtccattcagagagatcattcacatatctcttccccaaatttctttctcaccagttttccaatcatattccttctaagtccctcactatccagacaaatcattggctacggcccatgaactggtatataattgcacatatggccattccctcttccaagcaaagtgaacaacgagtcaccttgcctaaagttcttcccactggaaagactccccttcaccaccatccttcagagatgtcccagagaggggcagtagtgctgcagctgtatacttccggtggtacctgcgtatcacgcagaaccatccgtaaaccaggccctctgtcaactacttgcagggaactttccatgcgaccacatgtgtaggctgggagaaagaaggcagtgtaattaataggagtggcattagggccacttctttatgtaatttgtgcctttagtgtctgctcggacctgatagatcgtgtattacactacttttatttgatgatgaaatgtcgtacatgcccaacatatggcttggcgcgttagataataccctattaatgatgggcagacagcttaaaccacatggaaacttggtggcccatagtcagtcagtatctcctaaggcccagcagcaggcctatatctttctttcaaaaggagagtagttagttatctttctttggatgatggcagggtcttgctccagagtctgtgctgtgattcacacagagggctctgtcaaaggctccaaacaacattcctatctgccactgacatttcaagcaccattaaatctgctggatcatgtggcccatgtgcagagcagcttgcacagcaggctggacctgttgtagagccccactcaaaactagcagtttttgtgacactctcttgttctgtgccccatctaaactagcagcttttcagatcacttagtaaatgggccagagtaacacacacaaagaaggaatacattgcctcccaaatccaactaagtccactaggtattgtgcctttttgtgtcttatgatggagtccacatggcagatcagagccaatattaagacctggagctgaaacagttaagactggggcagacactatagatatgtatcctgtaagtaagacttacactcactgttcttacagctttactaggcttagccttgagttagttagaaaatgacagcatgctacaccatgtctctaagttacaactgaaataaacataaatcttcaaaaggacttcagaaacaaacatttctccatgaaatgacagagggaagtggtggttttaacttaatattcagttgtcaagaaaactgcctcattcatcactccactctctatgccctcaccctgcattattttcctccatagcacttagtaccatcacatgccataaattcacttattatgctccaccttttctagcagaatgccagctcttaagagccagggatttgtcttgtcttgtccacccatgtgtcctaagtgcctgaaataatatttattataacatttagtaggcttgcagtacatttttgttgaataaaataatctctgtagctatatctatataatcacatttgataaacatgaatttatccttattttgaaggtgtgggtttatacagaaaaataaaattctacatacaatctactagtgtagctatgaaaattttaatttcaaaataaaagtagagaaataaaaaagtgtatactgacagctagatacatcttaaccttaatataatgaaatgcctctgctcttggaaaccaaaaaccgcatgctttgaatgcatcactaatgtgaataaatctttctgccccaaacttaggcatctttgctattaacaaaaataattcatttgccaagtaaaatttaatgctatattctgtacttttgatactttttttcagaaaataaagctaagttaaatataccctccagcattttatattcaaaagttcatgctgctatttacattttatggatttatttatttatttatttatttgagatggagtttcactcttgtccaggctggagtgtgatggtatgatctcggctcactgcaacctctacctcccaggttcaagcaattctcctgcctcagccacctgagtggctgggaatacaggcatgcgccaccacacctggctaatttttttgtatttttttttgtaaagacagggtttcaccttgttggccaggctggtctccgaactcctgacgtcagtgattcacccatcttgacctcccaaagtgctgggattataggagtgagccactgcacctggcctatggatttatttatatgcatcatcctttaaaaatatttacgcagcttcctgcctgaaatttcaatttctctaaatcctgttcacagtacccacactcaaatcatttattatagcttaaccaactctaccaggtagaattgttctctctgcttgcagaacctccagcatgctttcaacgagtgtaaatacaattagtataaaatcatttggcacctaaagctaaaacaactgaaataattaagaaaaacgaagagcacatgtaagaagcaggaggattaactgccctgggaaccagccaagggaatccccagcgccccccatgtgccttaagctctcagtgcttccgtagcttccttaaagtaagacaagtaaccaactatgggtttataaatttgataatcagaggtctttagaattctttattatgagaaatatggattcagctgcaggctttggacaggatggcagctccagctctgaggcaagagctgagaatgtgctggcttgacacatggatgctcaagccatccataaaatataaaaagtcaaattttaaaaaaggtttactgcaaactaaaaataagcacaaattttgataaaatatttcacgaagctacatatcacaagtttacaagttattagaaggattcctttactgcatgctgggaagataattctcttacatgatccctagccaaaccaaactaactaaggctgtaattttgataatgccctggggcccggaacaaccctgggatactttcctgtacaaagtgacaatgctgattcattccctcaggaataacacagcctcatcacacctcatcgtcaaaaaaactttagcaatccaaagctactctggcaactgtgaacttccctatgtcgctgtggtcacacagaaaggagatcattgcaatattactaaataacaaagaaagaatttgcagcggcaggattagttatccttccatcccaggcaggtcaccagcaaaatgactttaaacagacatcctaaggagataaaattatcttcttcagtttcctccactatttcattggttctcaaactttagagtatcagattcatctgtagactgaggccttgttagcttaaatggcagactgcacagggaccctgatgccagggtcctccaggtgccagtcaaagcccaagtgccctttaaagcaggggtccccgatccatccatcggctgtggaccaatatcggtccgtggcctgtcaggaactgggctgcacagcaggaggtgagcagcaggcaagcccgcatcagtactgcctgagctccgcctcctgtcagatcagcagggacattagattctcctaggagcgtgaaccctactgtgaactgctcatgcaagggatctaggttgtgcgttccttatgagaatctaactaatgcctgatgatctgagatggaacagtttcatcccaaaaccattctctccctgcgcccccagtttatggaaaaattgtcttccataaaacctggtgcctggtgccaaaaacattggagactgctgctttaagggctcaaaagaatgaagaatagagcaggtcctcattacccttaaaaaatgtatcagagtacttggaagacagtgacctttctatcagttgttttaatttgtcttctaaatctactcttaattctaagggaacatataatatgctatataacagaatgcaaagaaaacataccagtttgaatgtttggtgtttaagatagatatatatatatacctttaacacaaaaattttatgtaaaaatacattttatgtatttactaaaaattgataaaattcagaatatctcaagacattcataagcatcaaaataaatcaggccaggctcatgtaaagtgccagcatgcactgtattgcatgacctccctgctcttcttagaaaggacataatgaaccctccccactgatacctccccactgataccatgtaaatgcagggagctgcatccaatgtatattaatatttgtatgtatgctttgatgagttctaaaagtacctcattataggtgctcataggtaggtagaacatgaaatgttatcctgtctaatctggataaataagttcctaaactaaacttgtaaaaaaatacttgactaaccacacatctcaggaaatccctgacttttccagtcctctacatggatgagtcattagagtatattttgctataggatagtccagaggccattataagatataaaaataggtaaataatcctaaagctctgaattaaatctctcaaagcaaggttacctctacattccttctttaaatctggctacagcaaagtacaggaaatgaatggtgaattcataaataattctatagctagattgctataggcacgagaagactattattcatagcctcaagcaaaaatgaaagaaaggtggattcttaagcatacaacattttcaacaactttgcatattttttatatataaaagtgaatttatgattttataatctaccataatttataatctaccatatgggagggaattaagtcatagttcacttaaatcacttaccaattaacttcaagtaccaaatagaatttctataaacctaaatctctttaccaagggatagctcaagcattacctaaacattccctacacaggctttctgtgcggcaatgtcagagatgctccatattaaacagtctctactattccttatatttccaaattcagtgatgacttcttataaggtgagatgttaacagtgagaaaaaaccaaatggttgaaaaaatattaagaagttcctgttacccttattagaagattttaaaaaggaaagaacaggggttgggcatggaggaggaagggaagctatggcctctgaagaggattaaatgatgacctacataaagtgaggaacacttaccattaattctcataactttttttttaatttaaaactttagggccaatacaactttctaaatctttctgcacactttcatttttaattacccttgtctagtaacacagcaatatattacttttaaagagaactggaacacatttttcaaatatcacatgcctcaagggatataatgataattttcagttaaattacattaacatgaactatcactaaaacacatatatacacatctcaaaagaacattatggctctggaagactctgagtttataaagacccttagtcattctaaaatgtacaagggaaaaatgtgttctgaaaaaataaagtttacttacttgtattgatcagaaattgattggacacaccaggatgatctacatcatgtattgcactggcaaaaattgctgcaagaatctccaaatctgtaaacacagcctggaaaatcagacaatatagataatattactattctacaatgatatgaattaaaagtataaacaaataagaaatctctagaatttaaatggaaaacaaaatgaagcttcaaaatgtgttacaatgtgtcaagggagagtcttagatacttgtgaacttttaaagtataatcttggaagaaaatattttatctaattttattacatctcatgatcaaatgttttccattcactgtattttttaaaatattattttaaaactctgaaattattttaaaagaaaataatagtttattttctaaatatttaagatgtctaagaatattctgaaaatgtacataaaattagtaagacattagcaattattttctttcatcgaaaccagggtttctcaacttcagcactattgacattttgggcccaataactctttgcgtgggaggctgtcctgtgcattgtaggatttttagcagaattcctggcctctaccaacaagatgccagtatcatgtacaactaaaaatgtgatagttgtgacaaccaaaaatgcctccagacattgccaaatgtccctggtggtggcaggagggaaagaaaggggaagagaaaccatctccagttgagaatcactcacccatatgatgaggtattaacataattttataatgaaaacaaactgaattataaaatatatttcttaagaaaatcaaattgctttagtaaacaactaatgaaataacttcttaggatttagaaaaattaaagtatgtccttctaatatattctatgaaaaaatatcaatatattgcttatgttttataaaacgttctttggcctataaataaaagccgtcagactagatttcaagaaaacaaatgaacaaaaagtgagtaagccagatgtgctttatgaaatgttcagtggatcatttcaaagaagcaatatcataaacagatcaatcactaaatctgtgaccaactttcataagcaaaatccatcaaagacttgattgtctattaactatagcattttcccccataagtcaataagttatacttccaatgaatccaattatcttctccattgaaaacccttcagataaaagtttaatagacctttatgagtggcaagttagtgttcttgaaatttcagaaacagatttacctccaaagcaggtgtagataatagcacatgagtagactggacaacatctgcagcatggatattgttgtgataggccacatcagcatggtaatggtcttcgagagtcataagatatgtaattaaagtatctactggaattttaaatgtttttaataaatcccgttcctgtaggaaaaaaaatcatcttaacatttttgtctttatgtgaaaaatttctccatagagtatgtttaaaaaaaaaaatcacacaccagtgttgccagtggataacctggaaatggcaactgcactctcacatgtctagtgaggaaaatgggaacctctgagaagatccagggactctgggacaaaaccagagttgggttgtcctgctggaacccaagaatactacgccctagctgtatggtgtcaggaatgaggtgccaactctaaaagtttctatgtcccattatcatggaggcagctccagtcaagcactattaactcaacccctgcatcacaccaactaaaaatcaacgtcctctctagggctgaagtttcccatttcggtcccgagatatctacagcagcctcaacttctcatttaaatcccaccctaagctggagcaaagggtcaataagagagagaaatggatatgaagaaagaagcaggacacaagaaagtgactgaaaaaactatattctaaggttagtagccagcaggggctttattcattttttttaagttagtactccattctctatgcagtcaggttcagatgactaagatgatgtctaaattattattttaataaattgcttcaatttggctatatcacatctttttcttaaatgcaaaaaaaataacaaaattgatgttatttgtggtttatccacactccacctttctgtatctttacttgtcccttggcaaaggagcaaataaggataaaagtataaaaataagcaaaaggtggggaatattaaaaaagacaaaatgtatgcataagctacagactggacattaagttcctaaataaaataaatgtaatagaactcaaccaccttacctgaaaaatggtgtgcatgataacagtcaagggccggttaccagacaactctgctattctgaaaacatgaagaccccatttgttcacatcttctagttcctggagtgaaaaaaaaaaaaagatactaaaatattagaaagtggagtaaaatatgactcaatgaacacaatcatttaaaaattacagaccttaggtggccgggcatagaggctcaagcctgtaatcccagaactttgggaggctgaggcgggcagatcacttgaggtcaggagtttgaaaccagcctgcccaacatggtgaaaccccatctccactaaaaataaaaaaaattagtcaggtgtggtggtgtgtgcctgtaatcccagctacttgggaggctgaggcaggagaattgcttgaacccaggaggcagaggttgtagtgagccaagatcgcgccactgcattctgcaatccaacctgggtgacagggcgagactatgtctcaaaacaaacaaaacaaaacaaaacaaaacagacttcagtgtaaagattgttagattgttttaaacaatgattcattttaaatgttaacagacacaccatgtaagcataggcaaactttaggcacatttacttaaatgtactgaaaattgaacagtatggcttaaccttgtgactttgacattacaacacatttatgtactttttaagtatcaatcacaaagcacttctttaatggataaaatctattcacaaaaccttaactgttttcctaaaacccagaagacatgacagatttctaactctttaaggccaaacaatgaaatgaagatgcaaataatcaccccccaaacccctaaaacataccaaaccacctgtctaaggcactttaaaaggagctttataaaatgccttcccatcttcaaaaaaagaaaaaaaaaaaaccccaattaataaacttttctatccatttaaaagactagaagtgaaaattcatgaaagggcatcatttaatatttatgatcctgatctttgaaatcatcataccttggcaaggacatcttcttgttcagttttaactccaaaccttgggatacttgaattagtcagactagagctgtgcatcaatttcttgactccactgatctgagacattggtcttttctttttctccttttccttctgagttggagaaggaatttccacttcatgttgcttatcttgagaaatttagaaaatgttctatatttattattaattctatctgttttatatcatatgcataattggaaggattataattgatcattatatattccaggaaatgtttccaactaaaaagtttccttttagagagttcagtatttacatttgaattggacttaatttgatgtcttcaaacacaaaattaagcaaataagttccattacaaaataataatatcaaatgtattccatggttacctctttgatacaatgtcctaataaaaaatgctgcaagacttagcatgacagcagactcagaatacacaacaggtggttatttccactgttcaattccattcctttgtgaaactgacttaatgaactgaatattgttcttgccaactaaggactacagtttcaatacatactttgaaatggtagaaactttatacgcaaatgtcatgaaaacagcagtatataaaactaacagctaactgaaatgggtaacactgtgggagctgaaacagcaggttttggatgacttagattaattctgctactttttatttctgtatgatagtgagataagggttaaatccccaggttttatgggagcatagagaatcataaatattacctgataagtgaatacgtacataagctaattgtgttctatagtaaaagacctaagatatcttcttactttcatccacgatttcaaggcagtgatgagcaactctaactcatccttatatatagaacatattctaagtgtttaataaatgttaactatatataacagcaattttgttttgaaagtaagtccaggatacattcaaattactgacctttatttactgcattttctttctgtggatgaggtacaagagttgtcccaggacaccaaactcagctattattagcaaacttttatttagcaattgtattttatctgcccaccagtttactaggcttgatgtacacaagacggtaaattcatcgagggcaggaatcatttctaatttatcattaaacacctattgcccaacaatggctggcatttaataagaatttgttgaagatatgaatagatctctctataaaatatattttacagtttggtactatgaaaaaatggcaatatataatcttaattcaagaattcctaaagtcctaaataaaactaagaaaatgtaccttgtcacctgcaactctaaaactcagaggcggatagtgtcgaattattaatatgacgaatgaaaacaaatagaacttctaacacttgtttggtttccaaaatgagttggcaccccaatcctcctacaaaaacaaacaagcaaacaactgaagaaaaaaatttaattgcatgttgttattctcacctaagaatgtgtttgatataaactctgacacttgatttccagaccgactcatttcagagagatgggtgagctcccgattaagcatccttttaaactgaaaaacagaaaagtaaaatgaaataatagaagaggaaaatttaagtgaaatatatatgcatactctgagatacaggaagatatgcccaaagaatttttaagttgtcctgacaatttagaacagtgccttccagcagaactttcttcaatgaggggaaaacaccataatcggtgctgccaattatagcagtcactagccacaggtggttactaagcatttgaaatgtggctagtgcaaatgagaaaccaaattttgaattttatttaattttaactacttttaatttaaataatcacatgtggctcatggccaccagactgaccagcacaaatttagactcccaagggctgaagggaaaatcaggagaaataagcaaagaaaagggaattaaaaattaagatgtattattagttatttagagaagagagaaactaatttatagcacataaaagtgttgccatacaataaaacatggaatgctttcttcaattaatttatcattagcagaaatgaatatatatactgatcaagggctcaaaatttagtcttttactccaaagcaaaacttaatagacttgagtactcttccaggactatggagaagtaaaatatttaaataaatactgtataatgtttccttttaaaagttgtttttcaagtaagagtataacacttattgtttctcaacatccacaaaatttaccattttcccaagtcactaaataggaaacaggtcaattttcaacaatctacttcacagtttttattactgatgccatagtgcctatttcattgaaagaaacactggaattaacctaccaacaccacatggcattaccagtatccaaatctcccaaagattttacacttctcccacccccatcagctgtttcttaagcattaagcatttcagagtcctttgactctgaaaacaacccgacgaggccttttaataagcctttaatatttgccttaatatacagaaacaatgtattttttctacacatagagtaactgctattagatacttgacaaaaaaaagtcagatgcatttactctaatcatcagattagcctttaaaatttgaaatttcaccataaattctcatttaagtatgaaggtaagtgttgaatgtatattttagtgatgtttgaaatataattcttagtatttaattatttagaattattttgcttctctgcataattcataccaagatggcctaactctataccgtttgctaaataacttccaaagtcaatcttatagaccatctagattaagttttaactccgcatttaactgttatcaaaacaaacaaaaaaccctcaaccatttcaatggactgttggatgagagaaatgtgtattcgcatgccagcgtagtcaaaaacaaagaactcgtcatttacattgggtgtatctcctaatgctttccctcccccctccccccaccccacaacaagccccaatgtgtgatgttccccttcctgtgcccaagtgttctcattgttcaattcccacatgtaccctagaacttaaagtataataaaaataaaataaatgctggggaaaaaacaaacaaacaaacaaaaaaacaaagaactggcatgaccagtacaaattctggttgttaaattactggtctagaaagcttagtctcaaactcaggaacactaaattcacttctttgttcatatgtttttataactcctttctaattataaaatgtacatgtgctatagaaaatgtagaaagctataccaaaaaaaagaaaataatgtaaatccccactgctggaagataaccacagataatttgttaaatttccttttatgccttttttctacccttgtatgtgaatacatatttttaaaactggcatcaggtggtatacagaacataggttactgcttgtgttcactcagcattatatcttataacctactgaaaaaaataaactttgggccttctaagaatatttgtagacatttataatagagttcaaaattttttctgtccctctttacaaagttatattttcttgagtaaattatgggctatcatataatttaatgagctaatatagaagtgtcttctatttagcctggcacatagtagatgctcaatattatttgagttctttctcccagctcactttctggcacttggtccataacttttgggccttttaaagtaatagctgatttttatcattgcaggtcagacagatgaaggatttgactgtagttataaccataaaaatagttacttaaatagctagctcctctttctcaaatcccataaagaatttggaatagcattagtatgggaaaccatagctatgtctcaaaagcacagctaaaatgtcatgcatacacaggtttaaaaaactctttgcttaagacttggagccaacccaaatgtccatcagtgatagactggattaagaaaatgtggcacatatataccatggaatactacgtagccataaaaagggatgagttcacgtcctttgcagggacatggatgaagctggaaaccatcattctcagcaaactaacacagcaacagaaaaccaaacaccacatgttctcactcataagtgggagttgaacaatgagaacacatggacacagggaggggaacatcacacaccagggcctatgagcgggtagggaggggaaggacagcattaggcaaaatacctaatgtagatgacaggttgatgggtgcagcaaacgaccatggcatgtatatacctatgtaacaaacctgcacgttctgcacatgtataccagaacttaaagtataataattaaaaaaaatttgctttacagataaattcacacttggaaaaatatactcattaggcaaagcatattccaaagaaaagagtctgctaaacattttaaacacacattcaatgaaatatctctttgacctaaaattgttcatgttatgagctaaaagttgctattaagaactacctggtcatgacaaagtcttttttttcataaaagataggagatgaggcaaagctttcaccattgctagaatctcagcagtctatacaggaactgctgccctccttgcacttctctcaataaagcaaaacaagggaagccttctgggagtgattgataaagatagatagagacccagttatcacaggtttatcttctaacttgtacacaaactagtataaggattatgttgcccaaagagaacatgtggatgctacctgcagatatgctacatatattattggatttttctaaaagaatataaagaacgaagtataattttcctggcagtttgcttaaacaattcaccaaaatagccagttagtacagataactgaagaaaaaagccagtgaaaggaatctaaatattgtacagactagataagtgacatcctgcatgttcatctttctggtcatatacattattcccagagtactttccagcctttgtttaaaacacaaaaacatggattggagaaatcctccatcacatgcccacctccctaccaaggcttataagggactccaaggaagtcaacatttcattttaacataattataaaagacaatatttgaagcaattacttctctactctaggaagacggtctaaggaatttcctaaagataattctgaagcgtacattaagttataacacaagggtattttctaaaaggaattaacattgttttccttttttgctatccatataaaagtttcagtccagcaaagctaaatgaataaccacaaaaattaccataagtgctttctcaactggtagttgatctcacaaattggttttggagtgcatagctagatgtactaaaaaaatgcactagatcattcaacaaacatttaaaaatgtgatacttctctcatctaaaaataattatataatatttactaagataactacataaaattaccaaagggggaaggactgatttaaagctaatacaatgtattcttctgggaaatcccatcatatttctcaattaatatatttagaagggacaaaacattaaactgctgtttgaaacgaaccgattgtaaaatgcagaaccatttaagcatttagtttatttttttaagtgacctctaaatattttccattgatgaatttctaattgtttttggcctaagtagtctgaaaacaatacacagatttagggttgcaactaaaaaaacgggaggatttctaagtgaatgcttttgaatcctttgttctcattatacatcagaatgtctgtgtacagcagttaaggcataaaggaaagtaaaaatgcagttgaatctcaatactgtattttgcttttcagaactgcaattcttcaatttacattaggcatttaagattgttcaggaagcaaactaaaataataaaacaaaatgtccttaaatgtaatctcctttacttctacatcacgccagtgtgctactgggtatattatatatcctcccaatatatatttaaggaggtggtatgggtccaatagtaagaaaattttcttattttttcctgacaatattctgctaaaaatcatttgaatatgctgcactgtgatgcattacaagtttggtagatatcagtattcaaagttatttaaacaaatactccattgatggtataaaaataaaaccttcaaaatgcataagaccaaatatatctatatttgctatttttacatgtttttaaaggtacagtattaaacataaagctgtccaggaaaaattttcctcaaaaagaaacgtactaaaattctatatgtagattcttggcaatattgttcataatcatagtacaaatggttcataatcacagtacaaatgtgaagcccttcaaaaataacatcagttgtgagctggctaaaagctaggagctgaattctggcggataatgagggcttcttatatttactctctatacttttctgcatttctgaagatttttagccaagaaatggctaacaaaattcaaataatggaagtctatatattttaaaaacatttttaaaaatctgaatcatccacagatttaaagggaggtaaggaatcatgactacttggacaaccaagactgaaataagttttctaatttttttagaattcaagtaaatctctaaaacaaaggggaacttgtccttcaaaaagaaagaaacaaagcaaacgacaaacactccaatctgaaaaatcctcagagtaacagaaaatgaatcttttaaaatgtgttgtgattggctcccaggttcaagcgagtggctcaaataccaaaaatctgtgaagtgatgtttcatttaggactgaataaggtttttctacctccttctattgtggagacaggatcacaatgctaatgttaccacagggcatggaaaaagcctgccaagcatggacacaatcttattgaattgtttattaattcatttcttgagattcacaaaacagtgtaataaaaactttgttcagttttgcaagtataatagacaatcaagttttcactttagtatcacttacatagttaagtaatgtcaatttttaatgtcacctagggctttatagctaaaggtgaaaaaaacgtattcctcgtcaggttaaagtagtatagatttttagaaacagccacaaattaattttataaactttatgtgcaacatactaactggaatccataaatcagtataagtaatttggcccaataatttatttgcaatgaatgtatttaattaccatatatttttcaagcacaattcaaacatataccacatgacaaacagaagaactactgcgtatctaaaaaagctattttaacactcaaactacaactgatgaaagttatacaatcttatcttgaccactattaacacgtatttcttcctagttcatgtgtaaggaaagaatacataactgatagtttgaacaaattacagtagagtctaagctttctaaataattttgtaatcagagtaaggagttttcaaaagctaagtaagtcttacctttatgtagccccaagacactgacagtaaatagtttgcttcaggcatttttgattgattatatgtatatatatatatatgtatatatatagtaagctctaaaatgtatttagcttcaaaatctcgacactttaacaacctccacaagccacgcagagtatgagtttttaaagatttttggtaattaagtatacataagaaagcctcgcattaaatcccatccagccgtcttcccatcgaatacatgccatttgtaagactccagaatggcacaaaattcagcaactattctgaataaagaaaatccacgtgataaaggaatatctaaagatctaagggtctgcatctttctctcccgagctccagggcttaatgaataatgtatgtcaagatgcttagttgcaagaaaggctagtcctgtcaaaagctaccaaataaggaact

SEQ ID NO: 265 - DNA, 70474 bp, Homo sapiens
ttttatggtatcaagttaaaaactctttaatatctcaaaatatcttatcagattgaattatatccaatatcaatttgatggctatattcaacacatattaagaacctactgtgtaccaggcatagttttaagtgctagtgatatattggtaagcaaagaccttgctctcatggagctgtggtctggtgggagagacagataacaaaaacaaacacgtatataaatctgtgagaagtgttataaagaaaattgagcagggttatgagaataaagctacagaatgggggatatctcacacaggatggttagcaatggctctgcggctccaggccctgcctactctctcacttttcctcagtttctccagatgtctcaagctcatttatgcctcaagatctttgcaaatgtttcttgtctggatccccttcctcttcctgtcaactttttccctagttacctcttacaatccttcagaactcagatgcaaatcactttctcaaggcctcaaggaagccttctgtggccctccggaacagatcaagttcaggttcctgcttatttaccccactgagctccttcattgtactgatcacatatataattatatgagtattgtttaagcctttgtcccctccagactgtaagctccatgaaagcaaacactgtgtctcattaacttattgttgagtccttaaaactttgtagtttgcggagtaggtaaccaaaaataattgtcaagtatctgaataattttcaatatcccagaatattcaattaagtaagtatggaaggcccctttcaaagcttgcttagaaaacaccatgcttaatcttataggccatctaagtaattttggtaatttttaatgtagcaaaattactcaagttggctttatttggttatgaatatcagtactaacttatgatgtcactatcctttcatttcaaccacgttcagtatcctaagagacatgctgattgaactataatttaaaatgaataatcttttatttgtaaaagattgagtcataaataggcagaatcaacccatgcttttattttcattgcatataaaaatttcatatgaaggtattgatgtacagtactatccccgtgggctgtaagagaggctaagaaaccactaaaagaataatcatttgtaattctcacacacaatttaccactctgaaaatatatccaaagaaataaaaacaactcaaatcagttaaggatgtttttgtaattatagtgtcccctttgtactgtttaaaacaaaagtaatcaaattcctttgggccagggctgctaaaatctacagtttgtgtcaaaaaataaaataaaataaaataaaataggctcatttttcctagaaaaagaatctttcctttcactgaaaagccacatgattcaagggctgggcaagtactgggaggatgtttccatataatccattataaatgtttcctgctttaggggctggccattgtacaaggtgaaattttaaaattctaaagcaatgaaagttttgcagaaacaaatcttagaggatagtgaatgctttctgctatgtaaactgacatcaacccacctttgcgtttaaatagatgggtttacatatatgtaaggacatttggtttatcttagtggaagaaaaattttaggattaaaaaacagtattttctctttaatgtattctcttaacatgtcaggaagctgatgaatagataaccaacacgagtaaactctggctccaatttcaaatcaagtccattttcctatgagctctagaagccaaaaggacttaaaaaaaagaaaaagattgtttataatcactgggaaagaatatatttccccagttgtgtttccgagttaaaaaaaaaaaaaaaggaaataatcaaatgcaagtagctgaagtagttcctgatcaacagatggcaaacaaccatcacacatgcagtgctgctccctggcaagaagtacttaagagcttctgtctcaaaagggtctcagaatctttcagaggttgtctgtggttttgtaaaatccacctattggcagaattctaatcaattaaaagcctggatgtaaaatgcccagccctagctccactgttacctttcaaatgcagcaaaacagaagaaaatattggttaaagttaaggcacagccctgggaccaaagacctgcagctatgtttttttaaatttatatatctttaagtattttatagttttcttgaatcttccataaacaagctctaaggtgacaagactatattacaggagaaaagaaaaatgtacagagtatgtatacacaccattcattctctcaccaagagtttccaaatatatcaacaccatcccatcatgggatgatgttttaataagaacagataatttacaattaacattacagtatgtacattgcaataaatacatggttgtaaacagacaaacaagactgtattacaggtaaggtcatttggtgagaaaaaaaatgcatggcacaaaaaataaataatgcattcaaaaattatcataaagctttctgtaaaatccatttcattcaagttttttctttccttgtctgtaatttgttctatctacattattgtgaattttaactgatataaaacaaaattaaaacagcattattgtgttcagtaacttgcaagctgaaatgcactggttttacacaaacttggacatttttttccccatacagtacccagatattgcattttcttatggcattttaggaaatgtaaagccacttgtaaaaggatattcttttattcttttttaaagcagtatatatttctgaagcacactttggcaagagagaagggcaaggataagcagattgtacagtgcattagtccctgtctcttggatattgagccttttctgcaatttgattgtccattagtgggtatctttacaacacggtaccattaaaaaccaacaaactggaagaaaaaaaaagagcctctctttattagtgcagttataaaccctttaccctttcaggtctggatttgttaatgacatattgctgctttttattttattcattattaagattctaggcactctgtgggggaaatactaagtgtagggaggagaggaatgagaatgttttggaaagaggaataaactctagactctttacctttctttctagacttcactcagggacaaataaaattaaaagaaacaagttcccaaatattcttgtgaaactacttggtcaaacatacgtctttatttttttcttatttgaaagattaccatctgatctttacagaggaaacagagtagaaaccttgcaattaactagttgattcctcttctgctttatgtaaaagatcagagttataaagacataatttttatttcaaaggatctaagcatcagctagatctcaggggactgaaatggggactctcttcagcatgagtcatttgcctggctgatgacttactttccagtccccaggaggctccttgagaagttccacatataaatgcttttcagagttgtaattcttcttaaacgtttgattttccacttgtcagatacccactttggcttctatctatctcaattcttgaatatcaatgtgaaaaatgattatttgggctttaaagtcttcatagagaaggtaaagaagactttattaaggctgacgtggggataaagtcagaattaaatgccccatgatgccaactgctataatcaggtaaacactaggaattaatctctaaaactgtaatacagttcctggtgctgaaatcagccaagagtgatctctaattttttatttaaccagaatttttaccaatataataaatattttaggatgcatcacagtactaaccctctggtgccagtggcatcatcttctttccctccatgtgtttaaagaagtagttcccctctgcaagatatgcttatggatcgaggataagtgataaaggacttcctacacgttatgtggctgtccattaaggaagagtagttgctacacttaaaaccgtttctcagggatgttcctgatatagttcttaatcccatggtgaaatcattaaaaccaaataggattagttgtattggtgtttgttaatatattgttaatattcttaaaaactgcctagttggctgtttaacttttctctgtaaaccaagagtaaaagctagtcatgatatacaacctcgtggttgaaatgaatgttaaccctaacttaactacctgtttcttttcaccggtgacaatggtagtgatatatttgacaagacctcatctagcaaacatggataaggttcagacacacgctaaattataaagcagcacaaggggaaaaacctttttcttactataactggctgtaaaaacaataaaaatgagcatgaaatgtgtggattattagagcatgaaatgtgtggattattagaaagacatgcacttgtgaaatgaacatctagtgacacagcaaaacgttattaggagatactaagtaggaaaacatctaaaaaagactgaccattttagctactgggtatttatatatctcccacttgcttcagacaacacgaactgatgactgagtttgcatgaagcttaagacacatttgatataacacacataaaagtattatagaacaaatagtcactttgcacatgaagaaaaacactggtgaagagcaactctgcttatctggaaagagtgaaacaaaatgcaaagtaaataataaagacttacaaaaagggtttcctgcaacataaagttgtttttctcttttaaaatatggaagtcattggtatataaaacaaacaatgaatcactacaaatcagttaattgctatgaactataaggtgcaagtaaaattcataaattagatttttatccagtgtagcacagatttgtactgaaaacttgcaagttactccttagaaaaaaataaccagtggcagatgaagttctgaacatagttttttttaaatataatacctcaatacatttaataataaaagtaagctctacaaaaaatctgttttacatatcatacaaaatgtagaggtcagtgcagctcactgaaccacactattcagtcatgtatcaggaagacttgaaattagaaaattatgcaatttctgtggctcatcctcctcctactggtaacagattcgtgctatgtcctgttcttgacatatttgttgcttcgtccattaagttcactctgtgcaatgcctttcttctgaaaatattgcaaacaaataaaaaggaatagaaaccccaagtccaataaacttttgggctgcctgatgagtcacactctcttgaaaataatttggagtagattttatctgctttgtcagctctaccaagctgaaatcttgttaaaaacgctgttcgtgaagatgtccaccttgctcggatgacatggaggtgaaaaaactggttacgatattcctgagcgctggactgagtagtcaaggtcagttttgttcaacaaacgtcctggcagatgacagtgaggtgtgaccgtggttgtggcatgtgacatgcactttggaaacaatttttctacttaaaaaaaaaaaaggcatgaaagtttttgcactgttacgtgtcaggagaacgatcatctatgacacaggcttcaggctggctttcctcttcttcccctactgcctcctcttcaacctgttcatcaaggggaatttcagtagactctgagtcttgagtacaaagagtcttggagtcactgcagctagtgtcttcttccacttgactgccactgtccttttccgtgtctgactcaccatcttcctctaaagttagttcaaactggaatttctcagtttgaccctgccggccctcctctgggtcatcaggtgcaggagaggggctctgagggattgtgctctggtaccattcacgattgtcctccaaagtgtccaaaatatcctgggcgtcagggtggacgaggtctgcccatgtctcccagaggggatgaacaatatagtctatgaagcccacctagttaagaaaaaaatccagtatgagtagaggacttgggactaagaaacaatggaaaagcttaattagatcatggcccacaaataaaacactgaacagaagactactaaacttagtttggtaaaattgtcactattttcaacaacaacagaccatttaaagtaaagtattgctactagctggtcaaaattagcttctagaacctttggttaaagagcatgttctatagcataaaaaattttccagttgttgacatggtagggcttattttacaatcaccaatttgtaggtgaatccagataactgaaataatgccatgtgctctatgtatatgaatatattaaatgaatatagtcataataaatgaatatgtctttagaatatatatatgactatatgaatgtaagtcataagaatgaaagttctttggatcataaatactaaggtgaaattgagcttgtcaaaaacaaagtaattttaaaaatccagtaaaatactatcatatgtaatacaaagtaaccaaatgctaaagcggtagctctgttctctctgaaagctatacacttcatgcattacctgtgatttttccacggaagcattgtgcttgtcacacatggggcttatctccatgccacgttccctctctcggtctccttggcggaagaactcctccattatccggtccgtccactggcggtacagctggagaggctttgttgggttgctcagatctgcacagtgcaccatattctgaagaacctaaaatagatggatgcattctctattcactcctgttccttttttttaaaaaaaaaaacaaaaaaaactagaaattcacattggatgactgcaacacttaaaaatacacgtagtgtaagatttattccaaacagctcaaccatgatgtgtctgtgtatagttcacacttgtattaatagttccaaattatgccacttctactgcatctaaatagcttaagagaaactgtttatgtgcatggctgactagattcagagctgcttaagtggctggttctgtggggtgtttgtttgttagtttttttaattaatgtagatgcaaacagaaagaccagtagaattttacctggttaattctcaggaataaaaatttggataaaaatcctgcctacaattgctgaaagtataaggtgggagaaggaagaaatacatcttatcaaagctgaacacgcagacatgtgcacatgtgcacagacacacacacacagagcaaactcaaacaaggctttacctgaatcctatcggaataattatcaagaagaagaactccagagcttgtcactttcttagtttcaaccatagtcttcaaatcagccagtagattcatgtgttttgacatatctgttgcaagtaccttaaaatatagagtatattattaagttcagagaaaacagaatttacacatgaaaatattacgcagaatataagaatgaaaaaggaataaaacaacactatgccttttaatgacagtggaaaatccttactactccttgggggcagagtcttttcccctttgctatcaagttttcccaaagcccagataaatgtgtgtaatatacagaaatgctaggcactgacaaccactttcatggtgaaaaatgggtgacatctccatggataagacatcatcacaagtttataagtttttgaaagctagagattttcctgtgtctcataatcactgaataagatgcatagaaaaaagagtaaagtcatggatgtctaaatggcactgtctactgatgagaaaaggtggggaaaaaatccatttgagctgtggcccacacaatctgcttttgttagtcatttttctctgcccgccaccagactggaggggcccagaaaataaatgatgagggtgagctgacattattctcaagtccaaactgctagaagtgaaaaacctattacagaacatcacagccagcatcacgggcagcttctataacataaagggccataatatgttttgaaatgcagttccttttacctaatactcatcttgttcttatgtctaaattataaacaacttgcatcacagttctcttctttggcttttatcagctacttacgatgtcaatgaccattttccttaaagattgtctttgttttttggtcaaattctggaaaatgtcacagttttcttcctgaagcaatttaaagcccacagccaaatgatggttctctaagactgaggaatcattgtacatcaaggcaagttcagagtctgtaaaaaagacaaaaggccaaagatcagcaaaactgtttgtgagaagtttatctgattcttaaaattctggatttaggatgtaatttcccctaaacttctctgctgcccttatcattacctgacaatatccaggagagaataaatcagataacataagagcaggaacaacactggaatgaatcttggggagtgaattctaatgctactaacatgtggcaggtcatttcactctgtaggtctcagctttctctaaagtgaaagaattggatctttaacctctcctctagagttgccatgagctcagcagaatatgacattattcttagtatctataacacatccagagcataaggttttgtattcctgataactgtgaattacctaccctgcactatataaagtgaggatcctgtgttacaggattgtttgtactcaaagagggtacaagaacaataaggaatcatatgaacaagtttagatttgctcatttgctcatgtatagctctgaaagtccaagctttattcattgttttccattttcttttccaagtatcgtggcagtcattgtatactgtacagggatattgctcttcctgcctgcttgctcacagcttcacagtgatgttgtgtttggctgtctgtataccctctggtgaagattctgccactctctccctactgccctagacctgtgaattttaggcagggagagattctgcctctctcctacttcttgtaaatagcagacccagagctacaagataatcattaaaaaacttttgatgctttattctctttccacttaatcactgtaaagactaaaagcaaatccgaggcaggaggattgcttaagcccaggagttcaagaccagcctggtcaacatagggagacctcatctcgacaaataataaaaaattatctggggatggtagggcgtgcctgtagtcccagctacttgggatgctgaggtaggaggattgcttgagcccaggagttcaaggctgcagtgagccattatatcgtgccactgcactccaaactaggcaacagagcaagactctgtttcaaaaagaaaagaaaagaaaagaaaaaggttaaaagcacaggtatttgatcttttttctaacgaatgcatagaaaatatataacgaatgcatagaaaatatatttggaaatatatatctttttttaagaaagaaatacccaatactattcaatggctattttaatggagctaggaaggagaggagaggcttaagacattttcaactgagaaattctattattttatcggaactatagaaatacaaatttgcacacttaaatttctgctcccaaactacaggagcagagctgtttagactagtagggagtaggtttgtacagtatttttttgttattttttgttttctttagataaaacaatagtgtttatcttttaaaaggcagtttctggtgaacttttatagtgtctataaatgcctttatgaacctttatctacagataggtaagcatatagaaatgaaaaatttaaaactatataggttcttagcacatattattgtatttctacagtggaatcaaataaacaaacatatattgaaaggaaggcataattattagatactggataattattagagttcgtttaaggaaggaaatatgcatgtagacaagcagtgttaacagaattgacttagccttacaaaaaccctaattggcttatatgaagctgaaggtgaaggaaattaaggctgttgaccctgcaaaagaataagatgatgagctcttccttcaaggaaaagggtgatctgttgtatggaaggtgcaacaaagagtctgagttctactggatataagtagggcctttcatgtagggcagatgtccaagaatactggcaaggcctgtcttggagagtggttatctcctgacacttaaagagtccagattggctagaaaagccaggaaaggatgccttagtggactggcaggcctccatagcctcttccatctcagatgctgttacaggaaagtggtggtgactgttgatttttaaatgaacaaatgttagcatttaagaaactgaatctcaaggaagttatttaactttctactcttctttaggactgaaggcatatggtcacatttaaattgggaggtaggagtctgcagctcctcagcagattttcatcaaagacactaatccattacttgtaagtagagtccttgaaggttcaggaatgatcagaaagttgctgtcaggatggtacagtgcacagcacagaggggcaaagaggttagcttatataacatttttgttgaaaccctttcatcttcaagcccaatataagttacctcttccatcaagtctttcttaattaccagatgaaactgcccactttctcctgtaaacttctatactactttgtaccacccatttagcatgtatcgcattctaccttttttgtctttatctctacaaatcttttaatcgttcctccccaaaccctcccaacctacttagagacttaagcccctacaaaatattaaaggttattaatttaatatgtttggttatctggcttcccctaggcacttcaattatttcaaacttacaaagtacaaacaggaatacagcaaggcacaacatttagaggatttaggtgccattgtgttaaatggtttatgtgaatcatctcatttaatcctcataactcttttaggaagatactgttgttatcgacattttaaggctatgttccattcatggatggcatggagccatataggtgggaagtaagtctttgtgtccttgggataggctgggggatagaaaatgtcccttggggacatcttttatacacataaatatttacatagacatactcatataatcctgtacaaatgaagaaaatgtacctcagagaaggtaggtaactttgccaacatcacctagccagtaagtgctggggccagcacttaaaaccaggcagtttctagagccctcaccttatactgactatgattacaagtaccttatagaggtgaaaacctgagcagtgaacactaaacatgaaccaggaaatcaacacagtccactcagtgcctggcacacatttataaagacaactttgtaagtatttattttttattgagaggccatgcatacctttacaaactcaaagccatcattttattatatatagatcaattgtgctcatttgttacaactaccctggatcatcaagaataaattaaattatgcccaacatatgctactactgaaggcaggaagaccacttttgtgtccctctcttctgagtgctaatgaaatggggggaagggtgggcaggtactaccacataactgagaacatgtacttcatctgtgctaatcttttctctctctgtattaatcatggttctccagagaaatagaatagacatatgtatgagtgtgtgtgtgtatgtgagaaaaagacacatttatttattataggaattggctcaggcaattatggagtccaagaagtcccatgtctgcaaaggtgaaccaggaaagcaagtccaaaggccagagaatcaaccaggaaccctgatgttagaggcaggagaatatgtatgtccaggctccgagaaagcaaattgcccttcccccaatgttttgttcttctctttgaggtcctcaatggattgactgatccctgccaacaatggtaagggcaatcttctttaatcagtctaccaattcaaatgctaatctaatctcttccaggaacactctcacagacgcaccccaaaatagtgttttaccagctatctgggcatcccttagcctagtcaagctgacacataaaattaaccattacaaattctgccccttgtcaccctggtacccataagcatctcctttaaccatatttaatctccataaggccataattctaccaaacaggctacaactatcctgcatacaactaaaagcacactaacacattccccagaagtgaaagtaaagtttttgagtaatgtttactcttatcctgatagcctataacttaaatactatgatataaaataaatacttaaatactaatataaagttaatacctcttatgttatataagggaataagaaaaagaaaatgaagataagttaatacctcttatgttatataagggaataagaaaaagaaaatgaagatatatgcttaatatatgtatatatacatataaatgcattcataagaaaatactcatgacaattatagtccttatttctataactggtcatatggtcatagctggtatttgtaattaccttcttttactactcattctgtattcccttttccctcagcaagcacctcagctggtcatgattctttacctggtggggtgaccgaaaccttcattcgtgaagggtatgggttattagtggtcctgcctggattgggttattttgtgctgaccttaattacagggcatggttaatactaagggatgccctaagggatctccttattccacacatactcttccttaccttcattgtggagtagtaacccaatttccccttggtagtcaggatcagtcaccccagtcaacactgtaatgcccttcttggatgattgaatcagatgcataaggagctcaaagtggctaggtcttaacttccagttcaacggaatcactgttgtgtctcctgatagaagcattcctccttctgaaactaagacctctagctagcagcacataaatttgcaggaacaggaagcaaactttgctagtgggtcactgggggtaattatgagtcgtaacagtcccatttctatccaatgattcctggacccatgaattctggttatgcgagaaatagcaccacatattggatgctgattcagagcatatatggcctttatggccttctggagaaccttgccccagccctgcaaggtcttgcctcctagctgagtaactgagtcttcaaaaggccattctaccaatttatcaagccagctgattcaggatgttagggaatatggtaagactagggacttccatgggcatgagcccagtgcagctcttctttgccagtaaggtgagttcctggttagaggcaatgctgtatggaataccatagttttggcagaaaaactgcagggaaggcacatctgtttccagagaaagtgccttttccactaaggacaaaatgctaccctttccaccatggaagtggtccaatgtaatcaaccagccatcaggtagctggctgatccccccaaaatggtgttatatgggggttcagtgttggtttatgctgctggtggattgcgcacttagcaatagtcatagccaggtcagccttggtgagtggaagtccatgtttctaagcacatcctgccacctccatccctgccaccatggccactttgttcttagcatgttgggtgatgacaggggtggctagggaaccaagttgactagtatctacagaatgggtcatcctattcacttggttattaaaatcctcctctgccaaggtcacactttggtgagcattccttttttgtccattcagagagatcattcacatatctcttccccaaatttctttctcaccagttttccaatcatattccttctaagtccctcactatccagacaaatcattggctacggcccatgaactggtatataattgcacatatggccattccctcttccaagcaaagtgaacaacgagtcaccttgcctaaagttcttcccactggaaagactccccttcaccaccatccttcagagatgtcccagagaggggcagtagtgctgcagctgtatacttccggtggtacctgcgtatcacgcagaaccatccgtaaaccaggccctctgtcaactacttgcagggaactttccatgcgaccacatgtgtaggctgggagaaagaaggcagtgtaattaataggagtggcattagggccacttctttatgtaatttgtgcctttagtgtctgctcggacctgatagatcgtgtattacactacttttatttgatgatgaaatgtcgtacatgcccaacatatggcttggcgcgttagataataccctattaatgatgggcagacagcttaaaccacatggaaacttggtggcccatagtcagtcagtatctcctaaggcccagcagcaggcctatatctttctttcaaaaggagagtagttagttatctttctttggatgatggcagggtcttgctccagagtctgtgctgtgattcacacagagggctctgtcaaaggctccaaacaacattcctatctgccactgacatttcaagcaccattaaatctgctggatcatgtggcccatgtgcagagcagcttgcacagcaggctggacctgttgtagagccccactcaaaactagcagtttttgtgacactctcttgttctgtgccccatctaaactagcagcttttcagatcacttagtaaatgggccagagtaacacacacaaagaaggaatacattgcctcccaaatccaactaagtccactaggtattgtgcctttttgtgtcttatgatggagtccacatggcagatcagagccaatattaagacctggagctgaaacagttaagactggggcagacactatagatatgtatcctgtaagtaagacttacactcactgttcttacagctttactaggcttagccttgagttagttagaaaatgacagcatgctacaccatgtctctaagttacaactgaaataaacataaatcttcaaaaggacttcagaaacaaacatttctccatgaaatgacagagggaagtggtggttttaacttaatattcagttgtcaagaaaactgcctcattcatcactccactctctatgccctcaccctgcattattttcctccatagcacttagtaccatcacatgccataaattcacttattatgctccaccttttctagcagaatgccagctcttaagagccagggatttgtcttgtcttgtccacccatgtgtcctaagtgcctgaaataatatttattataacatttagtaggcttgcagtacatttttgttgaataaaataatctctgtagctatatctatataatcacatttgataaacatgaatttatccttattttgaaggtgtgggtttatacagaaaaataaaattctacatacaatctactagtgtagctatgaaaattttaatttcaaaataaaagtagagaaataaaaaagtgtatactgacagctagatacatcttaaccttaatataatgaaatgcctctgctcttggaaaccaaaaaccgcatgctttgaatgcatcactaatgtgaataaatctttctgccccaaacttaggcatctttgctattaacaaaaataattcatttgccaagtaaaatttaatgctatattctgtacttttgatactttttttcagaaaataaagctaagttaaatataccctccagcattttatattcaaaagttcatgctgctatttacattttatggatttatttatttatttatttatttgagatggagtttcactcttgtccaggctggagtgtgatggtatgatctcggctcactgcaacctctacctcccaggttcaagcaattctcctgcctcagccacctgagtggctgggaatacaggcatgcgccaccacacctggctaatttttttgtatttttttttgtaaagacagggtttcaccttgttggccaggctggtctccgaactcctgacgtcagtgattcacccatcttgacctcccaaagtgctgggattataggagtgagccactgcacctggcctatggatttatttatatgcatcatcctttaaaaatatttacgcagcttcctgcctgaaatttcaatttctctaaatcctgttcacagtacccacactcaaatcatttattatagcttaaccaactctaccaggtagaattgttctctctgcttgcagaacctccagcatgctttcaacgagtgtaaatacaattagtataaaatcatttggcacctaaagctaaaacaactgaaataattaagaaaaacgaagagcacatgtaagaagcaggaggattaactgccctgggaaccagccaagggaatccccagcgccccccatgtgccttaagctctcagtgcttccgtagcttccttaaagtaagacaagtaaccaactatgggtttataaatttgataatcagaggtctttagaattctttattatgagaaatatggattcagctgcaggctttggacaggatggcagctccagctctgaggcaagagctgagaatgtgctggcttgacacatggatgctcaagccatccataaaatataaaaagtcaaattttaaaaaaggtttactgcaaactaaaaataagcacaaattttgataaaatatttcacgaagctacatatcacaagtttacaagttattagaaggattcctttactgcatgctgggaagataattctcttacatgatccctagccaaaccaaactaactaaggctgtaattttgataatgccctggggcccggaacaaccctgggatactttcctgtacaaagtgacaatgctgattcattccctcaggaataacacagcctcatcacacctcatcgtcaaaaaaactttagcaatccaaagctactctggcaactgtgaacttccctatgtcgctgtggtcacacagaaaggagatcattgcaatattactaaataacaaagaaagaatttgcagcggcaggattagttatccttccatcccaggcaggtcaccagcaaaatgactttaaacagacatcctaaggagataaaattatcttcttcagtttcctccactatttcattggttctcaaactttagagtatcagattcatctgtagactgaggccttgttagcttaaatggcagactgcacagggaccctgatgccagggtcctccaggtgccagtcaaagcccaagtgccctttaaagcaggggtccccgatccatccatcggctgtggaccaatatcggtccgtggcctgtcaggaactgggctgcacagcaggaggtgagcagcaggcaagcccgcatcagtactgcctgagctccgcctcctgtcagatcagcagggacattagattctcctaggagcgtgaaccctactgtgaactgctcatgcaagggatctaggttgtgcgttccttatgagaatctaactaatgcctgatgatctgagatggaacagtttcatcccaaaaccattctctccctgcgcccccagtttatggaaaaattgtcttccataaaacctggtgcctggtgccaaaaacattggagactgctgctttaagggctcaaaagaatgaagaatagagcaggtcctcattacccttaaaaaatgtatcagagtacttggaagacagtgacctttctatcagttgttttaatttgtcttctaaatctactcttaattctaagggaacatataatatgctatataacagaatgcaaagaaaacataccagtttgaatgtttggtgtttaagatagatatatatatatacctttaacacaaaaattttatgtaaaaatacattttatgtatttactaaaaattgataaaattcagaatatctcaagacattcataagcatcaaaataaatcaggccaggctcatgtaaagtgccagcatgcactgtattgcatgacctccctgctcttcttagaaaggacataatgaaccctccccactgatacctccccactgataccatgtaaatgcagggagctgcatccaatgtatattaatatttgtatgtatgctttgatgagttctaaaagtacctcattataggtgctcataggtaggtagaacatgaaatgttatcctgtctaatctggataaataagttcctaaactaaacttgtaaaaaaatacttgactaaccacacatctcaggaaatccctgacttttccagtcctctacatggatgagtcattagagtatattttgctataggatagtccagaggccattataagatataaaaataggtaaataatcctaaagctctgaattaaatctctcaaagcaaggttacctctacattccttctttaaatctggctacagcaaagtacaggaaatgaatggtgaattcataaataattctatagctagattgctataggcacgagaagactattattcatagcctcaagcaaaaatgaaagaaaggtggattcttaagcatacaacattttcaacaactttgcatattttttatatataaaagtgaatttatgattttataatctaccataatttataatctaccatatgggagggaattaagtcatagttcacttaaatcacttaccaattaacttcaagtaccaaatagaatttctataaacctaaatctctttaccaagggatagctcaagcattacctaaacattccctacacaggctttctgtgcggcaatgtcagagatgctccatattaaacagtctctactattccttatatttccaaattcagtgatgacttcttataaggtgagatgttaacagtgagaaaaaaccaaatggttgaaaaaatattaagaagttcctgttacccttattagaagattttaaaaaggaaagaacaggggttgggcatggaggaggaagggaagctatggcctctgaagaggattaaatgatgacctacataaagtgaggaacacttaccattaattctcataactttttttttaatttaaaactttagggccaatacaactttctaaatctttctgcacactttcatttttaattacccttgtctagtaacacagcaatatattacttttaaagagaactggaacacatttttcaaatatcacatgcctcaagggatataatgataattttcagttaaattacattaacatgaactatcactaaaacacatatatacacatctcaaaagaacattatggctctggaagactctgagtttataaagacccttagtcattctaaaatgtacaagggaaaaatgtgttctgaaaaaataaagtttacttacttgtattgatcagaaattgattggacacaccaggatgatctacatcatgtattgcactggcaaaaattgctgcaagaatctccaaatctgtaaacacagcctggaaaatcagacaatatagataatattactattctacaatgatatgaattaaaagtataaacaaataagaaatctctagaatttaaatggaaaacaaaatgaagcttcaaaatgtgttacaatgtgtcaagggagagtcttagatacttgtgaacttttaaagtataatcttggaagaaaatattttatctaattttattacatctcatgatcaaatgttttccattcactgtattttttaaaatattattttaaaactctgaaattattttaaaagaaaataatagtttattttctaaatatttaagatgtctaagaatattctgaaaatgtacataaaattagtaagacattagcaattattttctttcatcgaaaccagggtttctcaacttcagcactattgacattttgggcccaataactctttgcgtgggaggctgtcctgtgcattgtaggatttttagcagaattcctggcctctaccaacaagatgccagtatcatgtacaactaaaaatgtgatagttgtgacaaccaaaaatgcctccagacattgccaaatgtccctggtggtggcaggagggaaagaaaggggaagagaaaccatctccagttgagaatcactcacccatatgatgaggtattaacataattttataatgaaaacaaactgaattataaaatatatttcttaagaaaatcaaattgctttagtaaacaactaatgaaataacttcttaggatttagaaaaattaaagtatgtccttctaatatattctatgaaaaaatatcaatatattgcttatgttttataaaacgttctttggcctataaataaaagccgtcagactagatttcaagaaaacaaatgaacaaaaagtgagtaagccagatgtgctttatgaaatgttcagtggatcatttcaaagaagcaatatcataaacagatcaatcactaaatctgtgaccaactttcataagcaaaatccatcaaagacttgattgtctattaactatagcattttcccccataagtcaataagttatacttccaatgaatccaattatcttctccattgaaaacccttcagataaaagtttaatagacctttatgagtggcaagttagtgttcttgaaatttcagaaacagatttacctccaaagcaggtgtagataatagcacatgagtagactggacaacatctgcagcatggatattgttgtgataggccacatcagcatggtaatggtcttcgagagtcataagatatgtaattaaagtatctactggaattttaaatgtttttaataaatcccgttcctgtaggaaaaaaaatcatcttaacatttttgtctttatgtgaaaaatttctccatagagtatgtttaaaaaaaaaaatcacacaccagtgttgccagtggataacctggaaatggcaactgcactctcacatgtctagtgaggaaaatgggaacctctgagaagatccagggactctgggacaaaaccagagttgggttgtcctgctggaacccaagaatactacgccctagctgtatggtgtcaggaatgaggtgccaactctaaaagtttctatgtcccattatcatggaggcagctccagtcaagcactattaactcaacccctgcatcacaccaactaaaaatcaacgtcctctctagggctgaagtttcccatttcggtcccgagatatctacagcagcctcaacttctcatttaaatcccaccctaagctggagcaaagggtcaataagagagagaaatggatatgaagaaagaagcaggacacaagaaagtgactgaaaaaactatattctaaggttagtagccagcaggggctttattcattttttttaagttagtactccattctctatgcagtcaggttcagatgactaagatgatgtctaaattattattttaataaattgcttcaatttggctatatcacatctttttcttaaatgcaaaaaaaataacaaaattgatgttatttgtggtttatccacactccacctttctgtatctttacttgtcccttggcaaaggagcaaataaggataaaagtataaaaataagcaaaaggtggggaatattaaaaaagacaaaatgtatgcataagctacagactggacattaagttcctaaataaaataaatgtaatagaactcaaccaccttacctgaaaaatggtgtgcatgataacagtcaagggccggttaccagacaactctgctattctgaaaacatgaagaccccatttgttcacatcttctagttcctggagtgaaaaaaaaaaaaagatactaaaatattagaaagtggagtaaaatatgactcaatgaacacaatcatttaaaaattacagaccttaggtggccgggcatagaggctcaagcctgtaatcccagaactttgggaggctgaggcgggcagatcacttgaggtcaggagtttgaaaccagcctgcccaacatggtgaaaccccatctccactaaaaataaaaaaaattagtcaggtgtggtggtgtgtgcctgtaatcccagctacttgggaggctgaggcaggagaattgcttgaacccaggaggcagaggttgtagtgagccaagatcgcgccactgcattctgcaatccaacctgggtgacagggcgagactatgtctcaaaacaaacaaaacaaaacaaaacaaaacagacttcagtgtaaagattgttagattgttttaaacaatgattcattttaaatgttaacagacacaccatgtaagcataggcaaactttaggcacatttacttaaatgtactgaaaattgaacagtatggcttaaccttgtgactttgacattacaacacatttatgtactttttaagtatcaatcacaaagcacttctttaatggataaaatctattcacaaaaccttaactgttttcctaaaacccagaagacatgacagatttctaactctttaaggccaaacaatgaaatgaagatgcaaataatcaccccccaaacccctaaaacataccaaaccacctgtctaaggcactttaaaaggagctttataaaatgccttcccatcttcaaaaaaagaaaaaaaaaaaaccccaattaataaacttttctatccatttaaaagactagaagtgaaaattcatgaaagggcatcatttaatatttatgatcctgatctttgaaatcatcataccttggcaaggacatcttcttgttcagttttaactccaaaccttgggatacttgaattagtcagactagagctgtgcatcaatttcttgactccactgatctgagacattggtcttttctttttctccttttccttctgagttggagaaggaatttccacttcatgttgcttatcttgagaaatttagaaaatgttctatatttattattaattctatctgttttatatcatatgcataattggaaggattataattgatcattatatattccaggaaatgtttccaactaaaaagtttccttttagagagttcagtatttacatttgaattggacttaatttgatgtcttcaaacacaaaattaagcaaataagttccattacaaaataataatatcaaatgtattccatggttacctctttgatacaatgtcctaataaaaaatgctgcaagacttagcatgacagcagactcagaatacacaacaggtggttatttccactgttcaattccattcctttgtgaaactgacttaatgaactgaatattgttcttgccaactaaggactacagtttcaatacatactttgaaatggtagaaactttatacgcaaatgtcatgaaaacagcagtatataaaactaacagctaactgaaatgggtaacactgtgggagctgaaacagcaggttttggatgacttagattaattctgctactttttatttctgtatgatagtgagataagggttaaatccccaggttttatgggagcatagagaatcataaatattacctgataagtgaatacgtacataagctaattgtgttctatagtaaaagacctaagatatcttcttactttcatccacgatttcaaggcagtgatgagcaactctaactcatccttatatatagaacatattctaagtgtttaataaatgttaactatatataacagcaattttgttttgaaagtaagtccaggatacattcaaattactgacctttatttactgcattttctttctgtggatgaggtacaagagttgtcccaggacaccaaactcagctattattagcaaacttttatttagcaattgtattttatctgcccaccagtttactaggcttgatgtacacaagacggtaaattcatcgagggcaggaatcatttctaatttatcattaaacacctattgcccaacaatggctggcatttaataagaatttgttgaagatatgaatagatctctctataaaatatattttacagtttggtactatgaaaaaatggcaatatataatcttaattcaagaattcctaaagtcctaaataaaactaagaaaatgtaccttgtcacctgcaactctaaaactcagaggcggatagtgtcgaattattaatatgacgaatgaaaacaaatagaacttctaacacttgtttggtttccaaaatgagttggcaccccaatcctcctacaaaaacaaacaagcaaacaactgaagaaaaaaatttaattgcatgttgttattctcacctaagaatgtgtttgatataaactctgacacttgatttccagaccgactcatttcagagagatgggtgagctcccgattaagcatccttttaaactgaaaaacagaaaagtaaaatgaaataatagaagaggaaaatttaagtgaaatatatatgcatactctgagatacaggaagatatgcccaaagaatttttaagttgtcctgacaatttagaacagtgccttccagcagaactttcttcaatgaggggaaaacaccataatcggtgctgccaattatagcagtcactagccacaggtggttactaagcatttgaaatgtggctagtgcaaatgagaaaccaaattttgaattttatttaattttaactacttttaatttaaataatcacatgtggctcatggccaccagactgaccagcacaaatttagactcccaagggctgaagggaaaatcaggagaaataagcaaagaaaagggaattaaaaattaagatgtattattagttatttagagaagagagaaactaatttatagcacataaaagtgttgccatacaataaaacatggaatgctttcttcaattaatttatcattagcagaaatgaatatatatactgatcaagggctcaaaatttagtcttttactccaaagcaaaacttaatagacttgagtactcttccaggactatggagaagtaaaatatttaaataaatactgtataatgtttccttttaaaagttgtttttcaagtaagagtataacacttattgtttctcaacatccacaaaatttaccattttcccaagtcactaaataggaaacaggtcaattttcaacaatctacttcacagtttttattactgatgccatagtgcctatttcattgaaagaaacactggaattaacctaccaacaccacatggcattaccagtatccaaatctcccaaagattttacacttctcccacccccatcagctgtttcttaagcattaagcatttcagagtcctttgactctgaaaacaacccgacgaggccttttaataagcctttaatatttgccttaatatacagaaacaatgtattttttctacacatagagtaactgctattagatacttgacaaaaaaaagtcagatgcatttactctaatcatcagattagcctttaaaatttgaaatttcaccataaattctcatttaagtatgaaggtaagtgttgaatgtatattttagtgatgtttgaaatataattcttagtatttaattatttagaattattttgcttctctgcataattcataccaagatggcctaactctataccgtttgctaaataacttccaaagtcaatcttatagaccatctagattaagttttaactccgcatttaactgttatcaaaacaaacaaaaaaccctcaaccatttcaatggactgttggatgagagaaatgtgtattcgcatgccagcgtagtcaaaaacaaagaactcgtcatttacattgggtgtatctcctaatgctttccctcccccctccccccaccccacaacaagccccaatgtgtgatgttccccttcctgtgcccaagtgttctcattgttcaattcccacatgtaccctagaacttaaagtataataaaaataaaataaatgctggggaaaaaacaaacaaacaaacaaaaaaacaaagaactggcatgaccagtacaaattctggttgttaaattactggtctagaaagcttagtctcaaactcaggaacactaaattcacttctttgttcatatgtttttataactcctttctaattataaaatgtacatgtgctatagaaaatgtagaaagctataccaaaaaaaagaaaataatgtaaatccccactgctggaagataaccacagataatttgttaaatttccttttatgccttttttctacccttgtatgtgaatacatatttttaaaactggcatcaggtggtatacagaacataggttactgcttgtgttcactcagcattatatcttataacctactgaaaaaaataaactttgggccttctaagaatatttgtagacatttataatagagttcaaaattttttctgtccctctttacaaagttatattttcttgagtaaattatgggctatcatataatttaatgagctaatatagaagtgtcttctatttagcctggcacatagtagatgctcaatattatttgagttctttctcccagctcactttctggcacttggtccataacttttgggccttttaaagtaatagctgatttttatcattgcaggtcagacagatgaaggatttgactgtagttataaccataaaaatagttacttaaatagctagctcctctttctcaaatcccataaagaatttggaatagcattagtatgggaaaccatagctatgtctcaaaagcacagctaaaatgtcatgcatacacaggtttaaaaaactctttgcttaagacttggagccaacccaaatgtccatcagtgatagactggattaagaaaatgtggcacatatataccatggaatactacgtagccataaaaagggatgagttcacgtcctttgcagggacatggatgaagctggaaaccatcattctcagcaaactaacacagcaacagaaaaccaaacaccacatgttctcactcataagtgggagttgaacaatgagaacacatggacacagggaggggaacatcacacaccagggcctatgagcgggtagggaggggaaggacagcattaggcaaaatacctaatgtagatgacaggttgatgggtgcagcaaacgaccatggcatgtatatacctatgtaacaaacctgcacgttctgcacatgtataccagaacttaaagtataataattaaaaaaaatttgctttacagataaattcacacttggaaaaatatactcattaggcaaagcatattccaaagaaaagagtctgctaaacattttaaacacacattcaatgaaatatctctttgacctaaaattgttcatgttatgagctaaaagttgctattaagaactacctggtcatgacaaagtcttttttttcataaaagataggagatgaggcaaagctttcaccattgctagaatctcagcagtctatacaggaactgctgccctccttgcacttctctcaataaagcaaaacaagggaagccttctgggagtgattgataaagatagatagagacccagttatcacaggtttatcttctaacttgtacacaaactagtataaggattatgttgcccaaagagaacatgtggatgctacctgcagatatgctacatatattattggatttttctaaaagaatataaagaacgaagtataattttcctggcagtttgcttaaacaattcaccaaaatagccagttagtacagataactgaagaaaaaagccagtgaaaggaatctaaatattgtacagactagataagtgacatcctgcatgttcatctttctggtcatatacattattcccagagtactttccagcctttgtttaaaacacaaaaacatggattggagaaatcctccatcacatgcccacctccctaccaaggcttataagggactccaaggaagtcaacatttcattttaacataattataaaagacaatatttgaagcaattacttctctactctaggaagacggtctaaggaatttcctaaagataattctgaagcgtacattaagttataacacaagggtattttctaaaaggaattaacattgttttccttttttgctatccatataaaagtttcagtccagcaaagctaaatgaataaccacaaaaattaccataagtgctttctcaactggtagttgatctcacaaattggttttggagtgcatagctagatgtactaaaaaaatgcactagatcattcaacaaacatttaaaaatgtgatacttctctcatctaaaaataattatataatatttactaagataactacataaaattaccaaagggggaaggactgatttaaagctaatacaatgtattcttctgggaaatcccatcatatttctcaattaatatatttagaagggacaaaacattaaactgctgtttgaaacgaaccgattgtaaaatgcagaaccatttaagcatttagtttatttttttaagtgacctctaaatattttccattgatgaatttctaattgtttttggcctaagtagtctgaaaacaatacacagatttagggttgcaactaaaaaaacgggaggatttctaagtgaatgcttttgaatcctttgttctcattatacatcagaatgtctgtgtacagcagttaaggcataaaggaaagtaaaaatgcagttgaatctcaatactgtattttgcttttcagaactgcaattcttcaatttacattaggcatttaagattgttcaggaagcaaactaaaataataaaacaaaatgtccttaaatgtaatctcctttacttctacatcacgccagtgtgctactgggtatattatatatcctcccaatatatatttaaggaggtggtatgggtccaatagtaagaaaattttcttattttttcctgacaatattctgctaaaaatcatttgaatatgctgcactgtgatgcattacaagtttggtagatatcagtattcaaagttatttaaacaaatactccattgatggtataaaaataaaaccttcaaaatgcataagaccaaatatatctatatttgctatttttacatgtttttaaaggtacagtattaaacataaagctgtccaggaaaaattttcctcaaaaagaaacgtactaaaattctatatgtagattcttggcaatattgttcataatcatagtacaaatggttcataatcacagtacaaatgtgaagcccttcaaaaataacatcagttgtgagctggctaaaagctaggagctgaattctggcggataatgagggcttcttatatttactctctatacttttctgcatttctgaagatttttagccaagaaatggctaacaaaattcaaataatggaagtctatatattttaaaaacatttttaaaaatctgaatcatccacagatttaaagggaggtaaggaatcatgactacttggacaaccaagactgaaataagttttctaatttttttagaattcaagtaaatctctaaaacaaaggggaacttgtccttcaaaaagaaagaaacaaagcaaacgacaaacactccaatctgaaaaatcctcagagtaacagaaaatgaatcttttaaaatgtgttgtgattggctcccaggttcaagcgagtggctcaaataccaaaaatctgtgaagtgatgtttcatttaggactgaataaggtttttctacctccttctattgtggagacaggatcacaatgctaatgttaccacagggcatggaaaaagcctgccaagcatggacacaatcttattgaattgtttattaattcatttcttgagattcacaaaacagtgtaataaaaactttgttcagttttgcaagtataatagacaatcaagttttcactttagtatcacttacatagttaagtaatgtcaatttttaatgtcacctagggctttatagctaaaggtgaaaaaaacgtattcctcgtcaggttaaagtagtatagatttttagaaacagccacaaattaattttataaactttatgtgcaacatactaactggaatccataaatcagtataagtaatttggcccaataatttatttgcaatgaatgtatttaattaccatatatttttcaagcacaattcaaacatataccacatgacaaacagaagaactactgcgtatctaaaaaagctattttaacactcaaactacaactgatgaaagttatacaatcttatcttgaccactattaacacgtatttcttcctagttcatgtgtaaggaaagaatacataactgatagtttgaacaaattacagtagagtctaagctttctaaataattttgtaatcagagtaaggagttttcaaaagctaagtaagtcttacctttatgtagccccaagacactgacagtaaatagtttgcttcaggcatttttgattgattatatgtatatatatatatatgtatatatatagtaagctctaaaatgtatttagcttcaaaatctcgacactttaacaacctccacaagccacgcagagtatgagtttttaaagatttttggtaattaagtatacataagaaagcctcgcattaaatcccatccagccgtcttcccatcgaatacatgccatttgtaagactccagaatggcacaaaattcagcaactattctgaataaagaaaatccacgtgataaaggaatatctaaagatctaagggtctgcatctttctctcccgagctccagggcttaatgaataatgtatgtcaagatgcttagttgcaagaaaggctagtcctgtcaaaagctaccaaataaggaactgcagggaagccgggaagagtgacaagaagcccctcccataaaaccccaactctgcaccaattgcattccagctcttagcctataaggcgagggggtgtggcctcggtgcaggctgctttgggattggttggcaagggccagcctctggggaggctttctcctcacccgacaaacgccattgaataatggtatccctgcagctctgaggccaccctgagaaaagatgaacggggcttccctcttgcagtgatgaataatgaccataaaactcctcaaaattcgtagttcattcttaagaattgcccatccttttggagggcattttctatgaattttaatgtcctctggcttcccttccttccaaataaaaactgctccaaaaatggcaatcgagcattttaattgcttccctctctcaaatccaaaacaagtggctccctggtgatgtagaaatgactgtagttctcccctcatccaacataaaagcatagggattaaacaatacgactaatgtccagaattcacagatggcacagatggcaatgacacattccctcacctgtgtgccatggctgctctcagctccttttgtttctattgttatgtatgacagagttctaaaaccttcaaaatctaggggtgggaccacttgcaattctggggggagggaaatgtgaaagctagggcactgtgtatgcataaggaatgcagtgttttgtatatagaactcaggatctgtattttgatcagaagagaatattttatttatttatttagagacagagtctcgctgtcgcccaggctagagtgcagtagtgcgatcttggctcactgtcacctctgcctcccgggttcaagcgattctcctgcctcagcctcccgagaagctgggattacaggcgcccaccaccacgcctggctaatttttgtatttttagcagagacgggatttcaccatgttggccaggctggtctcaaactcctgacctcaggggatctgcccacctcagcctcccaaagtgctgggattacaggtgtgagccaacgtgcccagccagaacagaacattttaataactgtacacaaagttaagaaaggaatgagtggctcttaggaatccagaattgagctcaagagtaatcagacattttacgaggagggttaaatgagaaatcaaagttctttctagaaaaacagcattttctatttggtttggtgtagtattaccctgtaactttaatactaaagaggtcttgtgggtgagaaacaaggaaaaactaggttttagttgattttagcatataattctgtgcattttacctcctctccatctcaaagcctgtgcttactactctgtgctttaacttgctggtatggctactctgcagtcttcctgacatttaactatttccacatgtggcatgtctgtcttagagagcatgctctctgataagcactcctgtaacactgtgtctctctgagtttctattggcctttagctgctacagtcctctgcttttgttaacatctgttgtattcatttccatcactcttactcctctacaaaaggaagaaattaaagctccaacattccactaaagctacccccagaggaatactaaggtcctccttttctctggtctccctacttctctgaagtgttccacatgtttgatcattcctactactctccctcaactcccaggatcctgaacttctttaattttccctaggcccacaatcttcaatgaccacttctaacttgaacttcagtgccatatttctgaatacaagattctcctctcgaatgccctgctagtcacgacaaactttttcaaaactgtgagacatttttctatttaaagtagttcttagtataattacttccatttcagtcagtgagcctatatttcttccagtatctcagatggaatctatgactctttcctaccattcaacaggtgtttcatgtgcgtcagacactgtcaggtgtttaatataaaccatctagctgaatccttgagtaacccggcatgttcccctatacggcatcaccttccctccttcattcaactttgttagcaagccctatcttttatccagagctgtttctttcagtttattccttaccattacccctcccgtaatctgaatccaaatatttaaaagactgagagaaatagaaagtaactttaatatcaccccctctaactccctcatttccacataaagttgagacctagagagaaaaaatgattttcccaggttcactctggtactgagaacaagaattgcaagtttaaatcttttgtgcacaatcactgacaaataatctttttagtgtgtcagcttcctcatctgtaaagtggattactgtggcagctagtctccaaagatactcttaatgagccacactgtcctacactgaatctgagttggcttgtgtaaccaacaagtgatggtgcatgactgctgaggctaagtcataagaaatcttgcagctctcatcctgctttctttgaatgtgctattgggacccctaagccattaggttgaaaaaaaaaaaggtctgactactctgagaggctatgctacaagaagtccatgttaacttcacagacagtgaagagagaaagcgcaagagagcacttgcacaagaaagagcacacatgcctggccagtcttcagcaatgccagccaccccagcccagagccagacctgaggggcaagaagccatcctagccatccagccagttcagctttcagatagctacccactgggctgcaaccatatgaggaatgccaagcaagaatgtctagccaagaccagttaacccacaaagccatgaaaactaataaaaatacattcatatttcaaagtattaggtttgaagtgatttcttacatagcaataaataaccagaacagatacatatgaggattaaatgagaccatatatgcaaagcacttaaaacaacaaatggtacaaagttgaagataagtaggtatcagacagtaaagatgacagtgacaatgatcattatgataatcattctattatactaatatttaaaaaaattctctggtttgtcatttgtttttaaaatatatatgttatatttcctttcaattgcatcacagcactccatgtctcagggccaaaatgctgtaattgcttcttagctcatcttcttgcccctggcttttccccttctagtctcatattgacctctactgccagatcaattttcctcaaatccagccgcagcctgttacttcaaagctagtaatgcctgcttcatcacatccctctgtaaattccagactgccatatctgaccttaatccccaacgccaagcctattttcagctgctctattacatttgctctgttcctgaaagactagtactcctccaccttcaccatacagctgacaatcccatctctgtcttaccaaattctcggcctaaaataccctccttcttctactctgccaacctcaaactggttttctcagtcagatttaaatcattcaaagtacatcttaggaccaaatattccagcctttttccaaattctaacgattctacatctgccccttcattcaatatttattaagctcctactctatgtcaggcactgcctgagaaagagaaacaaagctttctcacctgcagcttatattccaaaactaagttaataaatacataatacgtcatggggtgataagcacaatggagagaaagaagggataaggattacggatagaggttgctataaggtgatcatggaaagcccctctgatgagatgacgtataccaggagatctgaagaaaggaaacaagccatgtggattgcggggtgagaggtagggtagagaagggaaaaccaagtgaggaatggcaaaagcaaaggcctcgaggcaaaacatacttggtgaggctccctgaagaacaggtggaagtgtcataccacttgtcatttaaatgcaaattacactctgcagtcaggctcactgccttccccctcctttaaaaaaaaaaaaatccatccatccatcaattttattctttgacaaacttaagactcagttactttttactttttataacaagtattcatcctgaaatgaaattcctaaatacacttccttcataatactgtactgaatacatataggctaaatactccctacatagatttaaaaaaaaaatcagtataatggcttatcagtgaaataaaggagaaatgagtaatttctatcaaatactacaaaatataaatacttgtacacaactacattttaaaaagtagtcaaaaactactataactgattagctgtgtgaccttggggaagctatttaaatttcccatacttcagtttactcacatggaaaatgagaataatagtttctaccttacagggttgttgtgaggattaaattagtgcatatacataaggctcttagaacagtaagtgctatctaagggtttgctatgatttctcttatggggagaattaccacaaaagtaacagtagcatgaaaatgaatacaggggtgttatgttagaaaaattttcctttttcctgatatgatgaatgattctttgaaaggtttcaaatgtaacaaagtgccatcttcacaatatacactattgctgcattactagaaaatttggtgtggattaaaaccatgtaaaaatatttaatacttatacgtaaaaagtagttgggttctaggctcagagaattataaatgcattttgttttttcacctatgtgaatagctgctgggactttttggaagttgtgtgggacacacagcaaacctccctggtgaaaggctgtcccatgtatcccaggacatctagcctccctggcctctgcccaccaagcaccaggagtactccccagtcactgtcccctgaaatttcctgaatgttccccagtgttaagaatcactgttctatttttttcaactgtcttcaactttgactcctcatccagggtggaggatctttgaggccagaaaagtatcttattatgtccctgtatttctcaaggtagtgtactattgccacaaaaagattgttggctgatgcagatgcaaaacatcaatatttttatactgattataggtgacaggaaaggacaagggttttcaccctcagcaaaatcatcaaaaacatttaaaacagattacatatagtagataatactccttgtcttaaaacattatgcagaaacacacatacagtttcccttccctctaaaatctgcagcctcttctccctgctgaatgtgagtgatggtcccttcattcaacagacttctatttggcaactattatgtgccaggcattctaataggtgctggatgtgaaaggatttaacttattcaaataagtccctaatttgctgcaataagggagattatttaatcatattgagtaaaaagtaccaaggaaagtttccatatttctagggaataagaaatcttttcaaaaatctctgagccaaattaaaattcatttcattttccctaatctccatttctaggagactagaatctccttcctattgccacggtagctgctatctgcagagagaatctagataatttagaagagaaatttgaatagagccagagagatacaattcttatagtcagacttggcttcaccaaatttaatgaagaaactttaataagttacaacatttactaggcacctactatgcacaaagaactttacatacctcatttctaatcttggcaacattctgataagataaatattatccctattttaacatgaaaagatggaccttcttacatattcaataacttgctccataggtgacaggattgaaatgcaaacccagtccttgctcttaatggtgtatgacagctcatcatataattaggctgatgcaaactctatgataaacagtatgaatctaggagtggatttgtttatcctcaatctttttgctaactttacagtgccttgaattaaagaatcatggttactatcaccatggtcagatctctggacagggtgaggaagcaggtgcccacaggcagacagccctgccatatagtgagacacgcttatgtttgggagcgctatgtgaacaacacacagctgccctcatatgcagatgtaatgatgacgacacattcagacaaggaactgaggtccagaaaagttctgacaacacaacttgagggacagcgttacagctagagctcaggtttcttatctgtaatccactgctctcaaatgcccaaatgattttatatacatatatgcaagtgtgtttgttgaaatagaaaaaatagtttcttggcctggtgaagtgcctcatgcctgtaatcccaacattttgggaggccaatgcgggaggattgcttgaggccaggaggtcgagaccagcctgggcaacatagagaaaccaccgtctctacaaaaaatttaaaaattagccaggtgtggtggcatgtgcttgtagttccagatactactgaggtgggaggtgggaggtgctgaggtgggaggatggcttgaggccaggagtttaaggctgcagtgagctatgattgcaccactgtactccagcctggatgacagagcaagaccttgtctcaaaaaagaaaaaaaaaattcccataatgttcagttagttctctttttcagacttttcctagaaatacccctcagaatttctagaggccacttccctgctattccttgttttctcagtccttaccagatacccaagcaattaacaatctttttgaactatttcagtacatttcaggatatttgaaattctgctgatggagctgaactgctgatacattaacacatgctgtcattattgactttgtaacagaggtcaagagagaaaagatgcatttttgaatagggaaaaacaaaactaaattatggggaaactaaggctcagagaggtcaagttgtcttgctcaaggtcacaaagccagtagtaagtaacagggccaggatttgaacccagactgtctggtttcagagtactctaaattgccaaaaaaagaaaactatttcaggcattattttatatttagcctagagcctacataatagatccgttaatataatcaattctaagctgtatattatattactgtgtttgaaatatttaagaaatattgtttaaaataagtgtattagctcttggacctctccaacataaggagttttccaggcagtagcactgtttgcagtaggacttacattattggaaaatattttatcctataatcaatctacatttattttacacctttcaccttaaaattaaaagtcgtggtagttattaatcaagaagcaaatctatataacgtggtctctcatatatccagtactgttcagcttgaacaaatgcaaatctaatttttaaatgtcccttgaagaattctgaggcaaagttaaacttcaagtattaaacagaatagccacagaaaactagtgtttctcagcctccctttgctttcaaatgccttaaaaatattttagaggcagacaataatctagaattgattcataaccaatattttacataacagaatgttacatgtattttcatattataaaaactatactttctttgattaatgctagtattctgaaaacatcgttagtgccagtaaatccactaaatctgtttgtatttactgccctctagtgataatggctctacatttgattaagaaaaaactattcctttcagtaaatgaaaacatctcttgtaagttttatggagatttgagattaagaggaactccaggctgcttttttaaaaccaaataatcatctgaacaagctgagaatcgttctctaaatgatcttattttaatttttttttaacaaaaaagtctcatttaaaatagtaaacacctgcaacatgtatggagaaaggaaaccatttttgctaagaggctccttgaagctgaaataacatgagactgatctgatagctgtatttatatttctcttctacatgggctaactctcttattagatgttagcatagtattctgtaattgttgatacagtttgaattcatatatggtagagacagagttttgtataactatttagtcaatttacctaaaaccagcagcagcagcatatctactacagacttttgtttcactgaagaataatcatgacaataaatgggtgcaaaaacttcacataaatgaagcctccacaaaaataatcttgtatgaaaaagtattgtctccttatagagaaaattaggatctccaattcacttaaattggcctaaatgaataccataatcatcataaaatagttactaatgtcccctctgtacttcgtggtatgctttgtggaaacaatttaaacaaagagaatatctgtctcctaaagtaataataactagtgtaaataggcatgcttccagaaatatataatcttttacacatatcactttaatatgtgcatcttaaaataattttaagtaataaaatttgagctataaaagagaaatgatattcttttcaacaaagaatgcttgaacaattgagcatccactcataaaacaagaaacttcaacctttatcctgcaccacactaacatctacttgaaatgaatcatagaactaaatgtaaaatctaaaactaaagaacttctagaagaaaacacagtagaaagtagttgtgatcttgcgttaggcaaagatttcttaaaccacaaaagcatgaagcataaaataaaaaatggtatactggactttaccaaatttctctttgaaaaaaactgttaagaaaacagaacaacaagccacagacttgagaagggaatatgtacaaaatgcatatcaaataaaggacttgtatccagaaattattttttaaaaaatctttacaacacaataagaggacaatccagtgaaaagatggtcaaaagatttgaacaaacaaacacttcataagaatcaaaaagatcaataagcatgtgaaaagatccatgaccatcattagacattagggaaacaaaaagtaaaaccacagtgagatgccacactacatacttactagaatgtataaaatacaaaatacaaacaatacaaaatgctggcctggatgcagagcaaattaaattctcatacattgctagtgagaatgcaaaatggtatagaaactttggaaaaaggtttgacagtttcttataaagttaaaaagtagagtgaccatatgacccagcaatcctacttctaagtatctacccatgagaaatgaaaacatatgtctatataaagacctatatgaaaatgtttatagcaactctctatagcagaaacccagaaacagttcagatatcagtcaactggtgaatgggtaaacaaattgtgtccataaaatgacatactggaaaaaaatgaaatactaaaaagcaataaaatgaaacaaattaccaatagatgcaataacacaaaatgtattataagtgaaacttataattcaactcaaaactcaaaagtattgtaagtgaaagaagccattcacaaaaggctatatctttaatgtattattcattctggcaaggcaaaaccatagggacaatcagcactggacgtggggtttggggaatgactataaaaagcaagagaaaactttttgggtggtataaatatcctatattatatagtacatatatattataattacacattacctatatatctagattatggtggtggttatccaattgtacacatttgtgaaaatgcattcaactatacctctagaaagagtaactcttatgtaaattatacctcaaaaatctaactttgaaaaatattagctgatgttatcaaattatttcaattccagatttgcttaactttacaactttgcccaaagataaatgcaaaacaaaaacctcaggcatagttatgtatgataaaacaccatttttaccctttcaaagagctccaccattatttcccagaaaacaggcatacagttatccaaggtccacattagctttaatgatacaacattcagtgaattcccagttgtgaaaagcctttaggttggcagggcgctgtggctcatgcctgtaatcctagcactttaggaggccgaggcaggcagattgcctgagctcaggagtttgagatcagcctcggcaatatggtgaaaccctgtctctactaaaaatacaaaaaattagcagggtgtggtggtgcactcatgtaatcccagctactcgggaggctgaggcaggagaattgcttgagcccgggaggcagaagttgcagtgagctgagatcgcgccactgcactccagccggggtgacagagattctgtctccaaaaataaaataataagagaagcctttaggtgataaaataatagtcaaagtattcttttaagtattattattttatttttttttaattctttgtaataaaaagttccataaagtaaaatattgtccttttttgttttatttttatttgtatcaattcaaggggacaggtgcagtttgttacctggacctgatttttaaataaatcaaactcagtttagttatttcatggtgatcctgggagactgtttgtcagtcatcatcgaatagcgaatgagtatcctttgtatgctcattctaggctgtaagtaccatgtcagctgatggagacacaaaaatccaataaagtaggtatagctgggggaggttccaagatggccaaataggaacagctccagtctactgctcccagcatgagtgatgcagaagacgggtgatttctgcatttccaactgagctttgaaaagagtagtggatctcccagcatgaagtttgagatctgagaatggacacactgcttcctcaagcgggtccctgacccccgagtagcctaactgggaggcacctcccagtaggggccaactgacacctcatacagccagatgcccctctgagatgaagcttccagaggaaggatcaggtagctacatttgccgttctgcaatatttgcggttcggcagcctctgctggtgatacccaggcaaacagggtctggagtggacctccagcaaactcgaacagacccacagctgagggtcctgactgttagaaggaaaactaacaaacagaaagggcatccacaccaaaaccccatatgtacgtcaccatcatcaaagaccaaaggtagataaaaccacaaagatggggagaaaccagagcagaaaagctgaaagttctaaaaatcagagctcctcttctcctccaaaggaatgcagctcctcaccagcaacggaacaaagctggacagagaatgactttgacaagctgagagaagaaggcttcagacgatgggtaataaacttttccgagctaaaggaggatgttcaaacccatcgcaaagaagctaaaaaccttgaaaaaagattagacaaatggctaactagaataaccagcatagagaagaccttaaatgacctgatggagctgaaaaccatggcatgagaactacatgatgcattcacaagtttcagtagccaattccatcaactggaagaaagggtatcagtgattgaagatgaaatgaatgaaatgaatgaaatgaagcaagaagagaagtttagagaaaaaagagtaaaaataaatgaacaaagcctccaagaaatatgggactatgtgaaaagaccaaatctacatctgattggtgtacctgaaagtgatgggagaatggaaccaagttggaaaacactctgcaggatattatccaggagaaattccccaacctagcaaggcaggccaacattcaaattccagaaatacagagaatgccacgaagatactcctcaagaagagcaactccaagacacataattgtcagattcaccaaagttgaaatgaaggaaaaaatgttaagggcagccagagagaaaggtcgggttacccacaaagggaagcccatcagacttacagctgatctctcagcagaaactctataagccagaagagagtgggggccaatattcaacattcttaaaggaaagaattttcaactcagaatttcatacccagccaaactaagcttcacaggtgaaggagaaataaaatcctttacagacaagcaaatgctgagattttgtcaccaccaggcctgccttacaagagctcctgaaggaagcactaaacatggaaaggaacaaccagtaccagctactgcaaaaacatgccaaattgtaaagaccatcaaggctaggaagaaactgcatcaactaatgggcaaaataaccagctaacatcataaagacaggatcaaattcccacataacaatattaaccttatatgtaaatgggctaaatgttccaattaaaaaacacagactagcaaattggataaagagtcaagacccatcagtgcgctgtattcaggagacccatctcacatgcagagagacacataggctcaaaataaagggatggaggaagatctaccaagcaaatagaaaacaaaaaaaagcaggggttgcaatcctagtctctgataaaacagactttaaaccaacaaagatcagaagagacaaagaaggccattacaaaatggtaaagggatcaattcaacaagaagagctaactatcctaaatatatatgcacccaatacaggagcacccagattcataaagcaagtccttagagacctactaagagacttagacttctacacaataataatgggagactttaacaccccactgtcaacattagacagatcaacgagacagaaaattaacaaggatatccaggaattgaactcagctctgcaacaagcggacctaatagacatctacagaactctccaccccaaatcaacagaacatacattcttctcagcaccacatcacagttattccaaaactgaccacatagttggaagtaaagcactcctcagcaaatgtaatagaacagaaattataacaaattttctctcagaccacagtgcaaagtagaagttgggattaagaaactcattcaaaaccactcaactacatggaaactgaacaacctgctcctgaatgactactgggtacataatgcgatgaaggcagaaataaagatgttctttgaaaccaatgagaacaaagacacaacatactagaatctctgtgacacatttaaagcagtgtgtagagggaaatttatagcactaagtgcccacaagagaaagcaggaaagatctaaaattgacaccctaacatcacaattaaacgaactagaaaagcaagagcaaatacattcaaaagctagcagaaggcaagaaataactaagatcagagcagaactgaaggagatagagacacaaaaaaaccttcaaaaaaatcaatgagtccaggagctggttttttgaaaagatcaacaaaattgatagaccactagcaagactaataaagaagaaatgagagaagaatcaaatagatgcaataaaaaatgataaaggggataccaccaccaatcccccagagatacaaactaccatcagagaataacacctctacacaaataaactagaaaatctagaagaaatggataaattcctggacacatgcaccctcccaagactaaatcaggaagaagttgaatccctgaatagaccaataacaggttctgaaattaaggcaataattaagagcctaccaaccaaaaaaagtccaggaccagacagattcacagctgaattctaccagaggtacaaagaggagttggtaacattccttctgaaactattccaatcaatagaaaaagagggaatcctccctaactcatttgatgaggccagcatcatcctgataccaatgcctggcggagacacaacaaaaaaaagagaattttagaccaacatccatgatgaacatcgatgcaaaaatccttaataaaatactggcaaaccaaatccagcagcacatcaaaaagcttgtccaccctaatcaagtgggcttcatccctgggatgcaaggctgcttcaacatatgcaaatcaataaacgtaatccatcatataaacagaaccaaagacaaaaaccacatgattatctcaatagatgcagaaaaggcctttgacaaaattcaacaggacttcatgctaaaaactctcaataaattcggtattgatgggatgtatctcaaaatagtaagagctatttatgacaaacccacagccaatatcatactgaatgggcaaaaactggaagcattccctttgaacactggcacaagacagggatgccttctctcaccgctcctattcaacatagtgttgaaagttctggccagggcaatcaggcaggagaaagaaacaaagggtattcaattaggaaaagaggaagtcaaattgtccctgtttgcagatgacatgattatatatttagaaaaccccatcatctcagcccaaaatctccttaagctgataaacaacttcagcaaagtctcaagatacaaaaccaatgtgcaaaaatcacaagcattcctatacaccaataacagacaaacagccaaatcatgagtgaacacccattcacaattacttcaaagagaataaaataccaaggaatccaacttacaagggatgtgaaggaccttttcagggagaattacaaaccactgctcaacaaaataaaagaggacacaaagcttatagataggaagaatcaatatcatgaaaatggccatactgcccaaggtaatttatagattcaatgccatccccatcaatctaccaatgactttcttcacagaattggaaaaactactttaaagttcatatggaaccaaaaaagagcccgcattgccaagacaatcctaagcaaaaagaacaaagctggaggcatcatgctacctgacttcaaactatactacaaggctacagtaaccaaaatagcatggtactggtacaagaacagagatataggccaatggaacagaatagagccctcagaaataataccacatgtctacaaccatctgatctttgacaaacctgacaaaaacaagaaatggggaaaggattccctatttaataaatggtgctgggaaaactggctagccatatgtagaaagctgaaactggatcccttccttacactttatacaaaaattaattcaagacggattaaagacttacatgttagtcctaaaaccataaaaaccctagaagaaaacctaagcaataccattcaggacataggcatgggcaaggacttcatgtctgaaacaccaaaagcaatggcaacaagagccaaaattgacaaatgggatctaattaaactaaagagcttctgcacagcaaaagaaactaccatcagagtgaacaggcaacctacagaatgggagaaaatttttgctatctatccatctgacaaagggctaatatccagaatctacaaagaacttaaacaaatttacaagaaaaaatcaaacaaccccatcaaaaagtgggtgaagtatatgaacagacacttctcaaaagaagacatttatgcagccaacagacacgtgaaaaaatgctcatcatgactggccatcagagaaatgcaaatcaaaaccacaatgagataccatctcacaccagttagaatggcaatcattaaaaagtcaggaaacaacaggtgctggagaggatgtgaagaaataggaacacttttacactgttggtgggactgtaaagtagttcaaccattgtggaagacagtgtggcaattcctcaaaggtctagaactagaaataccatttgacccagccatcccattactggatatatatccaaaggattataaatcatgctgctataaagacacattcacatgtatgtttactgcagcactattcaggatagcaaagacttggaaccaacccaaatgtccaccaatgatagactggattaagaaaatgtggcacatacacaccatggaatactatgcagccataaaaaaggatgagttcatcatgtcctttgtagggacatggatgaaactggaagccatcattctgagcaaactgttgcaaggacagaaaaccaaacaccgcatgttctcactcataggtgggaattgaacaatgagaacacttggacacaggatgggggaacatcacacactggggcctgttgtggggtgaggggagtgggagggatagcattaggagatatacctaatgtaaatgacgagttaatgggtgcagcacaccaacatggcacatgtatacatatgtaacaaacctgcacattgtgcacatgtaccctagaacttaaagtgtaataaaaaaattaaaaaagtagatagtcccaaccgctgtattctttttgaatccttttgccactgtttcatatcacagtttttttttttttctgagccctagattatcagtctgttctttttttttttttttttttttaatgtagtccataggaatctgctgcctcacggtcagtatcgtgccccttaccccaattctaatatgacaggtttttgtctaagacagcatttcctagaatgtgttgtaatgtacagcagcttcatgtgataattctcaaagactcccactgtcaaatgttagcatattcaaggctctgccaggacctgtaatacatattctttctttattctgtttaacttagcatttctgaaacctatcttactactgaactcttgacatttattaacaaacaaatacaaacgaaaataccagggttccaagtaaaattcttatataaagcaaagggctttaaacatcagagttttttagaatggttattcactcatgcactcaacaaacacttattacatagtatgtgccagcataggggatacagtaataaacaaaacagacaagttccctgttcatgtaaaccttggacttatggggcaaaaagacaataaacaagcagacaaaaaaaaattacaaacactctcaatgaaggaaaagagggtaacatcgtacattgatgggggactataaaattaagtagtaaggaaaagctgcacttgagaaggtggtatttgggaagagactcgaatgcctagaataagccaaccagatttggggcacagcactctcaacaaaggctgagtaacacagccagtctgagggaggacaggtctacggaatgagagccgaggcaagtcaaggcaacatcacgtgggtcctgagggtatgagccttccagagggtgtgaggataccattagaaggttctgagcagggaatgataggatgtgatttacattttgtaaagctgtctctgtagaggatagtttgtaaaagtgcttgaggcaaaactgacaagacttgaagacttgcacaacagaactgaagaaatgagaagaatcaactcctagacttctgggatgatcaatgtctaggatggacattggtgccatttgcaagatggagaagaccgggggaggtacggatttaaaggagggtatgtaaggagaaagaagaatcctatgagacaagaccagaacatgtaaatacatgaagttttggatttcttactcttcaaagacattttacctcctgtccccgaagttcttcacagagttcaggataagaaaagctgccagacagttgagttttgaataagtagtaactttcaaacacttgaaagacattatattagaatagactacatccatcaaaatacttaaaaatgtttttagaatagtccaataatttggaatatgaaagcctaagaaacttccttatccaaggccgcataatataaccaaaattagaatttagtactcctagttggcaatatttttatgaaattactgttttactaagacattttagaaatgaagactttactgaaggcaataataagtgcaattaaaagtggtacaataataagacttctttttcatttgcaacaggttagtagtgtatgagaattatgagatgtaaaatagtgtagagcataggcttctctagttggcttcatgtgagttcgaatcttggccctgcctctcttaccagcaatgaaatatgcagcattttacttaaggatactgggttgtatggagagaatcagagttaaggttggtgatccagcagtgtcatgtgtcaggagctaataaattgtattgtgaccagaaacactgaaacttgttataaggaaagcaatctaattaaaacagctgcattaaaatttctacaatatcttcctaacagcttatgctatcaacagtttgtaaactatcagaatcacggatactggctgagaatgcttttggagatttcaaattggcataattttctcagaatgcactgatctgacaaatgtacagacaggcagacaggaatactaccactcttcatgaataactgtctgcctctcctggatttcttccatgttgtgtaagtctattacactttgggtgaatgtagctttagtacattgagttaatatcattcttgcaaagaagctctttataaattccttaaacttaatttgactctggacacaaacaaatgagaacaaaatacagctcaaggattaagatccttaaccaaatatgtaaaaaacacgaaaagccttacaaacagtgatcaacagttaaacatgcgctatcaccttcccctaacagctagggaagcatgtatatgaatggaacatatgaacttccatttggtgtactaagaaaacacatcacgcagatggcttttatagcttcccaaataaggttctaataattcacaaaagtgttgttccctaaaacccataataaacaataataaaacctaatgtttattgagggtctactatgtgtcaaggagagtcctatgtactctcctggaattacttcatttatttctaataataacctttaatgagcactgtcactcccgtttcacagatgagccttaaggtcttagctatcaactttgcagacaacacccaagtaaaatcctgccccctctttttttttttttttttaaccagaaatccagtcctgacaactgaaagcttatagggcatttccgcttagatacatagccttacctaaattatatgtctaaaaacttaactgtcatattgtccagccctcccccaatacccaactggcttctcttcatgattttccaactataattctgtccattattcaggtttagaatttcatgctttcttctggctgtggtcctgccaagtcttatgtatgctgtcacccttctctgtgcaatctttctcctactcattcctctcttttcatcactatcctatttcaggcccttatcactcttacacctaattccctaacggtttcttcttgctttcagtacaatttccccttgatataatctatcctgcacactaccaccagatataaccttctaaagtcaccttattttagtttcttcataatattttccttatagtcaaatgtaagggttcttcatgaattataggacaatgtgcaaatggcttgacctggcatttaagacagtctgcagtatggcctcaatctacatttctcacacctgccactggtcctataatcacatcctctgttccagagaggctcactcctccagaatgcccactaccctcctctccagcaaacatacaataaagcgaatccacatgaataccccatcctaccctgccttatccagcccctggaataccacctcttccctattagatgcctatataaatcctcagtattcaagatccagcttaaggagcactttttctgggaccaatcattctggtcctctgtattgaatactcgaactcctctacaggacaggaacataatgtattattaccctatcattcattaacacacaacaggcttacattatatggctggttgtattttcagaggtatgtctatatgtttcgctatctatctatctatctatctatctatctatctatctatctatgtgtttgaatacagatacataaaaatctcatttcacctataagaacctctggagcagatacatgtcatacaataattgggctaaaacaaaaatccctcagtgaaaacctaaagactgggttgtggttgtttgcagccaaaacgtacaaaatgaaaacctcctaacgatttattttccacatgaaattagtaccagatctagagaaaaatggacaaggatcaaatacaaataataaagtcatcaccaaactaaaaatttcattcaaaagtgatgatgttggccgggtgtggtgactcacacctgtaatcccagcactttggaaagctgaggtgggcagatcacttgaggccaggagtttgagaccagcctggccaacatggtgaaaccccatctctactaaaaacacaaaaaacagctgggcgtggtcatgcacctgttatacccactactcaggaggctgaggcaggagaatcacttgaatccaggaggtggaggtggcagtgagccgagattgtgctactgcactccagcttgggcaacagagcaagactccgtctcagaaaattaaaaaaaaaaaagtgatgatgtcagtaaagacccaaatcagggtcatatgtttaacaccagaaagtttgtatttgctacaagacagaaaccttgacaaaataacttttctgtgctttgttacttcatctgaatgaagaaggtaaaccagttgatctcacaaatctctttctaagggcttctggaatttttttttttttttaaacaataaaaggaaagagacttctcttaagcagaacaaagtccgactcctctgtaaagtggctgacagcaagtggaaaatggaagaagaacaattacctgcaaaatgactcattcccttgtaacaactacactactagggaattccttctcttaccggctgtggctagcgtcagactcatgacaaagacctcatcctggggctagaactaggtttagggttttctcattcattcctctgtttctcagctgcattttcatttttaatctgtgcaatgattacagaggcctatgtttggttttcatttctagtttccccaggaagagacaactactatcttgatattgattaacacttgaaacttctgttaatcacaatttcagtatttcagggaatcagagaaatcatttggaagagccttgaaggtcatccagggtgagagaaaagcaaagcacaagcaacagaccaatgtttagacacagtgaagtgaagacctacaggagaccctctcaacttcaataagagtcttttttatggctgtcttcatattctttcaaagaaatcataataaaggagttagtgagagtgtaaataaaaaataggctatcatagagtgctgggtaactgagctaaaactaaagtaaacaaactcagtgggccatcacatatgcaagctggtaaggtctcataaatcaccatgactgggtattgggatttcaaaggcacactctgtaagctttctcccagccctgttgattcaagctccaattgcactgggttacttatatggcagcatataaagttgaccttttatgtttaaaaatagttccattcctcatccctcctaaggataggccacagtacctatcatatgtccccaccacactacataatttatgtaagttttcacttaattttcaacacaatcctttgaggtagattatgttagtcctgatttacagggaaaacagaggctcagggaggccaaatttatttatttatccaaggttgcaactctactgtagggcagatttatatccagaagaggaattgcaaagctcctcagaatttaggagatttaaaatggaatcaagataaaggttcacatttttcatcttctattccattttactcttccagcatctaataataacctatgatatattagaacaaatcagcccatacttattttgacagtctcttttcaccccatttcagtttgtaccttgctgtctcagagcccatcaaccacctttcctcactcccaggcagccggtccttcaggggatggcttggcagttggcccaccatcctctgctaccagggcatgactcatggaggcaacaggtgaagctgacgccaactattagtgctaaaaaagactcaagcctcatgaaatataccatccataaatcgctctccagtcagctctacccctccctccatttctacagctgactgtctgttcttccttaaacatttacatccgccactgacctgtctgggatttcttttttacttcaaggttctcctaaaggttcagtccaaccaggtttcaccaaatgaaccctgcggtggaaaggggcagcaacgggcattggtcagtttgcctccagccaaggaaagtctgactcccctccttctcccactcttctctttctctgcctcacactgcctaatacgtctttcctctttctctctttctttccttatatcttcattttccaccctattcagaagtgaaacttcccttgccactttgcccccactaagaaaacagacctccaacacaacctcttaacaggctaattttaaaatcatgaacctgcttacaccttccgtgagtttatcctatatcttctctatctgctgtctgcttcccactaaggttttatccctccatcccacctccaaatcctttacagctcagattctcagatctgctttagtcacttggtctcctcatcccactgaccctattatccttctgtgcacatgttagagggcacatgctcctcctaggaactagggccaggtcagttatgctcccatcctgacatgacctagagaacaaaaaaggcaaaacgaggtactgtaggattcctctctaggaattatactttgctgaaattgctcttgctattttggaatctagtgctcactaaatacatttttaaaatattatttggatatattttgaaaatacaaccagaggtcgggcacagtggcttacgcctgtaatcccaacactttggcgggccaaggtgggcagattacgaggtcaggagttcgagaccagcctggccaacatagtgaaaccctgtctctactaaaaatacaaaaaattagccaggcgtggtggcaggcgcctgtaatcccagctgcttgggaagctgaggcaggagaattgcttgaacctgggaggagaaggttgcagtgagcctagatcacgccattgcactccagtccaggcaacagtgcaagactctaactcaaggaaaaaaaaaaaagagagagagagagaaaatacaaccagagaataaacacttgttcttctatctctccatcttccccaccaatacaacatccagaaaatagtcatctttacacttatttagaagcacatagatcttataaaagtttaactgagcattaggttttcatctttaaaaatattctgaggctgggtgcactggctcatgcactttgggaggccaaggcaggaggatcacttgagcccaggagtttgagaccagcctgggtaacatagtgagaccctgtctctacaaaaaaaaaaaaaaaaagttaaattaaattaaaaaacagaaaagccggtctggtggcacatgcctgtggctccatccactcaggaggctgaggtgggaggatggcttgagccagggagatcaaggctgcagtaagccatgatggcgccactgcactccagcctggttgacaaggtgagaacttgtctccaaaaacaaaacaaaacaaaaaacgttttgacatgtagaatactgtttctgggactaaattagagatttaaggtttgaggtatgagaaaatacctggaatcatgccttacattagaaggtaaggtaaatactggtgtttcccaatgagttgtagtcagattgttcatatgtatcaaacagacaatatactgaaatatttaaaaataaggctaaatagcaacaaataatttttcccatgaattctactttttttttttttttttttgagatggagtctcactcagtcgcccagactggagtgcagtggcgccatctccattcactgcaacctctacctcctgggttcaagtgattctcctgctcagcctcccgagtagctgagataacagacatgcaccaccacacctggctaatttttgtatttttagtacaggccaggttttgccatgttggccaggctggtctcaaacttctggcctcatgtgatcgacctcccaaagtgctgggattacaggtgtgagccaccatgcccagctgaattctacttttttttttttttttttgagacagagtcttgctctgtcacccaggctggagtgcagtggcacgatcttggctcactgcaacctctgcctcctgggttcaagtgattctcctgctcagcctcccgagtagctgagattacagacatgcaccatcacacctggctaatttttgtatttttaggagagacgggatttcaccatgttggccagctagtctctaactcctgaccgcgtgatctgctctcctctgcctcccaaagtgctgggattacaggcttgaggcaccacgcccggctgctgaaattctacttttgaaagaacaaattccccttctgtagggactgatgattcagtctgtaatgatgcattctcttcatcttctttttttgtcttttcttctatatatcctttaggcattctactgtattaacactagatagaaaaattaagatttaggcccaaacattatcttctggcataaagtaaactaatcgtttcctgatgtacaataaataaacagacatatttctagtagaagattccttatgatttatcaaaacccaattatcacttacccttatggagatcttagatcttagaaaccatactgacaatataagattaagaaaacaacagaaaatcaaaatatataccaaggataatgttaataggtttcatccttatcacagcatactgttgaaacttacttgaaatatttttttaaaaaagatacaagaggacaagtgtttagtttttaacaagggaggggactagtcaacaaatattgattacctaatttatgaacagctctggccaaagtggtcaaaaaaaaaaaattaggactttagttttcctaaacctatcttaatttttaacaggattatagctttgttcaatctttacagtctttagcctcttttgtgaaatgggtttccttgtaaataataaaatgacacctatatatatttaaagcactcatgaaataattttatctctttattaaaaactgtgataacccttccaattttgaaatttattgtcttcctaaattcttgctacaaagcctatcattaatattgcagttcattttttccctaaagattgaaaaaaacactaacaaatataaagtctttatggtcaaagaatgtactccttttataaaacttggagttgatgtaaaggcacagacaacacaagttaccttaataataaatgcacttttctttgtaattttgggtaattcagtgtgatttgtaattcttttaaaagacacacaatcacttgtatttttgcatggttctttttttcctaatttcccactatagtgaaatatctgtttttccttctctattgggtttggattggaatgatcaggtagaattaaatgtaaaataacaaaaggaaaatactttatagatcttctcaaaatactttgaagggtataatctctttaagatggctttattcatatttaagccaaaaacaaaaagcaaccaaaacactactgtttatacaaaaagcagcttcaaaatcagccagttattttctgaaatggagatggcagacattagcctgcacttactccaatatggcagccgcatctttgcctctttgctatggacacatccccagcaggcctgtactttctactctccagacctgtttatgacaggccaaggtgtttcctattatggtgcctatggctgcacagtgcactgcttgtcagtaataaaagccagaggctgtccctatagggattacagtgcagcagaccagagatgctgatgggaatgcaagcatgccctaggcaaacattgcagaatactctctgacaggcaaaagccaacaaacacatcctttcttcccagactagcagggaaagtattcagttatgtcattttcacttggaacaaactaataagaagaatgttattgctaaaataggtagagatgagaaagagcagtttatgaccatgaatatggcctctatggtttttgcctgtgcactacaaacttttaatttaaacgagatgagattgatctagcatatactatgataaaatttctgagacatgagtatctaaaagcagaactgagattaagtgagaaatgctcaggattcctgtcactgaaagaaaaagaaaaaaacctttcttgaaaggcacaaagtagaatgctcagactctccatctaccaatacaaggtaaaaaacagcatttgcattaaccaacatcatgcattcttgtactaatttatgtgactaactacaaaatgttatattgacactcactgtgtagggtgtcaggatggccaagtggtctaaggcaccagacactcactgggttgggctaaaaacaccgtagaagacctcatcagaacaataaaacagagacacaaaatattgtactaagagttaagagaattacaaataaaagttctgtggaaagtcaaaggtatccaattaggaaagcctgaggtgggagacataggacaccccagatataggatgggaagaagatgggattaaaaaaaaaggctttataaaggatgtaacattccagataggccttaaaagatggcttcgatcttttaaataaaactttttgttttagaacagatctagatttacagaaaacttgtgtagacattacagataattcctatatactctacactgtttcccatttttaatgtctgactttagtatggcacatttgtcacaattattgaaccaatactgatacattattattaaacaaagtccacacttcattcagatttccttagttttcacgtaatttccttttttctgttctggatcccatccaggataccacataatatttagtcctcatgtctcctgaggctcttcttggctgtaggtatctcaggttttccttgtttttgataaccttgacagttttgaggagtactggtcaaatactggtcaagtttcgagggtagaatatccctcaactgagatctgtctggtatttgcctcatgattacactggggttatatgttttcagtagggaaaccacagattaaaagtgccattttcatcagatcatatcgagggtacatgttatcacttatcactgtcaatgttgaccttgataacctggctgaagtagtgataggtttctccactacagtttcttttttttccctttctacactgtactgtttagaaggaagtcaatatgcacagctcacacttacggtgtagggggttatgttctccctccttgagagtagagtatctatagaagttattgggaattccgcacaggaggagatttgtctattttcccccacttaggtatttatttaataaattgtatcaatatgggtttatggatatttattttaccctttgggatataatccaatactatattattttcttgctcaaattgttctagctttggccattgggagctctttcagtttgctcttgcaactcttcagtatattcccacgggtgtagggttccatttgtttgagcaggtccttactttttggcactacaagatgctccaggctcatcttacatatttccttcctgagtccctagaaatcagctattttttttcaaagagtcttggttccttttaccagagaatggtattagaaaccaaaatgagggtgctaagtgtgctcattgctactggggtatggtagcttctagaccctctcggctgatagagcaaggaaatatttgtgtgtatactagatggtaagatgttgagaggtagaatggagagttaccttcttaatatacttttcttaatattaaatattaataagatattgtgtgcctgggttactttcagtcttatgcagaggaagaacgtatgtacattcatttatgaaaaacactggctagactattcttctgcactgcattatgcatttctgctagaaaaagctcagagattttcagatattctgacaaaaatctcaggcttgcttgatgagctatactgtaaaattacagaaggaaacaaagggcaaactccttgaaggatgaaaataaaggaataaaacatataaaacaccaccaaaaaaagtgattaatgggggagaagagtaaataaaacattataatagtcctctttggttagtatcaatattattaggtcactttatcaaaaggatagaaatcaggatggcagacacccttctctaaccctcaccccccaaaataataaaataaaaactaatgttattccttcacatatggaaatgaatgagttctactgagtatctagtatgattcctgactcagtcgagacaattcccatcttttaattcattaaatcaccacagcaactatttaacagatgagaaaactgaagcacagaaggcaacgtggcccaatttacgtttggtaaaaggcagagaatgaatccaattcaggcaggctgtctatagtagggtgctctaaatccacggaccattctgcctaaggaatgaatattttatgaattggaatatttctgctgaacgaatttgccattttctcctctagtggagaaatccaactgagggtaaagaaggaaaaatgttgattgtttaaaacaataaattagtctctaaattgttcttgcagctgatttagactagtgtgtccaaaagtatgcccagtgttagtaaatggtaggcaaaatgctttaaggtggtgcaagatgaatgttttctcattttgttattcattaattttagaaaaaatacagaaaaaatataacttgaacatcaaacctatgatttcatgtataccattacttaagatgaggcacttgggtgagtatttagatttaacaataagttgctcttagcatttctatactttgacaataaattatccaaaaaagaaattaagaaaataatcccatttgcaatagcatcaaaaaaatacttaggagcagccaggcgtggtggctcactcctgtaatcccagcactttgggaggccgaggcgggcagatcatgaggtcaggagatcgagaccatcctggctaacacagtgaaaccccatctctacttaaaaatacaaaaaaaaaaaaaggcaggtgtggtggcaggcgcctgtagtcccagctaattgggaggctgaggcaggagaacggcgtgaacctgggaggtggagcttgcagtaagccgagatcgcgccactgcactctagcctgggcaacagagcgagactccatcacaaaaaaaaaaaaaaaaaaaaacttaggagcaaatctaaccaacaaggtgaaagatctatacactggaaactacaagacattgatttaaacaactgaagaagacagaaataaatgaaaagatatcccatgttcatgcactgaaagaattagtaatgttaaaatgtccacactatccaaagccatctatagattcaatgcagttcctctattgattcaatgcaattcctttcaaaattccaatgtctttttttttcacagaaatagagaaaaaaatcttaaaatttatatgaaccaaaaaaagacctaatagccaaagcaatcttgaacaaaaagaacaaagctgcaggcatcatattccctcatttcaaaatatattataaagctactgtaatcaaaacagcatgttattgacataaaaacaaacatcaaccaatggaacaggatagaaagcccagaagtaaatccaagtatttacagtcaattgatttttgacaaagggtccaagaacacacaatggagagaggacagtctcttcaaatagtgttgggaaaactggatgtccacctgcagaagaaagaaactgtactcttatctcacactccatataaaaatcaactcaaaagagatataaaggcttaaacataagacctgaaactgtaaagctactagaagaaaatataagggaaaatctccacaacaatggtctgggcaatgatttcttggataggactccaaaagcacaggcaactaaaacaaaaatagacaaataggactacattaaactaaaaagtacctgcacaagcaaccaaataatagagtgaaaagacaacccatggatcaggagaaaatatctgcaaaccatacatctgataagaggctaatattcaaaatatataaaaaattcaaacaaccaaatagtaagaaaacaaatcgattaaaattagacaaaggatctgaatagacacactttcctcaaaaaagaaatatgaatggccaacagagatacaaaaaaaaaaaaaaaaaaaaaaaacaatgttccccagccctgcacagtggctcatgcctgtaatcccagtgctttgggaggctgaggcaggagatcacttgaggccaggaattctagacaagcctgggcaaaatagcaagaccctctctatacgaaaaaataaaaagccaggtatggtggcacacacctgtagtcctggctacttgggaggctgaggcaggatcattgagcccgagaatttgaggttacagtgagacatgatcacgccactgcactccagcctgaacaaaagagcaagaccctgtctcaaaaacaaacgaaaactcaacaatatctctaattctcagggaaatgcaattaaaaccacaatgagctatcacctcatgcctgttagaatgactattttccttttttttctcttcaacttttaagttcaggggtacatgtgcaggatgtgcaggatgtgcaggtttgttacataggtaaacatgtgccatgtttgcttcacgtatcatcccatcacctaggcactaagcccagcatccactagccattcttcctgatgctctccctgcacccatcccacccgccaacagaccccagtatgtgttgctctccaccatgtacaatggctatgttcaaacagatgaatgataacaagtgttggcaaggatgtggagaaaagggagcccttctacactgttggtgggaatgtaaattagaaccaccattattgaaaatagtatgaaggttcctcaaaaatctaaaaatagaactaccataaaatccaacaatcctacttctaggtatacacccaaaggaactgaaattggtacatcaaaaagatatttgcactcccatattcatttcagctttatttacaacagccaagatatggaagcaatctaagtgttcatcaagtgtgcataaagaaaatgtgatatatatatatatatatatatatatatattatatatatatatatatatatatagattatacaggccgggcgcagtggctcagatctgtaatcccagcactttgggaggccgaggcgggccgatcacaaggtcaggagatcgagaccatcctggctaacatagtaaaaccccatctctacttaaaaatacaaaaaattagtggggcgtggtagcgggcgcctgtagtcccagctactcaggaggctgaggcaggagaatggcatgaacctgggaggcggagcttgcagtgagccgagatcacaccactgcactccagcctgggctacaaagcgagactccacctcaaaaaaaaaaaaaaaaaaaaaaaaaaaagattacacagccttataaaagaaagaaattctgtcattcacaacatcatggaatggaactacaggacattatgctaagtgagataagtcaggcacagaaagacaaatattgtctttaataaatgatctcactttatggggaatctagaaaagtcgatctcagaaacagagagtagaaaggtgggttaccagaggctgtagaggaggagggagagagaaatggaagatgtcgatcaaacagtacaaaatttcagttagattggaggaataagttttagtgatctattgcactgcatggagaccccagtaattaataacgtattatatgttttacaatttctaaaatagatttttgacattctcatcacaaaaagataaattggtgaggtaatatagatatgttaattagctttactaaatctttctatgatgtacacattttaaaaatcacattatacccaagaaatagatacaattaatatttgtcaattaagaataattgacaaataaattttaaagattaataaaaaatacattaagttaaaacattcaacatataatagcagatatgaatgtacacagaaatgacaaaatcccagcactgtgggaggccgaggagggaggatcacgaggtcaagagatcgagaccatcctggccaacatggtgaaaccccatctctactcaaaatacaaaaattagctgggcatggtggcatgcgcctgtagtccagctactcgggaggctgaggcaggagaattgcttgaacttgggaggcggaggttgcagtgagctgagatcgtatcactgtactccagcctggcgacagagcgagactctgtctcaaaaatgacaaagtttgagcaacattaatttggactgtaaattcttaaagaatagaaaagtcatgtttttcttctaagaaatattatgtttttacattgcaagaaatatgtgacacagagtttttcttaatctctcttttttagtatattctagacaggcaagcacatgcaatttattgagcacccagtgtgtgctaatgcaccaaacggagctttacatacattatagctaatggtctcaataactttttcattttattttcccctttcattatcgccacttataaatgaaaaaactgagctccagagcggtaaggcctattgcccaaaatattagataggaaacaacagagctggaatttgaaaccaagtttgcctaatgaaaaacatttatgttcttttcactgtacaaagctgctgtaagtatcactggtgcctactccaggccagggagtaaatatcattcatccttatcacatacaaagtataacaaaacaaaaacaagaagctctgaatactaaataataataataaatactttataaaagataaactattctctaagagtaaaagataataaacctattgtcattgtagttggtcactgaacttaactaatttcctaatggacgcagcagaattgtttgttgtttaagcaaatatcaaggcataccccccaatccctgttacagggaataaaaaaagtcttcttcaaatgcctttcaaaactaatgtgaatattaaaataaagtgctactgatctctctacattctagaaagatctcagactaacagtgtcaattaaactattacaacaaatagccatgtaaaaactgctcccctactagagctacgctatcacaaaattaaccccagcaatctacagttctagaaaaagagttggtccctcctgctgaaaaagagaaaaccaaaccctacatattttgtgaatccactgaaaataatgacataaacagcactgcacatccatcatgtatttatatcttaagtgatagctacagtctatgtaactatcgcagaaatcttcttaaactgaacaaaagcattatctatcatcctttctctctagaaaaataccagtttgtttaatctacccataacattagaaaaaatacttcttttatcatgggcaatccttatgtttcggaatttttttcgaaaacgtagacagttcataatgctctcagacagaagttaccactactaccccaaatattaagtcaaaatgtaactgaaaaaaagaaatttatctagtaatgattaatttattgaataattaaaaattaggagtttttgataattaaatgttgggaataattaaactttcactaaatactggcacaggaactgaacggatgacaacagagacaagttaagatttgttttaatcctaagttttatgctaaggtaacatcaagggctctacttttcagtgaaagaaaaatttcctttaaaattgtttccctcttccattattacttaaaagcaaagaaagtattttttctaacagtgattataggattctcaatctttcatattaactttaaggtactacatgtaagctacataaatctttcccaaatctacctttattgagtagatgaaaaagcagatatcgaactcaaaacatctaaatgttgattttctataattatagaagatattttcttttgaaatttaaagtttgtatttaggcatattaacacttttttaatctaagatttaatatgttaatgtagaaaacaactgaggctgttttctctctataaaactaacatgccttttccaattaacttagtttccttcttagcaaaagtttaacatttatatctgttgagttacactgtagttgcataatgtggaaatatcttaagatttagccacttctatgaagatcctatatttgttataacacccctcttgcccagaagaaaatacatcaacaaaaagtcctactatatgttctgcattgactattacaaagcagtagggggagcagccagagaaagctctgagacaaagcacccagcaaagcaatttaatttataggcaacagaaacatgctagagaggtttgccaaaagccaaatacacaaaataaattccataaagaagtcatgaccacatttgtaaagctggcctaagtatatttggaatgaagtatagaaaaatctgaagtctcttagaaagggtctggattctaacttcaagacagactttcagcttgaaacacagtcatttccagccatgccaaacctcaaactgcccccaaaattagagcagaaacaaaatacatttttatagtgatatgtcttgggaataactcaaaatgatttcgttttctcctttgaacctcactgaacttacagggaaggcctggtgaaatgtgcattattaggtcacaagaggataacgttacagggttccatagcataatccttgaaagccctgaggcccaggccgctgtcctgctctcctctctactgactcccatcctcaatatactttccatgagagaaaggtaaccaaaaacatggtgaaactattctgcttaaaaggtgttttactgaaaaggcacattgaccactaacccttattacatttcacatgttctaaaaattagtaaggtctgcattttcagttttagagtaaaacaggaaaagtacttagttagctcttctgtctggcattctgtaactggaatttaagaaaagcctaaacttctaattagaacttcagaatgttcatgtctgtattataccacaaaaactgtaaatataatttaagcatttttatgatacagaaatgtgcgctatagacagttatctaagaattataaaaatccatcaaacttgaagtgtctggtataaattacaaccgaatggtaaaaagacattttagccacgtaggcaaccaatgaagtttgacctaaaacccaaataatagcaataacaacagatacagtgcctactattgtcagatactatattagctagctcttttgtatatattctttggaactcttacactgacttttcaagatagttattatggtgcccattgtatgctaaggaaactgaagctaaaaaaaattgaagtcatttctctaatgtaactccattagcaagaaacaaaaccataattcaacttccaggtttgcctgcctccaaagctttgagacctcactaaaattaccctcaattgtagcaatgaggttccaaaggaaatctgtacaaatctcaggcagattaatgtgcttataagggtaaatgccatagatttaatcactcaaattaaatgccatctggaatctcttaccctacttggtacaagcatcctacatgtgttacagccaaccctagccttggccaagaattcaataattttcctgcttcaatgccatcaacaagcaagaaacatatataataccaatacaggaaatacagctagttgctcctagagcatcatttaaaagctgctaattggctaagatgccttttattgagaagtctaagaaacagaaataatgtgttaacccagtttgttaaatgggtttgaggaatcagtttcctccttcctaatacctaaatccatctccataataagtattctctatcaccatttaaaaatcctgatctcttactagtgtttttattgtgcttttcaatctattagagtaaattttttaaaacctcaagagagaacacagaaaactgtcataatttttcaaaggctaaaggagaataaactgaaaatatcagtttgaacacgtgtatgtaaaaagaatggatggtaataaaactaacaactgaaaagcaatgtttctgactcattcattcatactcaagaaatatcaaataactgagtggagatgatgcaagctgtacacatttccagttcagactgaaggtgtggcaacactcacaggggccttccgatcagctgctccaactcagtttacagcttttgtggatgtggcttattcatgcccttgttatgaagaagaagggtaactttacaacctttagcaagagcttttttttctttctgtgctaacccttttttgtctataacagtcatgtaagcttagcactgatttagaaataaataagttaaagaagacacgaatggcttggacattaaaagtttaagcaacagcttaagctgagctaagtttaatgttaaaaattagtgtgacagcaataatttttcaattcagctctgtcgtgggctaggaaaaaatatcctaatttttcagccacaagacataaacattgctagaatgactacattttgaaaaaattatcttctcactttacctagatttcattttaaccaaacagaccaacctctcctattaaacctgtaaattaactcaaagtctaatctggggccttcataataaagattttttttttaaatccctgtcttatctggtgcctttaaaagaaaggaatcattttaggcaattattatgacctaaaaaatttttaaatcttaacgtatagattaattccttgacagctgaagtcatttacaatacattattaaatttcacattcagttttaaatccaaacatagatctcaacattaagaatatggattttagggaaagtaactagctgctcaaattcatttagctgaaaaactactgtcgaatcaccttgaaaatatacactaatgcttgcacattgctaagtggcttttgattctgctcttcattttcttacacagaatcaaccacacaatagaattaagaactcaggcccatggcaaagtgctcccatttagcagttaggacactggacatattcagcatatgtctactgctattgagaatcaaattatgaaaacaaactatattttataaaactaagaatttgttactcagatgagaataaaggtgcctaatgctacagcagggggtaaaagtcccagtaagagagcaataattggtcattctgatgaggagctgtgccaaatttagaaatgaggcacaaatgacaaaaaaattgatcatcagtgtggacatgggtaggtcagtgtgcatatgggtaggttagtatctgctggccgtgtctacagagccccttttatttatttgaagccaacttttcacttgacaatgctacctacaaaagcactgttaatagataagacaatcaagtggctgttatgccgtggcctttttgtaaaaactgcatgagaacaggtgggataaaaaccatagaaaggtagaaaaaaaaaagcatcactcatttaaagatatgtgcacatagatgaactgtaagataatataaccttcttgaccttgtaaataggtggccaaaaatacttaaatatcttgacgaggcaactattactaattgtctcacaacattaccagtccttactggctgaatccttcagccatctgcatacgacatgcacaggcaaatagccactaaaaacatacacaattccaattatctccttgcataactaaagacaaaaagaacaggaaatccaaaaaatacagcaaaactgaaaacactataccttgccttccgtgctattttaaggctgtcccaggctgaaggttacttctcagccctcaaaactccattaactgccaagaccagcaccttagcacatatggcacagatgcctagttgaagcctccttgtactaaatgacctcaaaaaactgggctttctttccaagattaatggaaacaaaagtaatgatcataaggaaccttctaactctgttaatgtttcctgcggatatgtatggccaactgaatatataaaggctcagttcttgcggggtaccctgacaactagatgaattagggtgaaggttccaagttcgatgaactcttctgagtttgagtgccctaggtggtgacattcaagtgatttcacagacatccaccaattcttattttcaaccgggaatcccaagaacacctttaaacatgcaatgcccatggaccctactgggtttctgctgcaagggctcagtgttacttaggaaccctgtgtcttgggagatacttaaatttagcacgtcaaattgcttttggaaaatgtttatctggcgtgactaggggaggcaaagcaaggaaacaggaacctccctctaaggagcagaatagccaacatgcagtaagcctaaaaaacctctcaatttatttcccggggctatgggtaccagtggctcgccggcatgggaatcagcagcctgggggcaccagtgacagcagaaccggggcttaccttgttggaggccatctcactgacggagtgcctggtctgtagggtctctagctggtccagacaccagtccagctcctccagggtctcgctggccagtttctggtaggcctcctctgcgaagagacagggaaagggggactcagttctcaagcgcttcacgggtccgctagcgagttcaaagggggccatcctgccataccccgccatgctcggatgcccggtgccggcacatgagggctgctccttcatattgcccagcccggcagtgcaacgggggcggaggctgtgctcgcggggcggccggcctcggggaggcacggtctctccagcttggcgtctcgggtcggcctccagggagggcgtgcaaagagcggcgagccaactttcacacagcgacgcgagcggaaaaaccactatgcgacttttcaactgtgcggcgggcccgagtcccagtccaggagcccggctctagcggatggcgagggggtggcgagcgcgcttgggtgcccgccccgcagaggagcgtctggtccacagccggatctcctcggtccccaacccggagccgcggccccacgcccgccccgcctgccgagccttctgcacggcacttgaagtgaatgaatcagccgcggccgggtgcgcggccaccac

SEQ ID NO: 266 - DNA, 70474 bp, Homo sapiens; identical to SEQ ID NO: 265

SEQ ID NO: 267 - DNA, 307080 bp, Homo sapiens
ttttatggtatcaagttaaaaactctttaatatctcaaaatatcttatcagattgaattatatccaatatcaatttgatggctatattcaacacatattaagaacctactgtgtaccaggcatagttttaagtgctagtgatatattggtaagcaaagaccttgctctcatggagctgtggtctggtgggagagacagataacaaaaacaaacacgtatataaatctgtgagaagtgttataaagaaaattgagcagggttatgagaataaagctacagaatgggggatatctcacacaggatggttagcaatggctctgcggctccaggccctgcctactctctcacttttcctcagtttctccagatgtctcaagctcatttatgcctcaagatctttgcaaatgtttcttgtctggatccccttcctcttcctgtcaactttttccctagttacctcttacaatccttcagaactcagatgcaaatcactttctcaaggcctcaaggaagccttctgtggccctccggaacagatcaagttcaggttcctgcttatttaccccactgagctccttcattgtactgatcacatatataattatatgagtattgtttaagcctttgtcccctccagactgtaagctccatgaaagcaaacactgtgtctcattaacttattgttgagtccttaaaactttgtagtttgcggagtaggtaaccaaaaataattgtcaagtatctgaataattttcaatatcccagaatattcaattaagtaagtatggaaggcccctttcaaagcttgcttagaaaacaccatgcttaatcttataggccatctaagtaattttggtaatttttaatgtagcaaaattactcaagttggctttatttggttatgaatatcagtactaacttatgatgtcactatcctttcatttcaaccacgttcagtatcctaagagacatgctgattgaactataatttaaaatgaataatcttttatttgtaaaagattgagtcataaataggcagaatcaacccatgcttttattttcattgcatataaaaatttcatatgaaggtattgatgtacagtactatccccgtgggctgtaagagaggctaagaaaccactaaaagaataatcatttgtaattctcacacacaatttaccactctgaaaatatatccaaagaaataaaaacaactcaaatcagttaaggatgtttttgtaattatagtgtcccctttgtactgtttaaaacaaaagtaatcaaattcctttgggccagggctgctaaaatctacagtttgtgtcaaaaaataaaataaaataaaataaaataggctcatttttcctagaaaaagaatctttcctttcactgaaaagccacatgattcaagggctgggcaagtactgggaggatgtttccatataatccattataaatgtttcctgctttaggggctggccattgtacaaggtgaaattttaaaattctaaagcaatgaaagttttgcagaaacaaatcttagaggatagtgaatgctttctgctatgtaaactgacatcaacccacctttgcgtttaaatagatgggtttacatatatgtaaggacatttggtttatcttagtggaagaaaaattttaggattaaaaaacagtattttctctttaatgtattctcttaacatgtcaggaagctgatgaatagataaccaacacgagtaaactctggctccaatttcaaatcaagtccattttcctatgagctctagaagccaaaaggacttaaaaaaaagaaaaagattgtttataatcactgggaaagaatatatttccccagttgtgtttccgagttaaaaaaaaaaaaaaaggaaataatcaaatgcaagtagctgaagtagttcctgatcaacagatggcaaacaaccatcacacatgcagtgctgctccctggcaagaagtacttaagagcttctgtctcaaaagggtctcagaatctttcagaggttgtctgtggttttgtaaaatccacctattggcagaattctaatcaattaaaagcctggatgtaaaatgcccagccctagctccactgttacctttcaaatgcagcaaaacagaagaaaatattggttaaagttaaggcacagccctgggaccaaagacctgcagctatgtttttttaaatttatatatctttaagtattttatagttttcttgaatcttccataaacaagctctaaggtgacaagactatattacaggagaaaagaaaaatgtacagagtatgtatacacaccattcattctctcaccaagagtttccaaatatatcaacaccatcccatcatgggatgatgttttaataagaacagataatttacaattaacattacagtatgtacattgcaataaatacatggttgtaaacagacaaacaagactgtattacaggtaaggtcatttggtgagaaaaaaaatgcatggcacaaaaaataaataatgcattcaaaaattatcataaagctttctgtaaaatccatttcattcaagttttttctttccttgtctgtaatttgttctatctacattattgtgaattttaactgatataaaacaaaattaaaacagcattattgtgttcagtaacttgcaagctgaaatgcactggttttacacaaacttggacatttttttccccatacagtacccagatattgcattttcttatggcattttaggaaatgtaaagccacttgtaaaaggatattcttttattcttttttaaagcagtatatatttctgaagcacactttggcaagagagaagggcaaggataagcagattgtacagtgcattagtccctgtctcttggatattgagccttttctgcaatttgattgtccattagtgggtatctttacaacacggtaccattaaaaaccaacaaactggaagaaaaaaaaagagcctctctttattagtgcagttataaaccctttaccctttcaggtctggatttgttaatgacatattgctgctttttattttattcattattaagattctaggcactctgtgggggaaatactaagtgtagggaggagaggaatgagaatgttttggaaagaggaataaactctagactctttacctttctttctagacttcactcagggacaaataaaattaaaagaaacaagttcccaaatattcttgtgaaactacttggtcaaacatacgtctttatttttttcttatttgaaagattaccatctgatctttacagaggaaacagagtagaaaccttgcaattaactagttgattcctcttctgctttatgtaaaagatcagagttataaagacataatttttatttcaaaggatctaagcatcagctagatctcaggggactgaaatggggactctcttcagcatgagtcatttgcctggctgatgacttactttccagtccccaggaggctccttgagaagttccacatataaatgcttttcagagttgtaattcttcttaaacgtttgattttccacttgtcagatacccactttggcttctatctatctcaattcttgaatatcaatgtgaaaaatgattatttgggctttaaagtcttcatagagaaggtaaagaagactttattaaggctgacgtggggataaagtcagaattaaatgccccatgatgccaactgctataatcaggtaaacactaggaattaatctctaaaactgtaatacagttcctggtgctgaaatcagccaagagtgatctctaattttttatttaaccagaatttttaccaatataataaatattttaggatgcatcacagtactaaccctctggtgccagtggcatcatcttctttccctccatgtgtttaaagaagtagttcccctctgcaagatatgcttatggatcgaggataagtgataaaggacttcctacacgttatgtggctgtccattaaggaagagtagttgctacacttaaaaccgtttctcagggatgttcctgatatagttcttaatcccatggtgaaatcattaaaaccaaataggattagttgtattggtgtttgttaatatattgttaatattcttaaaaactgcctagttggctgtttaacttttctctgtaaaccaagagtaaaagctagtcatgatatacaacctcgtggttgaaatgaatgttaaccctaacttaactacctgtttcttttcaccggtgacaatggtagtgatatatttgacaagacctcatctagcaaacatggataaggttcagacacacgctaaattataaagcagcacaaggggaaaaacctttttcttactataactggctgtaaaaacaataaaaatgagcatgaaatgtgtggattattagagcatgaaatgtgtggattattagaaagacatgcacttgtgaaatgaacatctagtgacacagcaaaacgttattaggagatactaagtaggaaaacatctaaaaaagactgaccattttagctactgggtatttatatatctcccacttgcttcagacaacacgaactgatgactgagtttgcatgaagcttaagacacatttgatataacacacataaaagtattatagaacaaatagtcactttgcacatgaagaaaaacactggtgaagagcaactctgcttatctggaaagagtgaaacaaaatgcaaagtaaataataaagacttacaaaaagggtttcctgcaacataaagttgtttttctcttttaaaatatggaagtcattggtatataaaacaaacaatgaatcactacaaatcagttaattgctatgaactataaggtgcaagtaaaattcataaattagatttttatccagtgtagcacagatttgtactgaaaacttgcaagttactccttagaaaaaaataaccagtggcagatgaagttctgaacatagttttttttaaatataatacctcaatacatttaataataaaagtaagctctacaaaaaatctgttttacatatcatacaaaatgtagaggtcagtgcagctcactgaaccacactattcagtcatgtatcaggaagacttgaaattagaaaattatgcaatttctgtggctcatcctcctcctactggtaacagattcgtgctatgtcctgttcttgacatatttgttgcttcgtccattaagttcactctgtgcaatgcctttcttctgaaaatattgcaaacaaataaaaaggaatagaaaccccaagtccaataaacttttgggctgcctgatgagtcacactctcttgaaaataatttggagtagattttatctgctttgtcagctctaccaagctgaaatcttgttaaaaacgctgttcgtgaagatgtccaccttgctcggatgacatggaggtgaaaaaactggttacgatattcctgagcgctggactgagtagtcaaggtcagttttgttcaacaaacgtcctggcagatgacagtgaggtgtgaccgtggttgtggcatgtgacatgcactttggaaacaatttttctacttaaaaaaaaaaaaggcatgaaagtttttgcactgttacgtgtcaggagaacgatcatctatgacacaggcttcaggctggctttcctcttcttcccctactgcctcctcttcaacctgttcatcaaggggaatttcagtagactctgagtcttgagtacaaagagtcttggagtcactgcagctagtgtcttcttccacttgactgccactgtccttttccgtgtctgactcaccatcttcctctaaagttagttcaaactggaatttctcagtttgaccctgccggccctcctctgggtcatcaggtgcaggagaggggctctgagggattgtgctctggtaccattcacgattgtcctccaaagtgtccaaaatatcctgggcgtcagggtggacgaggtctgcccatgtctcccagaggggatgaacaatatagtctatgaagcccacctagttaagaaaaaaatccagtatgagtagaggacttgggactaagaaacaatggaaaagcttaattagatcatggcccacaaataaaacactgaacagaagactactaaacttagtttggtaaaattgtcactattttcaacaacaacagaccatttaaagtaaagtattgctactagctggtcaaaattagcttctagaacctttggttaaagagcatgttctatagcataaaaaattttccagttgttgacatggtagggcttattttacaatcaccaatttgtaggtgaatccagataactgaaataatgccatgtgctctatgtatatgaatatattaaatgaatatagtcataataaatgaatatgtctttagaatatatatatgactatatgaatgtaagtcataagaatgaaagttctttggatcataaatactaaggtgaaattgagcttgtcaaaaacaaagtaattttaaaaatccagtaaaatactatcatatgtaatacaaagtaaccaaatgctaaagcggtagctctgttctctctgaaagctatacacttcatgcattacctgtgatttttccacggaagcattgtgcttgtcacacatggggcttatctccatgccacgttccctctctcggtctccttggcggaagaactcctccattatccggtccgtccactggcggtacagctggagaggctttgttgggttgctcagatctgcacagtgcaccatattctgaagaacctaaaatagatggatgcattctctattcactcctgttccttttttttaaaaaaaaaaacaaaaaaaactagaaattcacattggatgactgcaacacttaaaaatacacgtagtgtaagatttattccaaacagctcaaccatgatgtgtctgtgtatagttcacacttgtattaatagttccaaattatgccacttctactgcatctaaatagcttaagagaaactgtttatgtgcatggctgactagattcagagctgcttaagtggctggttctgtggggtgtttgtttgttagtttttttaattaatgtagatgcaaacagaaagaccagtagaattttacctggttaattctcaggaataaaaatttggataaaaatcctgcctacaattgctgaaagtataaggtgggagaaggaagaaatacatcttatcaaagctgaacacgcagacatgtgcacatgtgcacagacacacacacacagagcaaactcaaacaaggctttacctgaatcctatcggaataattatcaagaagaagaactccagagcttgtcactttcttagtttcaaccatagtcttcaaatcagccagtagattcatgtgttttgacatatctgttgcaagtaccttaaaatatagagtatattattaagttcagagaaaacagaatttacacatgaaaatattacgcagaatataagaatgaaaaaggaataaaacaacactatgccttttaatgacagtggaaaatccttactactccttgggggcagagtcttttcccctttgctatcaagttttcccaaagcccagataaatgtgtgtaatatacagaaatgctaggcactgacaaccactttcatggtgaaaaatgggtgacatctccatggataagacatcatcacaagtttataagtttttgaaagctagagattttcctgtgtctcataatcactgaataagatgcatagaaaaaagagtaaagtcatggatgtctaaatggcactgtctactgatgagaaaaggtggggaaaaaatccatttgagctgtggcccacacaatctgcttttgttagtcatttttctctgcccgccaccagactggaggggcccagaaaataaatgatgagggtgagctgacattattctcaagtccaaactgctagaagtgaaaaacctattacagaacatcacagccagcatcacgggcagcttctataacataaagggccataatatgttttgaaatgcagttccttttacctaatactcatcttgttcttatgtctaaattataaacaacttgcatcacagttctcttctttggcttttatcagctacttacgatgtcaatgaccattttccttaaagattgtctttgttttttggtcaaattctggaaaatgtcacagttttcttcctgaagcaatttaaagcccacagccaaatgatggttctctaagactgaggaatcattgtacatcaaggcaagttcagagtctgtaaaaaagacaaaaggccaaagatcagcaaaactgtttgtgagaagtttatctgattcttaaaattctggatttaggatgtaatttcccctaaacttctctgctgcccttatcattacctgacaatatccaggagagaataaatcagataacataagagcaggaacaacactggaatgaatcttggggagtgaattctaatgctactaacatgtggcaggtcatttcactctgtaggtctcagctttctctaaagtgaaagaattggatctttaacctctcctctagagttgccatgagctcagcagaatatgacattattcttagtatctataacacatccagagcataaggttttgtattcctgataactgtgaattacctaccctgcactatataaagtgaggatcctgtgttacaggattgtttgtactcaaagagggtacaagaacaataaggaatcatatgaacaagtttagatttgctcatttgctcatgtatagctctgaaagtccaagctttattcattgttttccattttcttttccaagtatcgtggcagtcattgtatactgtacagggatattgctcttcctgcctgcttgctcacagcttcacagtgatgttgtgtttggctgtctgtataccctctggtgaagattctgccactctctccctactgccctagacctgtgaattttaggcagggagagattctgcctctctcctacttcttgtaaatagcagacccagagctacaagataatcattaaaaaacttttgatgctttattctctttccacttaatcactgtaaagactaaaagcaaatccgaggcaggaggattgcttaagcccaggagttcaagaccagcctggtcaacatagggagacctcatctcgacaaataataaaaaattatctggggatggtagggcgtgcctgtagtcccagctacttgggatgctgaggtaggaggattgcttgagcccaggagttcaaggctgcagtgagccattatatcgtgccactgcactccaaactaggcaacagagcaagactctgtttcaaaaagaaaagaaaagaaaagaaaaaggttaaaagcacaggtatttgatcttttttctaacgaatgcatagaaaatatataacgaatgcatagaaaatatatttggaaatatatatctttttttaagaaagaaatacccaatactattcaatggctattttaatggagctaggaaggagaggagaggcttaagacattttcaactgagaaattctattattttatcggaactatagaaatacaaatttgcacacttaaatttctgctcccaaactacaggagcagagctgtttagactagtagggagtaggtttgtacagtatttttttgttattttttgttttctttagataaaacaatagtgtttatcttttaaaaggcagtttctggtgaacttttatagtgtctataaatgcctttatgaacctttatctacagataggtaagcatatagaaatgaaaaatttaaaactatataggttcttagcacatattattgtatttctacagtggaatcaaataaacaaacatatattgaaaggaaggcataattattagatactggataattattagagttcgtttaaggaaggaaatatgcatgtagacaagcagtgttaacagaattgacttagccttacaaaaaccctaattggcttatatgaagctgaaggtgaaggaaattaaggctgttgaccctgcaaaagaataagatgatgagctcttccttcaaggaaaagggtgatctgttgtatggaaggtgcaacaaagagtctgagttctactggatataagtagggcctttcatgtagggcagatgtccaagaatactggcaaggcctgtcttggagagtggttatctcctgacacttaaagagtccagattggctagaaaagccaggaaaggatgccttagtggactggcaggcctccatagcctcttccatctcagatgctgttacaggaaagtggtggtgactgttgatttttaaatgaacaaatgttagcatttaagaaactgaatctcaaggaagttatttaactttctactcttctttaggactgaaggcatatggtcacatttaaattgggaggtaggagtctgcagctcctcagcagattttcatcaaagacactaatccattacttgtaagtagagtccttgaaggttcaggaatgatcagaaagttgctgtcaggatggtacagtgcacagcacagaggggcaaagaggttagcttatataacatttttgttgaaaccctttcatcttcaagcccaatataagttacctcttccatcaagtctttcttaattaccagatgaaactgcccactttctcctgtaaacttctatactactttgtaccacccatttagcatgtatcgcattctaccttttttgtctttatctctacaaatcttttaatcgttcctccccaaaccctcccaacctacttagagacttaagcccctacaaaatattaaaggttattaatttaatatgtttggttatctggcttcccctaggcacttcaattatttcaaacttacaaagtacaaacaggaatacagcaaggcacaacatttagaggatttaggtgccattgtgttaaatggtttatgtgaatcatctcatttaatcctcataactcttttaggaagatactgttgttatcgacattttaaggctatgttccattcatggatggcatggagccatataggtgggaagtaagtctttgtgtccttgggataggctgggggatagaaaatgtcccttggggacatcttttatacacataaatatttacatagacatactcatataatcctgtacaaatgaagaaaatgtacctcagagaaggtaggtaactttgccaacatcacctagccagtaagtgctggggccagcacttaaaaccaggcagtttctagagccctcaccttatactgactatgattacaagtaccttatagaggtgaaaacctgagcagtgaacactaaacatgaaccaggaaatcaacacagtccactcagtgcctggcacacatttataaagacaactttgtaagtatttattttttattgagaggccatgcatacctttacaaactcaaagccatcattttattatatatagatcaattgtgctcatttgttacaactaccctggatcatcaagaataaattaaattatgcccaacatatgctactactgaaggcaggaagaccacttttgtgtccctctcttctgagtgctaatgaaatggggggaagggtgggcaggtactaccacataactgagaacatgtacttcatctgtgctaatcttttctctctctgtattaatcatggttctccagagaaatagaatagacatatgtatgagtgtgtgtgtgtatgtgagaaaaagacacatttatttattataggaattggctcaggcaattatggagtccaagaagtcccatgtctgcaaaggtgaaccaggaaagcaagtccaaaggccagagaatcaaccaggaaccctgatgttagaggcaggagaatatgtatgtccaggctccgagaaagcaaattgcccttcccccaatgttttgttcttctctttgaggtcctcaatggattgactgatccctgccaacaatggtaagggcaatcttctttaatcagtctaccaattcaaatgctaatctaatctcttccaggaacactctcacagacgcaccccaaaatagtgttttaccagctatctgggcatcccttagcctagtcaagctgacacataaaattaaccattacaaattctgccccttgtcaccctggtacccataagcatctcctttaaccatatttaatctccataaggccataattctaccaaacaggctacaactatcctgcatacaactaaaagcacactaacacattccccagaagtgaaagtaaagtttttgagtaatgtttactcttatcctgatagcctataacttaaatactatgatataaaataaatacttaaatactaatataaagttaatacctcttatgttatataagggaataagaaaaagaaaatgaagataagttaatacctcttatgttatataagggaataagaaaaagaaaatgaagatatatgcttaatatatgtatatatacatataaatgcattcataagaaaatactcatgacaattatagtccttatttctataactggtcatatggtcatagctggtatttgtaattaccttcttttactactcattctgtattcccttttccctcagcaagcacctcagctggtcatgattctttacctggtggggtgaccgaaaccttcattcgtgaagggtatgggttattagtggtcctgcctggattgggttattttgtgctgaccttaattacagggcatggttaatactaagggatgccctaagggatctccttattccacacatactcttccttaccttcattgtggagtagtaacccaatttccccttggtagtcaggatcagtcaccccagtcaacactgtaatgcccttcttggatgattgaatcagatgcataaggagctcaaagtggctaggtcttaacttccagttcaacggaatcactgttgtgtctcctgatagaagcattcctccttctgaaactaagacctctagctagcagcacataaatttgcaggaacaggaagcaaactttgctagtgggtcactgggggtaattatgagtcgtaacagtcccatttctatccaatgattcctggacccatgaattctggttatgcgagaaatagcaccacatattggatgctgattcagagcatatatggcctttatggccttctggagaaccttgccccagccctgcaaggtcttgcctcctagctgagtaactgagtcttcaaaaggccattctaccaatttatcaagccagctgattcaggatgttagggaatatggtaagactagggacttccatgggcatgagcccagtgcagctcttctttgccagtaaggtgagttcctggttagaggcaatgctgtatggaataccatagttttggcagaaaaactgcagggaaggcacatctgtttccagagaaagtgccttttccactaaggacaaaatgctaccctttccaccatggaagtggtccaatgtaatcaaccagccatcaggtagctggctgatccccccaaaatggtgttatatgggggttcagtgttggtttatgctgctggtggattgcgcacttagcaatagtcatagccaggtcagccttggtgagtggaagtccatgtttctaagcacatcctgccacctccatccctgccaccatggccactttgttcttagcatgttgggtgatgacaggggtggctagggaaccaagttgactagtatctacagaatgggtcatcctattcacttggttattaaaatcctcctctgccaaggtcacactttggtgagcattccttttttgtccattcagagagatcattcacatatctcttccccaaatttctttctcaccagttttccaatcatattccttctaagtccctcactatccagacaaatcattggctacggcccatgaactggtatataattgcacatatggccattccctcttccaagcaaagtgaacaacgagtcaccttgcctaaagttcttcccactggaaagactccccttcaccaccatccttcagagatgtcccagagaggggcagtagtgctgcagctgtatacttccggtggtacctgcgtatcacgcagaaccatccgtaaaccaggccctctgtcaactacttgcagggaactttccatgcgaccacatgtgtaggctgggagaaagaaggcagtgtaattaataggagtggcattagggccacttctttatgtaatttgtgcctttagtgtctgctcggacctgatagatcgtgtattacactacttttatttgatgatgaaatgtcgtacatgcccaacatatggcttggcgcgttagataataccctattaatgatgggcagacagcttaaaccacatggaaacttggtggcccatagtcagtcagtatctcctaaggcccagcagcaggcctatatctttctttcaaaaggagagtagttagttatctttctttggatgatggcagggtcttgctccagagtctgtgctgtgattcacacagagggctctgtcaaaggctccaaacaacattcctatctgccactgacatttcaagcaccattaaatctgctggatcatgtggcccatgtgcagagcagcttgcacagcaggctggacctgttgtagagccccactcaaaactagcagtttttgtgacactctcttgttctgtgccccatctaaactagcagcttttcagatcacttagtaaatgggccagagtaacacacacaaagaaggaatacattgcctcccaaatccaactaagtccactaggtattgtgcctttttgtgtcttatgatggagtccacatggcagatcagagccaatattaagacctggagctgaaacagttaagactggggcagacactatagatatgtatcctgtaagtaagacttacactcactgttcttacagctttactaggcttagccttgagttagttagaaaatgacagcatgctacaccatgtctctaagttacaactgaaataaacataaatcttcaaaaggacttcagaaacaaacatttctccatgaaatgacagagggaagtggtggttttaacttaatattcagttgtcaagaaaactgcctcattcatcactccactctctatgccctcaccctgcattattttcctccatagcacttagtaccatcacatgccataaattcacttattatgctccaccttttctagcagaatgccagctcttaagagccagggatttgtcttgtcttgtccacccatgtgtcctaagtgcctgaaataatatttattataacatttagtaggcttgcagtacatttttgttgaataaaataatctctgtagctatatctatataatcacatttgataaacatgaatttatccttattttgaaggtgtgggtttatacagaaaaataaaattctacatacaatctactagtgtagctatgaaaattttaatttcaaaataaaagtagagaaataaaaaagtgtatactgacagctagatacatcttaaccttaatataatgaaatgcctctgctcttggaaaccaaaaaccgcatgctttgaatgcatcactaatgtgaataaatctttctgccccaaacttaggcatctttgctattaacaaaaataattcatttgccaagtaaaatttaatgctatattctgtacttttgatactttttttcagaaaataaagctaagttaaatataccctccagcattttatattcaaaagttcatgctgctatttacattttatggatttatttatttatttatttatttgagatggagtttcactcttgtccaggctggagtgtgatggtatgatctcggctcactgcaacctctacctcccaggttcaagcaattctcctgcctcagccacctgagtggctgggaatacaggcatgcgccaccacacctggctaatttttttgtatttttttttgtaaagacagggtttcaccttgttggccaggctggtctccgaactcctgacgtcagtgattcacccatcttgacctcccaaagtgctgggattataggagtgagccactgcacctggcctatggatttatttatatgcatcatcctttaaaaatatttacgcagcttcctgcctgaaatttcaatttctctaaatcctgttcacagtacccacactcaaatcatttattatagcttaaccaactctaccaggtagaattgttctctctgcttgcagaacctccagcatgctttcaacgagtgtaaatacaattagtataaaatcatttggcacctaaagctaaaacaactgaaataattaagaaaaacgaagagcacatgtaagaagcaggaggattaactgccctgggaaccagccaagggaatccccagcgccccccatgtgccttaagctctcagtgcttccgtagcttccttaaagtaagacaagtaaccaactatgggtttataaatttgataatcagaggtctttagaattctttattatgagaaatatggattcagctgcaggctttggacaggatggcagctccagctctgaggcaagagctgagaatgtgctggcttgacacatggatgctcaagccatccataaaatataaaaagtcaaattttaaaaaaggtttactgcaaactaaaaataagcacaaattttgataaaatatttcacgaagctacatatcacaagtttacaagttattagaaggattcctttactgcatgctgggaagataattctcttacatgatccctagccaaaccaaactaactaaggctgtaattttgataatgccctggggcccggaacaaccctgggatactttcctgtacaaagtgacaatgctgattcattccctcaggaataacacagcctcatcacacctcatcgtcaaaaaaactttagcaatccaaagctactctggcaactgtgaacttccctatgtcgctgtggtcacacagaaaggagatcattgcaatattactaaataacaaagaaagaatttgcagcggcaggattagttatccttccatcccaggcaggtcaccagcaaaatgactttaaacagacatcctaaggagataaaattatcttcttcagtttcctccactatttcattggttctcaaactttagagtatcagattcatctgtagactgaggccttgttagcttaaatggcagactgcacagggaccctgatgccagggtcctccaggtgccagtcaaagcccaagtgccctttaaagcaggggtccccgatccatccatcggctgtggaccaatatcggtccgtggcctgtcaggaactgggctgcacagcaggaggtgagcagcaggcaagcccgcatcagtactgcctgagctccgcctcctgtcagatcagcagggacattagattctcctaggagcgtgaaccctactgtgaactgctcatgcaagggatctaggttgtgcgttccttatgagaatctaactaatgcctgatgatctgagatggaacagtttcatcccaaaaccattctctccctgcgcccccagtttatggaaaaattgtcttccataaaacctggtgcctggtgccaaaaacattggagactgctgctttaagggctcaaaagaatgaagaatagagcaggtcctcattacccttaaaaaatgtatcagagtacttggaagacagtgacctttctatcagttgttttaatttgtcttctaaatctactcttaattctaagggaacatataatatgctatataacagaatgcaaagaaaacataccagtttgaatgtttggtgtttaagatagatatatatatatacctttaacacaaaaattttatgtaaaaatacattttatgtatttactaaaaattgataaaattcagaatatctcaagacattcataagcatcaaaataaatcaggccaggctcatgtaaagtgccagcatgcactgtattgcatgacctccctgctcttcttagaaaggacataatgaaccctccccactgatacctccccactgataccatgtaaatgcagggagctgcatccaatgtatattaatatttgtatgtatgctttgatgagttctaaaagtacctcattataggtgctcataggtaggtagaacatgaaatgttatcctgtctaatctggataaataagttcctaaactaaacttgtaaaaaaatacttgactaaccacacatctcaggaaatccctgacttttccagtcctctacatggatgagtcattagagtatattttgctataggatagtccagaggccattataagatataaaaataggtaaataatcctaaagctctgaattaaatctctcaaagcaaggttacctctacattccttctttaaatctggctacagcaaagtacaggaaatgaatggtgaattcataaataattctatagctagattgctataggcacgagaagactattattcatagcctcaagcaaaaatgaaagaaaggtggattcttaagcatacaacattttcaacaactttgcatattttttatatataaaagtgaatttatgattttataatctaccataatttataatctaccatatgggagggaattaagtcatagttcacttaaatcacttaccaattaacttcaagtaccaaatagaatttctataaacctaaatctctttaccaagggatagctcaagcattacctaaacattccctacacaggctttctgtgcggcaatgtcagagatgctccatattaaacagtctctactattccttatatttccaaattcagtgatgacttcttataaggtgagatgttaacagtgagaaaaaaccaaatggttgaaaaaatattaagaagttcctgttacccttattagaagattttaaaaaggaaagaacaggggttgggcatggaggaggaagggaagctatggcctctgaagaggattaaatgatgacctacataaagtgaggaacacttaccattaattctcataactttttttttaatttaaaactttagggccaatacaactttctaaatctttctgcacactttcatttttaattacccttgtctagtaacacagcaatatattacttttaaagagaactggaacacatttttcaaatatcacatgcctcaagggatataatgataattttcagttaaattacattaacatgaactatcactaaaacacatatatacacatctcaaaagaacattatggctctggaagactctgagtttataaagacccttagtcattctaaaatgtacaagggaaaaatgtgttctgaaaaaataaagtttacttacttgtattgatcagaaattgattggacacaccaggatgatctacatcatgtattgcactggcaaaaattgctgcaagaatctccaaatctgtaaacacagcctggaaaatcagacaatatagataatattactattctacaatgatatgaattaaaagtataaacaaataagaaatctctagaatttaaatggaaaacaaaatgaagcttcaaaatgtgttacaatgtgtcaagggagagtcttagatacttgtgaacttttaaagtataatcttggaagaaaatattttatctaattttattacatctcatgatcaaatgttttccattcactgtattttttaaaatattattttaaaactctgaaattattttaaaagaaaataatagtttattttctaaatatttaagatgtctaagaatattctgaaaatgtacataaaattagtaagacattagcaattattttctttcatcgaaaccagggtttctcaacttcagcactattgacattttgggcccaataactctttgcgtgggaggctgtcctgtgcattgtaggatttttagcagaattcctggcctctaccaacaagatgccagtatcatgtacaactaaaaatgtgatagttgtgacaaccaaaaatgcctccagacattgccaaatgtccctggtggtggcaggagggaaagaaaggggaagagaaaccatctccagttgagaatcactcacccatatgatgaggtattaacataattttataatgaaaacaaactgaattataaaatatatttcttaagaaaatcaaattgctttagtaaacaactaatgaaataacttcttaggatttagaaaaattaaagtatgtccttctaatatattctatgaaaaaatatcaatatattgcttatgttttataaaacgttctttggcctataaataaaagccgtcagactagatttcaagaaaacaaatgaacaaaaagtgagtaagccagatgtgctttatgaaatgttcagtggatcatttcaaagaagcaatatcataaacagatcaatcactaaatctgtgaccaactttcataagcaaaatccatcaaagacttgattgtctattaactatagcattttcccccataagtcaataagttatacttccaatgaatccaattatcttctccattgaaaacccttcagataaaagtttaatagacctttatgagtggcaagttagtgttcttgaaatttcagaaacagatttacctccaaagcaggtgtagataatagcacatgagtagactggacaacatctgcagcatggatattgttgtgataggccacatcagcatggtaatggtcttcgagagtcataagatatgtaattaaagtatctactggaattttaaatgtttttaataaatcccgttcctgtaggaaaaaaaatcatcttaacatttttgtctttatgtgaaaaatttctccatagagtatgtttaaaaaaaaaaatcacacaccagtgttgccagtggataacctggaaatggcaactgcactctcacatgtctagtgaggaaaatgggaacctctgagaagatccagggactctgggacaaaaccagagttgggttgtcctgctggaacccaagaatactacgccctagctgtatggtgtcaggaatgaggtgccaactctaaaagtttctatgtcccattatcatggaggcagctccagtcaagcactattaactcaacccctgcatcacaccaactaaaaatcaacgtcctctctagggctgaagtttcccatttcggtcccgagatatctacagcagcctcaacttctcatttaaatcccaccctaagctggagcaaagggtcaataagagagagaaatggatatgaagaaagaagcaggacacaagaaagtgactgaaaaaactatattctaaggttagtagccagcaggggctttattcattttttttaagttagtactccattctctatgcagtcaggttcagatgactaagatgatgtctaaattattattttaataaattgcttcaatttggctatatcacatctttttcttaaatgcaaaaaaaataacaaaattgatgttatttgtggtttatccacactccacctttctgtatctttacttgtcccttggcaaaggagcaaataaggataaaagtataaaaataagcaaaaggtggggaatattaaaaaagacaaaatgtatgcataagctacagactggacattaagttcctaaataaaataaatgtaatagaactcaaccaccttacctgaaaaatggtgtgcatgataacagtcaagggccggttaccagacaactctgctattctgaaaacatgaagaccccatttgttcacatcttctagttcctggagtgaaaaaaaaaaaaagatactaaaatattagaaagtggagtaaaatatgactcaatgaacacaatcatttaaaaattacagaccttaggtggccgggcatagaggctcaagcctgtaatcccagaactttgggaggctgaggcgggcagatcacttgaggtcaggagtttgaaaccagcctgcccaacatggtgaaaccccatctccactaaaaataaaaaaaattagtcaggtgtggtggtgtgtgcctgtaatcccagctacttgggaggctgaggcaggagaattgcttgaacccaggaggcagaggttgtagtgagccaagatcgcgccactgcattctgcaatccaacctgggtgacagggcgagactatgtctcaaaacaaacaaaacaaaacaaaacaaaacagacttcagtgtaaagattgttagattgttttaaacaatgattcattttaaatgttaacagacacaccatgtaagcataggcaaactttaggcacatttacttaaatgtactgaaaattgaacagtatggcttaaccttgtgactttgacattacaacacatttatgtactttttaagtatcaatcacaaagcacttctttaatggataaaatctattcacaaaaccttaactgttttcctaaaacccagaagacatgacagatttctaactctttaaggccaaacaatgaaatgaagatgcaaataatcaccccccaaacccctaaaacataccaaaccacctgtctaaggcactttaaaaggagctttataaaatgccttcccatcttcaaaaaaagaaaaaaaaaaaaccccaattaataaacttttctatccatttaaaagactagaagtgaaaattcatgaaagggcatcatttaatatttatgatcctgatctttgaaatcatcataccttggcaaggacatcttcttgttcagttttaactccaaaccttgggatacttgaattagtcagactagagctgtgcatcaatttcttgactccactgatctgagacattggtcttttctttttctccttttccttctgagttggagaaggaatttccacttcatgttgcttatcttgagaaatttagaaaatgttctatatttattattaattctatctgttttatatcatatgcataattggaaggattataattgatcattatatattccaggaaatgtttccaactaaaaagtttccttttagagagttcagtatttacatttgaattggacttaatttgatgtcttcaaacacaaaattaagcaaataagttccattacaaaataataatatcaaatgtattccatggttacctctttgatacaatgtcctaataaaaaatgctgcaagacttagcatgacagcagactcagaatacacaacaggtggttatttccactgttcaattccattcctttgtgaaactgacttaatgaactgaatattgttcttgccaactaaggactacagtttcaatacatactttgaaatggtagaaactttatacgcaaatgtcatgaaaacagcagtatataaaactaacagctaactgaaatgggtaacactgtgggagctgaaacagcaggttttggatgacttagattaattctgctactttttatttctgtatgatagtgagataagggttaaatccccaggttttatgggagcatagagaatcataaatattacctgataagtgaatacgtacataagctaattgtgttctatagtaaaagacctaagatatcttcttactttcatccacgatttcaaggcagtgatgagcaactctaactcatccttatatatagaacatattctaagtgtttaataaatgttaactatatataacagcaattttgttttgaaagtaagtccaggatacattcaaattactgacctttatttactgcattttctttctgtggatgaggtacaagagttgtcccaggacaccaaactcagctattattagcaaacttttatttagcaattgtattttatctgcccaccagtttactaggcttgatgtacacaagacggtaaattcatcgagggcaggaatcatttctaatttatcattaaacacctattgcccaacaatggctggcatttaataagaatttgttgaagatatgaatagatctctctataaaatatattttacagtttggtactatgaaaaaatggcaatatataatcttaattcaagaattcctaaagtcctaaataaaactaagaaaatgtaccttgtcacctgcaactctaaaactcagaggcggatagtgtcgaattattaatatgacgaatgaaaacaaatagaacttctaacacttgtttggtttccaaaatgagttggcaccccaatcctcctacaaaaacaaacaagcaaacaactgaagaaaaaaatttaattgcatgttgttattctcacctaagaatgtgtttgatataaactctgacacttgatttccagaccgactcatttcagagagatgggtgagctcccgattaagcatccttttaaactgaaaaacagaaaagtaaaatgaaataatagaagaggaaaatttaagtgaaatatatatgcatactctgagatacaggaagatatgcccaaagaatttttaagttgtcctgacaatttagaacagtgccttccagcagaactttcttcaatgaggggaaaacaccataatcggtgctgccaattatagcagtcactagccacaggtggttactaagcatttgaaatgtggctagtgcaaatgagaaaccaaattttgaattttatttaattttaactacttttaatttaaataatcacatgtggctcatggccaccagactgaccagcacaaatttagactcccaagggctgaagggaaaatcaggagaaataagcaaagaaaagggaattaaaaattaagatgtattattagttatttagagaagagagaaactaatttatagcacataaaagtgttgccatacaataaaacatggaatgctttcttcaattaatttatcattagcagaaatgaatatatatactgatcaagggctcaaaatttagtcttttactccaaagcaaaacttaatagacttgagtactcttccaggactatggagaagtaaaatatttaaataaatactgtataatgtttccttttaaaagttgtttttcaagtaagagtataacacttattgtttctcaacatccacaaaatttaccattttcccaagtcactaaataggaaacaggtcaattttcaacaatctacttcacagtttttattactgatgccatagtgcctatttcattgaaagaaacactggaattaacctaccaacaccacatggcattaccagtatccaaatctcccaaagattttacacttctcccacccccatcagctgtttcttaagcattaagcatttcagagtcctttgactctgaaaacaacccgacgaggccttttaataagcctttaatatttgccttaatatacagaaacaatgtattttttctacacatagagtaactgctattagatacttgacaaaaaaaagtcagatgcatttactctaatcatcagattagcctttaaaatttgaaatttcaccataaattctcatttaagtatgaaggtaagtgttgaatgtatattttagtgatgtttgaaatataattcttagtatttaattatttagaattattttgcttctctgcataattcataccaagatggcctaactctataccgtttgctaaataacttccaaagtcaatcttatagaccatctagattaagttttaactccgcatttaactgttatcaaaacaaacaaaaaaccctcaaccatttcaatggactgttggatgagagaaatgtgtattcgcatgccagcgtagtcaaaaacaaagaactcgtcatttacattgggtgtatctcctaatgctttccctcccccctccccccaccccacaacaagccccaatgtgtgatgttccccttcctgtgcccaagtgttctcattgttcaattcccacatgtaccctagaacttaaagtataataaaaataaaataaatgctggggaaaaaacaaacaaacaaacaaaaaaacaaagaactggcatgaccagtacaaattctggttgttaaattactggtctagaaagcttagtctcaaactcaggaacactaaattcacttctttgttcatatgtttttataactcctttctaattataaaatgtacatgtgctatagaaaatgtagaaagctataccaaaaaaaagaaaataatgtaaatccccactgctggaagataaccacagataatttgttaaatttccttttatgccttttttctacccttgtatgtgaatacatatttttaaaactggcatcaggtggtatacagaacataggttactgcttgtgttcactcagcattatatcttataacctactgaaaaaaataaactttgggccttctaagaatatttgtagacatttataatagagttcaaaattttttctgtccctctttacaaagttatattttcttgagtaaattatgggctatcatataatttaatgagctaatatagaagtgtcttctatttagcctggcacatagtagatgctcaatattatttgagttctttctcccagctcactttctggcacttggtccataacttttgggccttttaaagtaatagctgatttttatcattgcaggtcagacagatgaaggatttgactgtagttataaccataaaaatagttacttaaatagctagctcctctttctcaaatcccataaagaatttggaatagcattagtatgggaaaccatagctatgtctcaaaagcacagctaaaatgtcatgcatacacaggtttaaaaaactctttgcttaagacttggagccaacccaaatgtccatcagtgatagactggattaagaaaatgtggcacatatataccatggaatactacgtagccataaaaagggatgagttcacgtcctttgcagggacatggatgaagctggaaaccatcattctcagcaaactaacacagcaacagaaaaccaaacaccacatgttctcactcataagtgggagttgaacaatgagaacacatggacacagggaggggaacatcacacaccagggcctatgagcgggtagggaggggaaggacagcattaggcaaaatacctaatgtagatgacaggttgatgggtgcagcaaacgaccatggcatgtatatacctatgtaacaaacctgcacgttctgcacatgtataccagaacttaaagtataataattaaaaaaaatttgctttacagataaattcacacttggaaaaatatactcattaggcaaagcatattccaaagaaaagagtctgctaaacattttaaacacacattcaatgaaatatctctttgacctaaaattgttcatgttatgagctaaaagttgctattaagaactacctggtcatgacaaagtcttttttttcataaaagataggagatgaggcaaagctttcaccattgctagaatctcagcagtctatacaggaactgctgccctccttgcacttctctcaataaagcaaaacaagggaagccttctgggagtgattgataaagatagatagagacccagttatcacaggtttatcttctaacttgtacacaaactagtataaggattatgttgcccaaagagaacatgtggatgctacctgcagatatgctacatatattattggatttttctaaaagaatataaagaacgaagtataattttcctggcagtttgcttaaacaattcaccaaaatagccagttagtacagataactgaagaaaaaagccagtgaaaggaatctaaatattgtacagactagataagtgacatcctgcatgttcatctttctggtcatatacattattcccagagtactttccagcctttgtttaaaacacaaaaacatggattggagaaatcctccatcacatgcccacctccctaccaaggcttataagggactccaaggaagtcaacatttcattttaacataattataaaagacaatatttgaagcaattacttctctactctaggaagacggtctaaggaatttcctaaagataattctgaagcgtacattaagttataacacaagggtattttctaaaaggaattaacattgttttccttttttgctatccatataaaagtttcagtccagcaaagctaaatgaataaccacaaaaattaccataagtgctttctcaactggtagttgatctcacaaattggttttggagtgcatagctagatgtactaaaaaaatgcactagatcattcaacaaacatttaaaaatgtgatacttctctcatctaaaaataattatataatatttactaagataactacataaaattaccaaagggggaaggactgatttaaagctaatacaatgtattcttctgggaaatcccatcatatttctcaattaatatatttagaagggacaaaacattaaactgctgtttgaaacgaaccgattgtaaaatgcagaaccatttaagcatttagtttatttttttaagtgacctctaaatattttccattgatgaatttctaattgtttttggcctaagtagtctgaaaacaatacacagatttagggttgcaactaaaaaaacgggaggatttctaagtgaatgcttttgaatcctttgttctcattatacatcagaatgtctgtgtacagcagttaaggcataaaggaaagtaaaaatgcagttgaatctcaatactgtattttgcttttcagaactgcaattcttcaatttacattaggcatttaagattgttcaggaagcaaactaaaataataaaacaaaatgtccttaaatgtaatctcctttacttctacatcacgccagtgtgctactgggtatattatatatcctcccaatatatatttaaggaggtggtatgggtccaatagtaagaaaattttcttattttttcctgacaatattctgctaaaaatcatttgaatatgctgcactgtgatgcattacaagtttggtagatatcagtattcaaagttatttaaacaaatactccattgatggtataaaaataaaaccttcaaaatgcataagaccaaatatatctatatttgctatttttacatgtttttaaaggtacagtattaaacataaagctgtccaggaaaaattttcctcaaaaagaaacgtactaaaattctatatgtagattcttggcaatattgttcataatcatagtacaaatggttcataatcacagtacaaatgtgaagcccttcaaaaataacatcagttgtgagctggctaaaagctaggagctgaattctggcggataatgagggcttcttatatttactctctatacttttctgcatttctgaagatttttagccaagaaatggctaacaaaattcaaataatggaagtctatatattttaaaaacatttttaaaaatctgaatcatccacagatttaaagggaggtaaggaatcatgactacttggacaaccaagactgaaataagttttctaatttttttagaattcaagtaaatctctaaaacaaaggggaacttgtccttcaaaaagaaagaaacaaagcaaacgacaaacactccaatctgaaaaatcctcagagtaacagaaaatgaatcttttaaaatgtgttgtgattggctcccaggttcaagcgagtggctcaaataccaaaaatctgtgaagtgatgtttcatttaggactgaataaggtttttctacctccttctattgtggagacaggatcacaatgctaatgttaccacagggcatggaaaaagcctgccaagcatggacacaatcttattgaattgtttattaattcatttcttgagattcacaaaacagtgtaataaaaactttgttcagttttgcaagtataatagacaatcaagttttcactttagtatcacttacatagttaagtaatgtcaatttttaatgtcacctagggctttatagctaaaggtgaaaaaaacgtattcctcgtcaggttaaagtagtatagatttttagaaacagccacaaattaattttataaactttatgtgcaacatactaactggaatccataaatcagtataagtaatttggcccaataatttatttgcaatgaatgtatttaattaccatatatttttcaagcacaattcaaacatataccacatgacaaacagaagaactactgcgtatctaaaaaagctattttaacactcaaactacaactgatgaaagttatacaatcttatcttgaccactattaacacgtatttcttcctagttcatgtgtaaggaaagaatacataactgatagtttgaacaaattacagtagagtctaagctttctaaataattttgtaatcagagtaaggagttttcaaaagctaagtaagtcttacctttatgtagccccaagacactgacagtaaatagtttgcttcaggcatttttgattgattatatgtatatatatatatatgtatatatatagtaagctctaaaatgtatttagcttcaaaatctcgacactttaacaacctccacaagccacgcagagtatgagtttttaaagatttttggtaattaagtatacataagaaagcctcgcattaaatcccatccagccgtcttcccatcgaatacatgccatttgtaagactccagaatggcacaaaattcagcaactattctgaataaagaaaatccacgtgataaaggaatatctaaagatctaagggtctgcatctttctctcccgagctccagggcttaatgaataatgtatgtcaagatgcttagttgcaagaaaggctagtcctgtcaaaagctaccaaataaggaactgcagggaagccgggaagagtgacaagaagcccctcccataaaaccccaactctgcaccaattgcattccagctcttagcctataaggcgagggggtgtggcctcggtgcaggctgctttgggattggttggcaagggccagcctctggggaggctttctcctcacccgacaaacgccattgaataatggtatccctgcagctctgaggccaccctgagaaaagatgaacggggcttccctcttgcagtgatgaataatgaccataaaactcctcaaaattcgtagttcattcttaagaattgcccatccttttggagggcattttctatgaattttaatgtcctctggcttcccttccttccaaataaaaactgctccaaaaatggcaatcgagcattttaattgcttccctctctcaaatccaaaacaagtggctccctggtgatgtagaaatgactgtagttctcccctcatccaacataaaagcatagggattaaacaatacgactaatgtccagaattcacagatggcacagatggcaatgacacattccctcacctgtgtgccatggctgctctcagctccttttgtttctattgttatgtatgacagagttctaaaaccttcaaaatctaggggtgggaccacttgcaattctggggggagggaaatgtgaaagctagggcactgtgtatgcataaggaatgcagtgttttgtatatagaactcaggatctgtattttgatcagaagagaatattttatttatttatttagagacagagtctcgctgtcgcccaggctagagtgcagtagtgcgatcttggctcactgtcacctctgcctcccgggttcaagcgattctcctgcctcagcctcccgagaagctgggattacaggcgcccaccaccacgcctggctaatttttgtatttttagcagagacgggatttcaccatgttggccaggctggtctcaaactcctgacctcaggggatctgcccacctcagcctcccaaagtgctgggattacaggtgtgagccaacgtgcccagccagaacagaacattttaataactgtacacaaagttaagaaaggaatgagtggctcttaggaatccagaattgagctcaagagtaatcagacattttacgaggagggttaaatgagaaatcaaagttctttctagaaaaacagcattttctatttggtttggtgtagtattaccctgtaactttaatactaaagaggtcttgtgggtgagaaacaaggaaaaactaggttttagttgattttagcatataattctgtgcattttacctcctctccatctcaaagcctgtgcttactactctgtgctttaacttgctggtatggctactctgcagtcttcctgacatttaactatttccacatgtggcatgtctgtcttagagagcatgctctctgataagcactcctgtaacactgtgtctctctgagtttctattggcctttagctgctacagtcctctgcttttgttaacatctgttgtattcatttccatcactcttactcctctacaaaaggaagaaattaaagctccaacattccactaaagctacccccagaggaatactaaggtcctccttttctctggtctccctacttctctgaagtgttccacatgtttgatcattcctactactctccctcaactcccaggatcctgaacttctttaattttccctaggcccacaatcttcaatgaccacttctaacttgaacttcagtgccatatttctgaatacaagattctcctctcgaatgccctgctagtcacgacaaactttttcaaaactgtgagacatttttctatttaaagtagttcttagtataattacttccatttcagtcagtgagcctatatttcttccagtatctcagatggaatctatgactctttcctaccattcaacaggtgtttcatgtgcgtcagacactgtcaggtgtttaatataaaccatctagctgaatccttgagtaacccggcatgttcccctatacggcatcaccttccctccttcattcaactttgttagcaagccctatcttttatccagagctgtttctttcagtttattccttaccattacccctcccgtaatctgaatccaaatatttaaaagactgagagaaatagaaagtaactttaatatcaccccctctaactccctcatttccacataaagttgagacctagagagaaaaaatgattttcccaggttcactctggtactgagaacaagaattgcaagtttaaatcttttgtgcacaatcactgacaaataatctttttagtgtgtcagcttcctcatctgtaaagtggattactgtggcagctagtctccaaagatactcttaatgagccacactgtcctacactgaatctgagttggcttgtgtaaccaacaagtgatggtgcatgactgctgaggctaagtcataagaaatcttgcagctctcatcctgctttctttgaatgtgctattgggacccctaagccattaggttgaaaaaaaaaaaggtctgactactctgagaggctatgctacaagaagtccatgttaacttcacagacagtgaagagagaaagcgcaagagagcacttgcacaagaaagagcacacatgcctggccagtcttcagcaatgccagccaccccagcccagagccagacctgaggggcaagaagccatcctagccatccagccagttcagctttcagatagctacccactgggctgcaaccatatgaggaatgccaagcaagaatgtctagccaagaccagttaacccacaaagccatgaaaactaataaaaatacattcatatttcaaagtattaggtttgaagtgatttcttacatagcaataaataaccagaacagatacatatgaggattaaatgagaccatatatgcaaagcacttaaaacaacaaatggtacaaagttgaagataagtaggtatcagacagtaaagatgacagtgacaatgatcattatgataatcattctattatactaatatttaaaaaaattctctggtttgtcatttgtttttaaaatatatatgttatatttcctttcaattgcatcacagcactccatgtctcagggccaaaatgctgtaattgcttcttagctcatcttcttgcccctggcttttccccttctagtctcatattgacctctactgccagatcaattttcctcaaatccagccgcagcctgttacttcaaagctagtaatgcctgcttcatcacatccctctgtaaattccagactgccatatctgaccttaatccccaacgccaagcctattttcagctgctctattacatttgctctgttcctgaaagactagtactcctccaccttcaccatacagctgacaatcccatctctgtcttaccaaattctcggcctaaaataccctccttcttctactctgccaacctcaaactggttttctcagtcagatttaaatcattcaaagtacatcttaggaccaaatattccagcctttttccaaattctaacgattctacatctgccccttcattcaatatttattaagctcctactctatgtcaggcactgcctgagaaagagaaacaaagctttctcacctgcagcttatattccaaaactaagttaataaatacataatacgtcatggggtgataagcacaatggagagaaagaagggataaggattacggatagaggttgctataaggtgatcatggaaagcccctctgatgagatgacgtataccaggagatctgaagaaaggaaacaagccatgtggattgcggggtgagaggtagggtagagaagggaaaaccaagtgaggaatggcaaaagcaaaggcctcgaggcaaaacatacttggtgaggctccctgaagaacaggtggaagtgtcataccacttgtcatttaaatgcaaattacactctgcagtcaggctcactgccttccccctcctttaaaaaaaaaaaaatccatccatccatcaattttattctttgacaaacttaagactcagttactttttactttttataacaagtattcatcctgaaatgaaattcctaaatacacttccttcataatactgtactgaatacatataggctaaatactccctacatagatttaaaaaaaaaatcagtataatggcttatcagtgaaataaaggagaaatgagtaatttctatcaaatactacaaaatataaatacttgtacacaactacattttaaaaagtagtcaaaaactactataactgattagctgtgtgaccttggggaagctatttaaatttcccatacttcagtttactcacatggaaaatgagaataatagtttctaccttacagggttgttgtgaggattaaattagtgcatatacataaggctcttagaacagtaagtgctatctaagggtttgctatgatttctcttatggggagaattaccacaaaagtaacagtagcatgaaaatgaatacaggggtgttatgttagaaaaattttcctttttcctgatatgatgaatgattctttgaaaggtttcaaatgtaacaaagtgccatcttcacaatatacactattgctgcattactagaaaatttggtgtggattaaaaccatgtaaaaatatttaatacttatacgtaaaaagtagttgggttctaggctcagagaattataaatgcattttgttttttcacctatgtgaatagctgctgggactttttggaagttgtgtgggacacacagcaaacctccctggtgaaaggctgtcccatgtatcccaggacatctagcctccctggcctctgcccaccaagcaccaggagtactccccagtcactgtcccctgaaatttcctgaatgttccccagtgttaagaatcactgttctatttttttcaactgtcttcaactttgactcctcatccagggtggaggatctttgaggccagaaaagtatcttattatgtccctgtatttctcaaggtagtgtactattgccacaaaaagattgttggctgatgcagatgcaaaacatcaatatttttatactgattataggtgacaggaaaggacaagggttttcaccctcagcaaaatcatcaaaaacatttaaaacagattacatatagtagataatactccttgtcttaaaacattatgcagaaacacacatacagtttcccttccctctaaaatctgcagcctcttctccctgctgaatgtgagtgatggtcccttcattcaacagacttctatttggcaactattatgtgccaggcattctaataggtgctggatgtgaaaggatttaacttattcaaataagtccctaatttgctgcaataagggagattatttaatcatattgagtaaaaagtaccaaggaaagtttccatatttctagggaataagaaatcttttcaaaaatctctgagccaaattaaaattcatttcattttccctaatctccatttctaggagactagaatctccttcctattgccacggtagctgctatctgcagagagaatctagataatttagaagagaaatttgaatagagccagagagatacaattcttatagtcagacttggcttcaccaaatttaatgaagaaactttaataagttacaacatttactaggcacctactatgcacaaagaactttacatacctcatttctaatcttggcaacattctgataagataaatattatccctattttaacatgaaaagatggaccttcttacatattcaataacttgctccataggtgacaggattgaaatgcaaacccagtccttgctcttaatggtgtatgacagctcatcatataattaggctgatgcaaactctatgataaacagtatgaatctaggagtggatttgtttatcctcaatctttttgctaactttacagtgccttgaattaaagaatcatggttactatcaccatggtcagatctctggacagggtgaggaagcaggtgcccacaggcagacagccctgccatatagtgagacacgcttatgtttgggagcgctatgtgaacaacacacagctgccctcatatgcagatgtaatgatgacgacacattcagacaaggaactgaggtccagaaaagttctgacaacacaacttgagggacagcgttacagctagagctcaggtttcttatctgtaatccactgctctcaaatgcccaaatgattttatatacatatatgcaagtgtgtttgttgaaatagaaaaaatagtttcttggcctggtgaagtgcctcatgcctgtaatcccaacattttgggaggccaatgcgggaggattgcttgaggccaggaggtcgagaccagcctgggcaacatagagaaaccaccgtctctacaaaaaatttaaaaattagccaggtgtggtggcatgtgcttgtagttccagatactactgaggtgggaggtgggaggtgctgaggtgggaggatggcttgaggccaggagtttaaggctgcagtgagctatgattgcaccactgtactccagcctggatgacagagcaagaccttgtctcaaaaaagaaaaaaaaaattcccataatgttcagttagttctctttttcagacttttcctagaaatacccctcagaatttctagaggccacttccctgctattccttgttttctcagtccttaccagatacccaagcaattaacaatctttttgaactatttcagtacatttcaggatatttgaaattctgctgatggagctgaactgctgatacattaacacatgctgtcattattgactttgtaacagaggtcaagagagaaaagatgcatttttgaatagggaaaaacaaaactaaattatggggaaactaaggctcagagaggtcaagttgtcttgctcaaggtcacaaagccagtagtaagtaacagggccaggatttgaacccagactgtctggtttcagagtactctaaattgccaaaaaaagaaaactatttcaggcattattttatatttagcctagagcctacataatagatccgttaatataatcaattctaagctgtatattatattactgtgtttgaaatatttaagaaatattgtttaaaataagtgtattagctcttggacctctccaacataaggagttttccaggcagtagcactgtttgcagtaggacttacattattggaaaatattttatcctataatcaatctacatttattttacacctttcaccttaaaattaaaagtcgtggtagttattaatcaagaagcaaatctatataacgtggtctctcatatatccagtactgttcagcttgaacaaatgcaaatctaatttttaaatgtcccttgaagaattctgaggcaaagttaaacttcaagtattaaacagaatagccacagaaaactagtgtttctcagcctccctttgctttcaaatgccttaaaaatattttagaggcagacaataatctagaattgattcataaccaatattttacataacagaatgttacatgtattttcatattataaaaactatactttctttgattaatgctagtattctgaaaacatcgttagtgccagtaaatccactaaatctgtttgtatttactgccctctagtgataatggctctacatttgattaagaaaaaactattcctttcagtaaatgaaaacatctcttgtaagttttatggagatttgagattaagaggaactccaggctgcttttttaaaaccaaataatcatctgaacaagctgagaatcgttctctaaatgatcttattttaatttttttttaacaaaaaagtctcatttaaaatagtaaacacctgcaacatgtatggagaaaggaaaccatttttgctaagaggctccttgaagctgaaataacatgagactgatctgatagctgtatttatatttctcttctacatgggctaactctcttattagatgttagcatagtattctgtaattgttgatacagtttgaattcatatatggtagagacagagttttgtataactatttagtcaatttacctaaaaccagcagcagcagcatatctactacagacttttgtttcactgaagaataatcatgacaataaatgggtgcaaaaacttcacataaatgaagcctccacaaaaataatcttgtatgaaaaagtattgtctccttatagagaaaattaggatctccaattcacttaaattggcctaaatgaataccataatcatcataaaatagttactaatgtcccctctgtacttcgtggtatgctttgtggaaacaatttaaacaaagagaatatctgtctcctaaagtaataataactagtgtaaataggcatgcttccagaaatatataatcttttacacatatcactttaatatgtgcatcttaaaataattttaagtaataaaatttgagctataaaagagaaatgatattcttttcaacaaagaatgcttgaacaattgagcatccactcataaaacaagaaacttcaacctttatcctgcaccacactaacatctacttgaaatgaatcatagaactaaatgtaaaatctaaaactaaagaacttctagaagaaaacacagtagaaagtagttgtgatcttgcgttaggcaaagatttcttaaaccacaaaagcatgaagcataaaataaaaaatggtatactggactttaccaaatttctctttgaaaaaaactgttaagaaaacagaacaacaagccacagacttgagaagggaatatgtacaaaatgcatatcaaataaaggacttgtatccagaaattattttttaaaaaatctttacaacacaataagaggacaatccagtgaaaagatggtcaaaagatttgaacaaacaaacacttcataagaatcaaaaagatcaataagcatgtgaaaagatccatgaccatcattagacattagggaaacaaaaagtaaaaccacagtgagatgccacactacatacttactagaatgtataaaatacaaaatacaaacaatacaaaatgctggcctggatgcagagcaaattaaattctcatacattgctagtgagaatgcaaaatggtatagaaactttggaaaaaggtttgacagtttcttataaagttaaaaagtagagtgaccatatgacccagcaatcctacttctaagtatctacccatgagaaatgaaaacatatgtctatataaagacctatatgaaaatgtttatagcaactctctatagcagaaacccagaaacagttcagatatcagtcaactggtgaatgggtaaacaaattgtgtccataaaatgacatactggaaaaaaatgaaatactaaaaagcaataaaatgaaacaaattaccaatagatgcaataacacaaaatgtattataagtgaaacttataattcaactcaaaactcaaaagtattgtaagtgaaagaagccattcacaaaaggctatatctttaatgtattattcattctggcaaggcaaaaccatagggacaatcagcactggacgtggggtttggggaatgactataaaaagcaagagaaaactttttgggtggtataaatatcctatattatatagtacatatatattataattacacattacctatatatctagattatggtggtggttatccaattgtacacatttgtgaaaatgcattcaactatacctctagaaagagtaactcttatgtaaattatacctcaaaaatctaactttgaaaaatattagctgatgttatcaaattatttcaattccagatttgcttaactttacaactttgcccaaagataaatgcaaaacaaaaacctcaggcatagttatgtatgataaaacaccatttttaccctttcaaagagctccaccattatttcccagaaaacaggcatacagttatccaaggtccacattagctttaatgatacaacattcagtgaattcccagttgtgaaaagcctttaggttggcagggcgctgtggctcatgcctgtaatcctagcactttaggaggccgaggcaggcagattgcctgagctcaggagtttgagatcagcctcggcaatatggtgaaaccctgtctctactaaaaatacaaaaaattagcagggtgtggtggtgcactcatgtaatcccagctactcgggaggctgaggcaggagaattgcttgagcccgggaggcagaagttgcagtgagctgagatcgcgccactgcactccagccggggtgacagagattctgtctccaaaaataaaataataagagaagcctttaggtgataaaataatagtcaaagtattcttttaagtattattattttatttttttttaattctttgtaataaaaagttccataaagtaaaatattgtccttttttgttttatttttatttgtatcaattcaaggggacaggtgcagtttgttacctggacctgatttttaaataaatcaaactcagtttagttatttcatggtgatcctgggagactgtttgtcagtcatcatcgaatagcgaatgagtatcctttgtatgctcattctaggctgtaagtaccatgtcagctgatggagacacaaaaatccaataaagtaggtatagctgggggaggttccaagatggccaaataggaacagctccagtctactgctcccagcatgagtgatgcagaagacgggtgatttctgcatttccaactgagctttgaaaagagtagtggatctcccagcatgaagtttgagatctgagaatggacacactgcttcctcaagcgggtccctgacccccgagtagcctaactgggaggcacctcccagtaggggccaactgacacctcatacagccagatgcccctctgagatgaagcttccagaggaaggatcaggtagctacatttgccgttctgcaatatttgcggttcggcagcctctgctggtgatacccaggcaaacagggtctggagtggacctccagcaaactcgaacagacccacagctgagggtcctgactgttagaaggaaaactaacaaacagaaagggcatccacaccaaaaccccatatgtacgtcaccatcatcaaagaccaaaggtagataaaaccacaaagatggggagaaaccagagcagaaaagctgaaagttctaaaaatcagagctcctcttctcctccaaaggaatgcagctcctcaccagcaacggaacaaagctggacagagaatgactttgacaagctgagagaagaaggcttcagacgatgggtaataaacttttccgagctaaaggaggatgttcaaacccatcgcaaagaagctaaaaaccttgaaaaaagattagacaaatggctaactagaataaccagcatagagaagaccttaaatgacctgatggagctgaaaaccatggcatgagaactacatgatgcattcacaagtttcagtagccaattccatcaactggaagaaagggtatcagtgattgaagatgaaatgaatgaaatgaatgaaatgaagcaagaagagaagtttagagaaaaaagagtaaaaataaatgaacaaagcctccaagaaatatgggactatgtgaaaagaccaaatctacatctgattggtgtacctgaaagtgatgggagaatggaaccaagttggaaaacactctgcaggatattatccaggagaaattccccaacctagcaaggcaggccaacattcaaattccagaaatacagagaatgccacgaagatactcctcaagaagagcaactccaagacacataattgtcagattcaccaaagttgaaatgaaggaaaaaatgttaagggcagccagagagaaaggtcgggttacccacaaagggaagcccatcagacttacagctgatctctcagcagaaactctataagccagaagagagtgggggccaatattcaacattcttaaaggaaagaattttcaactcagaatttcatacccagccaaactaagcttcacaggtgaaggagaaataaaatcctttacagacaagcaaatgctgagattttgtcaccaccaggcctgccttacaagagctcctgaaggaagcactaaacatggaaaggaacaaccagtaccagctactgcaaaaacatgccaaattgtaaagaccatcaaggctaggaagaaactgcatcaactaatgggcaaaataaccagctaacatcataaagacaggatcaaattcccacataacaatattaaccttatatgtaaatgggctaaatgttccaattaaaaaacacagactagcaaattggataaagagtcaagacccatcagtgcgctgtattcaggagacccatctcacatgcagagagacacataggctcaaaataaagggatggaggaagatctaccaagcaaatagaaaacaaaaaaaagcaggggttgcaatcctagtctctgataaaacagactttaaaccaacaaagatcagaagagacaaagaaggccattacaaaatggtaaagggatcaattcaacaagaagagctaactatcctaaatatatatgcacccaatacaggagcacccagattcataaagcaagtccttagagacctactaagagacttagacttctacacaataataatgggagactttaacaccccactgtcaacattagacagatcaacgagacagaaaattaacaaggatatccaggaattgaactcagctctgcaacaagcggacctaatagacatctacagaactctccaccccaaatcaacagaacatacattcttctcagcaccacatcacagttattccaaaactgaccacatagttggaagtaaagcactcctcagcaaatgtaatagaacagaaattataacaaattttctctcagaccacagtgcaaagtagaagttgggattaagaaactcattcaaaaccactcaactacatggaaactgaacaacctgctcctgaatgactactgggtacataatgcgatgaaggcagaaataaagatgttctttgaaaccaatgagaacaaagacacaacatactagaatctctgtgacacatttaaagcagtgtgtagagggaaatttatagcactaagtgcccacaagagaaagcaggaaagatctaaaattgacaccctaacatcacaattaaacgaactagaaaagcaagagcaaatacattcaaaagctagcagaaggcaagaaataactaagatcagagcagaactgaaggagatagagacacaaaaaaaccttcaaaaaaatcaatgagtccaggagctggttttttgaaaagatcaacaaaattgatagaccactagcaagactaataaagaagaaatgagagaagaatcaaatagatgcaataaaaaatgataaaggggataccaccaccaatcccccagagatacaaactaccatcagagaataacacctctacacaaataaactagaaaatctagaagaaatggataaattcctggacacatgcaccctcccaagactaaatcaggaagaagttgaatccctgaatagaccaataacaggttctgaaattaaggcaataattaagagcctaccaaccaaaaaaagtccaggaccagacagattcacagctgaattctaccagaggtacaaagaggagttggtaacattccttctgaaactattccaatcaatagaaaaagagggaatcctccctaactcatttgatgaggccagcatcatcctgataccaatgcctggcggagacacaacaaaaaaaagagaattttagaccaacatccatgatgaacatcgatgcaaaaatccttaataaaatactggcaaaccaaatccagcagcacatcaaaaagcttgtccaccctaatcaagtgggcttcatccctgggatgcaaggctgcttcaacatatgcaaatcaataaacgtaatccatcatataaacagaaccaaagacaaaaaccacatgattatctcaatagatgcagaaaaggcctttgacaaaattcaacaggacttcatgctaaaaactctcaataaattcggtattgatgggatgtatctcaaaatagtaagagctatttatgacaaacccacagccaatatcatactgaatgggcaaaaactggaagcattccctttgaacactggcacaagacagggatgccttctctcaccgctcctattcaacatagtgttgaaagttctggccagggcaatcaggcaggagaaagaaacaaagggtattcaattaggaaaagaggaagtcaaattgtccctgtttgcagatgacatgattatatatttagaaaaccccatcatctcagcccaaaatctccttaagctgataaacaacttcagcaaagtctcaagatacaaaaccaatgtgcaaaaatcacaagcattcctatacaccaataacagacaaacagccaaatcatgagtgaacacccattcacaattacttcaaagagaataaaataccaaggaatccaacttacaagggatgtgaaggaccttttcagggagaattacaaaccactgctcaacaaaataaaagaggacacaaagcttatagataggaagaatcaatatcatgaaaatggccatactgcccaaggtaatttatagattcaatgccatccccatcaatctaccaatgactttcttcacagaattggaaaaactactttaaagttcatatggaaccaaaaaagagcccgcattgccaagacaatcctaagcaaaaagaacaaagctggaggcatcatgctacctgacttcaaactatactacaaggctacagtaaccaaaatagcatggtactggtacaagaacagagatataggccaatggaacagaatagagccctcagaaataataccacatgtctacaaccatctgatctttgacaaacctgacaaaaacaagaaatggggaaaggattccctatttaataaatggtgctgggaaaactggctagccatatgtagaaagctgaaactggatcccttccttacactttatacaaaaattaattcaagacggattaaagacttacatgttagtcctaaaaccataaaaaccctagaagaaaacctaagcaataccattcaggacataggcatgggcaaggacttcatgtctgaaacaccaaaagcaatggcaacaagagccaaaattgacaaatgggatctaattaaactaaagagcttctgcacagcaaaagaaactaccatcagagtgaacaggcaacctacagaatgggagaaaatttttgctatctatccatctgacaaagggctaatatccagaatctacaaagaacttaaacaaatttacaagaaaaaatcaaacaaccccatcaaaaagtgggtgaagtatatgaacagacacttctcaaaagaagacatttatgcagccaacagacacgtgaaaaaatgctcatcatgactggccatcagagaaatgcaaatcaaaaccacaatgagataccatctcacaccagttagaatggcaatcattaaaaagtcaggaaacaacaggtgctggagaggatgtgaagaaataggaacacttttacactgttggtgggactgtaaagtagttcaaccattgtggaagacagtgtggcaattcctcaaaggtctagaactagaaataccatttgacccagccatcccattactggatatatatccaaaggattataaatcatgctgctataaagacacattcacatgtatgtttactgcagcactattcaggatagcaaagacttggaaccaacccaaatgtccaccaatgatagactggattaagaaaatgtggcacatacacaccatggaatactatgcagccataaaaaaggatgagttcatcatgtcctttgtagggacatggatgaaactggaagccatcattctgagcaaactgttgcaaggacagaaaaccaaacaccgcatgttctcactcataggtgggaattgaacaatgagaacacttggacacaggatgggggaacatcacacactggggcctgttgtggggtgaggggagtgggagggatagcattaggagatatacctaatgtaaatgacgagttaatgggtgcagcacaccaacatggcacatgtatacatatgtaacaaacctgcacattgtgcacatgtaccctagaacttaaagtgtaataaaaaaattaaaaaagtagatagtcccaaccgctgtattctttttgaatccttttgccactgtttcatatcacagtttttttttttttctgagccctagattatcagtctgttctttttttttttttttttttttaatgtagtccataggaatctgctgcctcacggtcagtatcgtgccccttaccccaattctaatatgacaggtttttgtctaagacagcatttcctagaatgtgttgtaatgtacagcagcttcatgtgataattctcaaagactcccactgtcaaatgttagcatattcaaggctctgccaggacctgtaatacatattctttctttattctgtttaacttagcatttctgaaacctatcttactactgaactcttgacatttattaacaaacaaatacaaacgaaaataccagggttccaagtaaaattcttatataaagcaaagggctttaaacatcagagttttttagaatggttattcactcatgcactcaacaaacacttattacatagtatgtgccagcataggggatacagtaataaacaaaacagacaagttccctgttcatgtaaaccttggacttatggggcaaaaagacaataaacaagcagacaaaaaaaaattacaaacactctcaatgaaggaaaagagggtaacatcgtacattgatgggggactataaaattaagtagtaaggaaaagctgcacttgagaaggtggtatttgggaagagactcgaatgcctagaataagccaaccagatttggggcacagcactctcaacaaaggctgagtaacacagccagtctgagggaggacaggtctacggaatgagagccgaggcaagtcaaggcaacatcacgtgggtcctgagggtatgagccttccagagggtgtgaggataccattagaaggttctgagcagggaatgataggatgtgatttacattttgtaaagctgtctctgtagaggatagtttgtaaaagtgcttgaggcaaaactgacaagacttgaagacttgcacaacagaactgaagaaatgagaagaatcaactcctagacttctgggatgatcaatgtctaggatggacattggtgccatttgcaagatggagaagaccgggggaggtacggatttaaaggagggtatgtaaggagaaagaagaatcctatgagacaagaccagaacatgtaaatacatgaagttttggatttcttactcttcaaagacattttacctcctgtccccgaagttcttcacagagttcaggataagaaaagctgccagacagttgagttttgaataagtagtaactttcaaacacttgaaagacattatattagaatagactacatccatcaaaatacttaaaaatgtttttagaatagtccaataatttggaatatgaaagcctaagaaacttccttatccaaggccgcataatataaccaaaattagaatttagtactcctagttggcaatatttttatgaaattactgttttactaagacattttagaaatgaagactttactgaaggcaataataagtgcaattaaaagtggtacaataataagacttctttttcatttgcaacaggttagtagtgtatgagaattatgagatgtaaaatagtgtagagcataggcttctctagttggcttcatgtgagttcgaatcttggccctgcctctcttaccagcaatgaaatatgcagcattttacttaaggatactgggttgtatggagagaatcagagttaaggttggtgatccagcagtgtcatgtgtcaggagctaataaattgtattgtgaccagaaacactgaaacttgttataaggaaagcaatctaattaaaacagctgcattaaaatttctacaatatcttcctaacagcttatgctatcaacagtttgtaaactatcagaatcacggatactggctgagaatgcttttggagatttcaaattggcataattttctcagaatgcactgatctgacaaatgtacagacaggcagacaggaatactaccactcttcatgaataactgtctgcctctcctggatttcttccatgttgtgtaagtctattacactttgggtgaatgtagctttagtacattgagttaatatcattcttgcaaagaagctctttataaattccttaaacttaatttgactctggacacaaacaaatgagaacaaaatacagctcaaggattaagatccttaaccaaatatgtaaaaaacacgaaaagccttacaaacagtgatcaacagttaaacatgcgctatcaccttcccctaacagctagggaagcatgtatatgaatggaacatatgaacttccatttggtgtactaagaaaacacatcacgcagatggcttttatagcttcccaaataaggttctaataattcacaaaagtgttgttccctaaaacccataataaacaataataaaacctaatgtttattgagggtctactatgtgtcaaggagagtcctatgtactctcctggaattacttcatttatttctaataataacctttaatgagcactgtcactcccgtttcacagatgagccttaaggtcttagctatcaactttgcagacaacacccaagtaaaatcctgccccctctttttttttttttttttaaccagaaatccagtcctgacaactgaaagcttatagggcatttccgcttagatacatagccttacctaaattatatgtctaaaaacttaactgtcatattgtccagccctcccccaatacccaactggcttctcttcatgattttccaactataattctgtccattattcaggtttagaatttcatgctttcttctggctgtggtcctgccaagtcttatgtatgctgtcacccttctctgtgcaatctttctcctactcattcctctcttttcatcactatcctatttcaggcccttatcactcttacacctaattccctaacggtttcttcttgctttcagtacaatttccccttgatataatctatcctgcacactaccaccagatataaccttctaaagtcaccttattttagtttcttcataatattttccttatagtcaaatgtaagggttcttcatgaattataggacaatgtgcaaatggcttgacctggcatttaagacagtctgcagtatggcctcaatctacatttctcacacctgccactggtcctataatcacatcctctgttccagagaggctcactcctccagaatgcccactaccctcctctccagcaaacatacaataaagcgaatccacatgaataccccatcctaccctgccttatccagcccctggaataccacctcttccctattagatgcctatataaatcctcagtattcaagatccagcttaaggagcactttttctgggaccaatcattctggtcctctgtattgaatactcgaactcctctacaggacaggaacataatgtattattaccctatcattcattaacacacaacaggcttacattatatggctggttgtattttcagaggtatgtctatatgtttcgctatctatctatctatctatctatctatctatctatctatctatgtgtttgaatacagatacataaaaatctcatttcacctataagaacctctggagcagatacatgtcatacaataattgggctaaaacaaaaatccctcagtgaaaacctaaagactgggttgtggttgtttgcagccaaaacgtacaaaatgaaaacctcctaacgatttattttccacatgaaattagtaccagatctagagaaaaatggacaaggatcaaatacaaataataaagtcatcaccaaactaaaaatttcattcaaaagtgatgatgttggccgggtgtggtgactcacacctgtaatcccagcactttggaaagctgaggtgggcagatcacttgaggccaggagtttgagaccagcctggccaacatggtgaaaccccatctctactaaaaacacaaaaaacagctgggcgtggtcatgcacctgttatacccactactcaggaggctgaggcaggagaatcacttgaatccaggaggtggaggtggcagtgagccgagattgtgctactgcactccagcttgggcaacagagcaagactccgtctcagaaaattaaaaaaaaaaaagtgatgatgtcagtaaagacccaaatcagggtcatatgtttaacaccagaaagtttgtatttgctacaagacagaaaccttgacaaaataacttttctgtgctttgttacttcatctgaatgaagaaggtaaaccagttgatctcacaaatctctttctaagggcttctggaatttttttttttttttaaacaataaaaggaaagagacttctcttaagcagaacaaagtccgactcctctgtaaagtggctgacagcaagtggaaaatggaagaagaacaattacctgcaaaatgactcattcccttgtaacaactacactactagggaattccttctcttaccggctgtggctagcgtcagactcatgacaaagacctcatcctggggctagaactaggtttagggttttctcattcattcctctgtttctcagctgcattttcatttttaatctgtgcaatgattacagaggcctatgtttggttttcatttctagtttccccaggaagagacaactactatcttgatattgattaacacttgaaacttctgttaatcacaatttcagtatttcagggaatcagagaaatcatttggaagagccttgaaggtcatccagggtgagagaaaagcaaagcacaagcaacagaccaatgtttagacacagtgaagtgaagacctacaggagaccctctcaacttcaataagagtcttttttatggctgtcttcatattctttcaaagaaatcataataaaggagttagtgagagtgtaaataaaaaataggctatcatagagtgctgggtaactgagctaaaactaaagtaaacaaactcagtgggccatcacatatgcaagctggtaaggtctcataaatcaccatgactgggtattgggatttcaaaggcacactctgtaagctttctcccagccctgttgattcaagctccaattgcactgggttacttatatggcagcatataaagttgaccttttatgtttaaaaatagttccattcctcatccctcctaaggataggccacagtacctatcatatgtccccaccacactacataatttatgtaagttttcacttaattttcaacacaatcctttgaggtagattatgttagtcctgatttacagggaaaacagaggctcagggaggccaaatttatttatttatccaaggttgcaactctactgtagggcagatttatatccagaagaggaattgcaaagctcctcagaatttaggagatttaaaatggaatcaagataaaggttcacatttttcatcttctattccattttactcttccagcatctaataataacctatgatatattagaacaaatcagcccatacttattttgacagtctcttttcaccccatttcagtttgtaccttgctgtctcagagcccatcaaccacctttcctcactcccaggcagccggtccttcaggggatggcttggcagttggcccaccatcctctgctaccagggcatgactcatggaggcaacaggtgaagctgacgccaactattagtgctaaaaaagactcaagcctcatgaaatataccatccataaatcgctctccagtcagctctacccctccctccatttctacagctgactgtctgttcttccttaaacatttacatccgccactgacctgtctgggatttcttttttacttcaaggttctcctaaaggttcagtccaaccaggtttcaccaaatgaaccctgcggtggaaaggggcagcaacgggcattggtcagtttgcctccagccaaggaaagtctgactcccctccttctcccactcttctctttctctgcctcacactgcctaatacgtctttcctctttctctctttctttccttatatcttcattttccaccctattcagaagtgaaacttcccttgccactttgcccccactaagaaaacagacctccaacacaacctcttaacaggctaattttaaaatcatgaacctgcttacaccttccgtgagtttatcctatatcttctctatctgctgtctgcttcccactaaggttttatccctccatcccacctccaaatcctttacagctcagattctcagatctgctttagtcacttggtctcctcatcccactgaccctattatccttctgtgcacatgttagagggcacatgctcctcctaggaactagggccaggtcagttatgctcccatcctgacatgacctagagaacaaaaaaggcaaaacgaggtactgtaggattcctctctaggaattatactttgctgaaattgctcttgctattttggaatctagtgctcactaaatacatttttaaaatattatttggatatattttgaaaatacaaccagaggtcgggcacagtggcttacgcctgtaatcccaacactttggcgggccaaggtgggcagattacgaggtcaggagttcgagaccagcctggccaacatagtgaaaccctgtctctactaaaaatacaaaaaattagccaggcgtggtggcaggcgcctgtaatcccagctgcttgggaagctgaggcaggagaattgcttgaacctgggaggagaaggttgcagtgagcctagatcacgccattgcactccagtccaggcaacagtgcaagactctaactcaaggaaaaaaaaaaaagagagagagagagaaaatacaaccagagaataaacacttgttcttctatctctccatcttccccaccaatacaacatccagaaaatagtcatctttacacttatttagaagcacatagatcttataaaagtttaactgagcattaggttttcatctttaaaaatattctgaggctgggtgcactggctcatgcactttgggaggccaaggcaggaggatcacttgagcccaggagtttgagaccagcctgggtaacatagtgagaccctgtctctacaaaaaaaaaaaaaaaaagttaaattaaattaaaaaacagaaaagccggtctggtggcacatgcctgtggctccatccactcaggaggctgaggtgggaggatggcttgagccagggagatcaaggctgcagtaagccatgatggcgccactgcactccagcctggttgacaaggtgagaacttgtctccaaaaacaaaacaaaacaaaaaacgttttgacatgtagaatactgtttctgggactaaattagagatttaaggtttgaggtatgagaaaatacctggaatcatgccttacattagaaggtaaggtaaatactggtgtttcccaatgagttgtagtcagattgttcatatgtatcaaacagacaatatactgaaatatttaaaaataaggctaaatagcaacaaataatttttcccatgaattctactttttttttttttttttttgagatggagtctcactcagtcgcccagactggagtgcagtggcgccatctccattcactgcaacctctacctcctgggttcaagtgattctcctgctcagcctcccgagtagctgagataacagacatgcaccaccacacctggctaatttttgtatttttagtacaggccaggttttgccatgttggccaggctggtctcaaacttctggcctcatgtgatcgacctcccaaagtgctgggattacaggtgtgagccaccatgcccagctgaattctacttttttttttttttttttgagacagagtcttgctctgtcacccaggctggagtgcagtggcacgatcttggctcactgcaacctctgcctcctgggttcaagtgattctcctgctcagcctcccgagtagctgagattacagacatgcaccatcacacctggctaatttttgtatttttaggagagacgggatttcaccatgttggccagctagtctctaactcctgaccgcgtgatctgctctcctctgcctcccaaagtgctgggattacaggcttgaggcaccacgcccggctgctgaaattctacttttgaaagaacaaattccccttctgtagggactgatgattcagtctgtaatgatgcattctcttcatcttctttttttgtcttttcttctatatatcctttaggcattctactgtattaacactagatagaaaaattaagatttaggcccaaacattatcttctggcataaagtaaactaatcgtttcctgatgtacaataaataaacagacatatttctagtagaagattccttatgatttatcaaaacccaattatcacttacccttatggagatcttagatcttagaaaccatactgacaatataagattaagaaaacaacagaaaatcaaaatatataccaaggataatgttaataggtttcatccttatcacagcatactgttgaaacttacttgaaatatttttttaaaaaagatacaagaggacaagtgtttagtttttaacaagggaggggactagtcaacaaatattgattacctaatttatgaacagctctggccaaagtggtcaaaaaaaaaaaattaggactttagttttcctaaacctatcttaatttttaacaggattatagctttgttcaatctttacagtctttagcctcttttgtgaaatgggtttccttgtaaataataaaatgacacctatatatatttaaagcactcatgaaataattttatctctttattaaaaactgtgataacccttccaattttgaaatttattgtcttcctaaattcttgctacaaagcctatcattaatattgcagttcattttttccctaaagattgaaaaaaacactaacaaatataaagtctttatggtcaaagaatgtactccttttataaaacttggagttgatgtaaaggcacagacaacacaagttaccttaataataaatgcacttttctttgtaattttgggtaattcagtgtgatttgtaattcttttaaaagacacacaatcacttgtatttttgcatggttctttttttcctaatttcccactatagtgaaatatctgtttttccttctctattgggtttggattggaatgatcaggtagaattaaatgtaaaataacaaaaggaaaatactttatagatcttctcaaaatactttgaagggtataatctctttaagatggctttattcatatttaagccaaaaacaaaaagcaaccaaaacactactgtttatacaaaaagcagcttcaaaatcagccagttattttctgaaatggagatggcagacattagcctgcacttactccaatatggcagccgcatctttgcctctttgctatggacacatccccagcaggcctgtactttctactctccagacctgtttatgacaggccaaggtgtttcctattatggtgcctatggctgcacagtgcactgcttgtcagtaataaaagccagaggctgtccctatagggattacagtgcagcagaccagagatgctgatgggaatgcaagcatgccctaggcaaacattgcagaatactctctgacaggcaaaagccaacaaacacatcctttcttcccagactagcagggaaagtattcagttatgtcattttcacttggaacaaactaataagaagaatgttattgctaaaataggtagagatgagaaagagcagtttatgaccatgaatatggcctctatggtttttgcctgtgcactacaaacttttaatttaaacgagatgagattgatctagcatatactatgataaaatttctgagacatgagtatctaaaagcagaactgagattaagtgagaaatgctcaggattcctgtcactgaaagaaaaagaaaaaaacctttcttgaaaggcacaaagtagaatgctcagactctccatctaccaatacaaggtaaaaaacagcatttgcattaaccaacatcatgcattcttgtactaatttatgtgactaactacaaaatgttatattgacactcactgtgtagggtgtcaggatggccaagtggtctaaggcaccagacactcactgggttgggctaaaaacaccgtagaagacctcatcagaacaataaaacagagacacaaaatattgtactaagagttaagagaattacaaataaaagttctgtggaaagtcaaaggtatccaattaggaaagcctgaggtgggagacataggacaccccagatataggatgggaagaagatgggattaaaaaaaaaggctttataaaggatgtaacattccagataggccttaaaagatggcttcgatcttttaaataaaactttttgttttagaacagatctagatttacagaaaacttgtgtagacattacagataattcctatatactctacactgtttcccatttttaatgtctgactttagtatggcacatttgtcacaattattgaaccaatactgatacattattattaaacaaagtccacacttcattcagatttccttagttttcacgtaatttccttttttctgttctggatcccatccaggataccacataatatttagtcctcatgtctcctgaggctcttcttggctgtaggtatctcaggttttccttgtttttgataaccttgacagttttgaggagtactggtcaaatactggtcaagtttcgagggtagaatatccctcaactgagatctgtctggtatttgcctcatgattacactggggttatatgttttcagtagggaaaccacagattaaaagtgccattttcatcagatcatatcgagggtacatgttatcacttatcactgtcaatgttgaccttgataacctggctgaagtagtgataggtttctccactacagtttcttttttttccctttctacactgtactgtttagaaggaagtcaatatgcacagctcacacttacggtgtagggggttatgttctccctccttgagagtagagtatctatagaagttattgggaattccgcacaggaggagatttgtctattttcccccacttaggtatttatttaataaattgtatcaatatgggtttatggatatttattttaccctttgggatataatccaatactatattattttcttgctcaaattgttctagctttggccattgggagctctttcagtttgctcttgcaactcttcagtatattcccacgggtgtagggttccatttgtttgagcaggtccttactttttggcactacaagatgctccaggctcatcttacatatttccttcctgagtccctagaaatcagctattttttttcaaagagtcttggttccttttaccagagaatggtattagaaaccaaaatgagggtgctaagtgtgctcattgctactggggtatggtagcttctagaccctctcggctgatagagcaaggaaatatttgtgtgtatactagatggtaagatgttgagaggtagaatggagagttaccttcttaatatacttttcttaatattaaatattaataagatattgtgtgcctgggttactttcagtcttatgcagaggaagaacgtatgtacattcatttatgaaaaacactggctagactattcttctgcactgcattatgcatttctgctagaaaaagctcagagattttcagatattctgacaaaaatctcaggcttgcttgatgagctatactgtaaaattacagaaggaaacaaagggcaaactccttgaaggatgaaaataaaggaataaaacatataaaacaccaccaaaaaaagtgattaatgggggagaagagtaaataaaacattataatagtcctctttggttagtatcaatattattaggtcactttatcaaaaggatagaaatcaggatggcagacacccttctctaaccctcaccccccaaaataataaaataaaaactaatgttattccttcacatatggaaatgaatgagttctactgagtatctagtatgattcctgactcagtcgagacaattcccatcttttaattcattaaatcaccacagcaactatttaacagatgagaaaactgaagcacagaaggcaacgtggcccaatttacgtttggtaaaaggcagagaatgaatccaattcaggcaggctgtctatagtagggtgctctaaatccacggaccattctgcctaaggaatgaatattttatgaattggaatatttctgctgaacgaatttgccattttctcctctagtggagaaatccaactgagggtaaagaaggaaaaatgttgattgtttaaaacaataaattagtctctaaattgttcttgcagctgatttagactagtgtgtccaaaagtatgcccagtgttagtaaatggtaggcaaaatgctttaaggtggtgcaagatgaatgttttctcattttgttattcattaattttagaaaaaatacagaaaaaatataacttgaacatcaaacctatgatttcatgtataccattacttaagatgaggcacttgggtgagtatttagatttaacaataagttgctcttagcatttctatactttgacaataaattatccaaaaaagaaattaagaaaataatcccatttgcaatagcatcaaaaaaatacttaggagcagccaggcgtggtggctcactcctgtaatcccagcactttgggaggccgaggcgggcagatcatgaggtcaggagatcgagaccatcctggctaacacagtgaaaccccatctctacttaaaaatacaaaaaaaaaaaaaggcaggtgtggtggcaggcgcctgtagtcccagctaattgggaggctgaggcaggagaacggcgtgaacctgggaggtggagcttgcagtaagccgagatcgcgccactgcactctagcctgggcaacagagcgagactccatcacaaaaaaaaaaaaaaaaaaaaacttaggagcaaatctaaccaacaaggtgaaagatctatacactggaaactacaagacattgatttaaacaactgaagaagacagaaataaatgaaaagatatcccatgttcatgcactgaaagaattagtaatgttaaaatgtccacactatccaaagccatctatagattcaatgcagttcctctattgattcaatgcaattcctttcaaaattccaatgtctttttttttcacagaaatagagaaaaaaatcttaaaatttatatgaaccaaaaaaagacctaatagccaaagcaatcttgaacaaaaagaacaaagctgcaggcatcatattccctcatttcaaaatatattataaagctactgtaatcaaaacagcatgttattgacataaaaacaaacatcaaccaatggaacaggatagaaagcccagaagtaaatccaagtatttacagtcaattgatttttgacaaagggtccaagaacacacaatggagagaggacagtctcttcaaatagtgttgggaaaactggatgtccacctgcagaagaaagaaactgtactcttatctcacactccatataaaaatcaactcaaaagagatataaaggcttaaacataagacctgaaactgtaaagctactagaagaaaatataagggaaaatctccacaacaatggtctgggcaatgatttcttggataggactccaaaagcacaggcaactaaaacaaaaatagacaaataggactacattaaactaaaaagtacctgcacaagcaaccaaataatagagtgaaaagacaacccatggatcaggagaaaatatctgcaaaccatacatctgataagaggctaatattcaaaatatataaaaaattcaaacaaccaaatagtaagaaaacaaatcgattaaaattagacaaaggatctgaatagacacactttcctcaaaaaagaaatatgaatggccaacagagatacaaaaaaaaaaaaaaaaaaaaaaaacaatgttccccagccctgcacagtggctcatgcctgtaatcccagtgctttgggaggctgaggcaggagatcacttgaggccaggaattctagacaagcctgggcaaaatagcaagaccctctctatacgaaaaaataaaaagccaggtatggtggcacacacctgtagtcctggctacttgggaggctgaggcaggatcattgagcccgagaatttgaggttacagtgagacatgatcacgccactgcactccagcctgaacaaaagagcaagaccctgtctcaaaaacaaacgaaaactcaacaatatctctaattctcagggaaatgcaattaaaaccacaatgagctatcacctcatgcctgttagaatgactattttccttttttttctcttcaacttttaagttcaggggtacatgtgcaggatgtgcaggatgtgcaggtttgttacataggtaaacatgtgccatgtttgcttcacgtatcatcccatcacctaggcactaagcccagcatccactagccattcttcctgatgctctccctgcacccatcccacccgccaacagaccccagtatgtgttgctctccaccatgtacaatggctatgttcaaacagatgaatgataacaagtgttggcaaggatgtggagaaaagggagcccttctacactgttggtgggaatgtaaattagaaccaccattattgaaaatagtatgaaggttcctcaaaaatctaaaaatagaactaccataaaatccaacaatcctacttctaggtatacacccaaaggaactgaaattggtacatcaaaaagatatttgcactcccatattcatttcagctttatttacaacagccaagatatggaagcaatctaagtgttcatcaagtgtgcataaagaaaatgtgatatatatatatatatatatatatatatattatatatatatatatatatatatagattatacaggccgggcgcagtggctcagatctgtaatcccagcactttgggaggccgaggcgggccgatcacaaggtcaggagatcgagaccatcctggctaacatagtaaaaccccatctctacttaaaaatacaaaaaattagtggggcgtggtagcgggcgcctgtagtcccagctactcaggaggctgaggcaggagaatggcatgaacctgggaggcggagcttgcagtgagccgagatcacaccactgcactccagcctgggctacaaagcgagactccacctcaaaaaaaaaaaaaaaaaaaaaaaaaaaagattacacagccttataaaagaaagaaattctgtcattcacaacatcatggaatggaactacaggacattatgctaagtgagataagtcaggcacagaaagacaaatattgtctttaataaatgatctcactttatggggaatctagaaaagtcgatctcagaaacagagagtagaaaggtgggttaccagaggctgtagaggaggagggagagagaaatggaagatgtcgatcaaacagtacaaaatttcagttagattggaggaataagttttagtgatctattgcactgcatggagaccccagtaattaataacgtattatatgttttacaatttctaaaatagatttttgacattctcatcacaaaaagataaattggtgaggtaatatagatatgttaattagctttactaaatctttctatgatgtacacattttaaaaatcacattatacccaagaaatagatacaattaatatttgtcaattaagaataattgacaaataaattttaaagattaataaaaaatacattaagttaaaacattcaacatataatagcagatatgaatgtacacagaaatgacaaaatcccagcactgtgggaggccgaggagggaggatcacgaggtcaagagatcgagaccatcctggccaacatggtgaaaccccatctctactcaaaatacaaaaattagctgggcatggtggcatgcgcctgtagtccagctactcgggaggctgaggcaggagaattgcttgaacttgggaggcggaggttgcagtgagctgagatcgtatcactgtactccagcctggcgacagagcgagactctgtctcaaaaatgacaaagtttgagcaacattaatttggactgtaaattcttaaagaatagaaaagtcatgtttttcttctaagaaatattatgtttttacattgcaagaaatatgtgacacagagtttttcttaatctctcttttttagtatattctagacaggcaagcacatgcaatttattgagcacccagtgtgtgctaatgcaccaaacggagctttacatacattatagctaatggtctcaataactttttcattttattttcccctttcattatcgccacttataaatgaaaaaactgagctccagagcggtaaggcctattgcccaaaatattagataggaaacaacagagctggaatttgaaaccaagtttgcctaatgaaaaacatttatgttcttttcactgtacaaagctgctgtaagtatcactggtgcctactccaggccagggagtaaatatcattcatccttatcacatacaaagtataacaaaacaaaaacaagaagctctgaatactaaataataataataaatactttataaaagataaactattctctaagagtaaaagataataaacctattgtcattgtagttggtcactgaacttaactaatttcctaatggacgcagcagaattgtttgttgtttaagcaaatatcaaggcataccccccaatccctgttacagggaataaaaaaagtcttcttcaaatgcctttcaaaactaatgtgaatattaaaataaagtgctactgatctctctacattctagaaagatctcagactaacagtgtcaattaaactattacaacaaatagccatgtaaaaactgctcccctactagagctacgctatcacaaaattaaccccagcaatctacagttctagaaaaagagttggtccctcctgctgaaaaagagaaaaccaaaccctacatattttgtgaatccactgaaaataatgacataaacagcactgcacatccatcatgtatttatatcttaagtgatagctacagtctatgtaactatcgcagaaatcttcttaaactgaacaaaagcattatctatcatcctttctctctagaaaaataccagtttgtttaatctacccataacattagaaaaaatacttcttttatcatgggcaatccttatgtttcggaatttttttcgaaaacgtagacagttcataatgctctcagacagaagttaccactactaccccaaatattaagtcaaaatgtaactgaaaaaaagaaatttatctagtaatgattaatttattgaataattaaaaattaggagtttttgataattaaatgttgggaataattaaactttcactaaatactggcacaggaactgaacggatgacaacagagacaagttaagatttgttttaatcctaagttttatgctaaggtaacatcaagggctctacttttcagtgaaagaaaaatttcctttaaaattgtttccctcttccattattacttaaaagcaaagaaagtattttttctaacagtgattataggattctcaatctttcatattaactttaaggtactacatgtaagctacataaatctttcccaaatctacctttattgagtagatgaaaaagcagatatcgaactcaaaacatctaaatgttgattttctataattatagaagatattttcttttgaaatttaaagtttgtatttaggcatattaacacttttttaatctaagatttaatatgttaatgtagaaaacaactgaggctgttttctctctataaaactaacatgccttttccaattaacttagtttccttcttagcaaaagtttaacatttatatctgttgagttacactgtagttgcataatgtggaaatatcttaagatttagccacttctatgaagatcctatatttgttataacacccctcttgcccagaagaaaatacatcaacaaaaagtcctactatatgttctgcattgactattacaaagcagtagggggagcagccagagaaagctctgagacaaagcacccagcaaagcaatttaatttataggcaacagaaacatgctagagaggtttgccaaaagccaaatacacaaaataaattccataaagaagtcatgaccacatttgtaaagctggcctaagtatatttggaatgaagtatagaaaaatctgaagtctcttagaaagggtctggattctaacttcaagacagactttcagcttgaaacacagtcatttccagccatgccaaacctcaaactgcccccaaaattagagcagaaacaaaatacatttttatagtgatatgtcttgggaataactcaaaatgatttcgttttctcctttgaacctcactgaacttacagggaaggcctggtgaaatgtgcattattaggtcacaagaggataacgttacagggttccatagcataatccttgaaagccctgaggcccaggccgctgtcctgctctcctctctactgactcccatcctcaatatactttccatgagagaaaggtaaccaaaaacatggtgaaactattctgcttaaaaggtgttttactgaaaaggcacattgaccactaacccttattacatttcacatgttctaaaaattagtaaggtctgcattttcagttttagagtaaaacaggaaaagtacttagttagctcttctgtctggcattctgtaactggaatttaagaaaagcctaaacttctaattagaacttcagaatgttcatgtctgtattataccacaaaaactgtaaatataatttaagcatttttatgatacagaaatgtgcgctatagacagttatctaagaattataaaaatccatcaaacttgaagtgtctggtataaattacaaccgaatggtaaaaagacattttagccacgtaggcaaccaatgaagtttgacctaaaacccaaataatagcaataacaacagatacagtgcctactattgtcagatactatattagctagctcttttgtatatattctttggaactcttacactgacttttcaagatagttattatggtgcccattgtatgctaaggaaactgaagctaaaaaaaattgaagtcatttctctaatgtaactccattagcaagaaacaaaaccataattcaacttccaggtttgcctgcctccaaagctttgagacctcactaaaattaccctcaattgtagcaatgaggttccaaaggaaatctgtacaaatctcaggcagattaatgtgcttataagggtaaatgccatagatttaatcactcaaattaaatgccatctggaatctcttaccctacttggtacaagcatcctacatgtgttacagccaaccctagccttggccaagaattcaataattttcctgcttcaatgccatcaacaagcaagaaacatatataataccaatacaggaaatacagctagttgctcctagagcatcatttaaaagctgctaattggctaagatgccttttattgagaagtctaagaaacagaaataatgtgttaacccagtttgttaaatgggtttgaggaatcagtttcctccttcctaatacctaaatccatctccataataagtattctctatcaccatttaaaaatcctgatctcttactagtgtttttattgtgcttttcaatctattagagtaaattttttaaaacctcaagagagaacacagaaaactgtcataatttttcaaaggctaaaggagaataaactgaaaatatcagtttgaacacgtgtatgtaaaaagaatggatggtaataaaactaacaactgaaaagcaatgtttctgactcattcattcatactcaagaaatatcaaataactgagtggagatgatgcaagctgtacacatttccagttcagactgaaggtgtggcaacactcacaggggccttccgatcagctgctccaactcagtttacagcttttgtggatgtggcttattcatgcccttgttatgaagaagaagggtaactttacaacctttagcaagagcttttttttctttctgtgctaacccttttttgtctataacagtcatgtaagcttagcactgatttagaaataaataagttaaagaagacacgaatggcttggacattaaaagtttaagcaacagcttaagctgagctaagtttaatgttaaaaattagtgtgacagcaataatttttcaattcagctctgtcgtgggctaggaaaaaatatcctaatttttcagccacaagacataaacattgctagaatgactacattttgaaaaaattatcttctcactttacctagatttcattttaaccaaacagaccaacctctcctattaaacctgtaaattaactcaaagtctaatctggggccttcataataaagattttttttttaaatccctgtcttatctggtgcctttaaaagaaaggaatcattttaggcaattattatgacctaaaaaatttttaaatcttaacgtatagattaattccttgacagctgaagtcatttacaatacattattaaatttcacattcagttttaaatccaaacatagatctcaacattaagaatatggattttagggaaagtaactagctgctcaaattcatttagctgaaaaactactgtcgaatcaccttgaaaatatacactaatgcttgcacattgctaagtggcttttgattctgctcttcattttcttacacagaatcaaccacacaatagaattaagaactcaggcccatggcaaagtgctcccatttagcagttaggacactggacatattcagcatatgtctactgctattgagaatcaaattatgaaaacaaactatattttataaaactaagaatttgttactcagatgagaataaaggtgcctaatgctacagcagggggtaaaagtcccagtaagagagcaataattggtcattctgatgaggagctgtgccaaatttagaaatgaggcacaaatgacaaaaaaattgatcatcagtgtggacatgggtaggtcagtgtgcatatgggtaggttagtatctgctggccgtgtctacagagccccttttatttatttgaagccaacttttcacttgacaatgctacctacaaaagcactgttaatagataagacaatcaagtggctgttatgccgtggcctttttgtaaaaactgcatgagaacaggtgggataaaaaccatagaaaggtagaaaaaaaaaagcatcactcatttaaagatatgtgcacatagatgaactgtaagataatataaccttcttgaccttgtaaataggtggccaaaaatacttaaatatcttgacgaggcaactattactaattgtctcacaacattaccagtccttactggctgaatccttcagccatctgcatacgacatgcacaggcaaatagccactaaaaacatacacaattccaattatctccttgcataactaaagacaaaaagaacaggaaatccaaaaaatacagcaaaactgaaaacactataccttgccttccgtgctattttaaggctgtcccaggctgaaggttacttctcagccctcaaaactccattaactgccaagaccagcaccttagcacatatggcacagatgcctagttgaagcctccttgtactaaatgacctcaaaaaactgggctttctttccaagattaatggaaacaaaagtaatgatcataaggaaccttctaactctgttaatgtttcctgcggatatgtatggccaactgaatatataaaggctcagttcttgcggggtaccctgacaactagatgaattagggtgaaggttccaagttcgatgaactcttctgagtttgagtgccctaggtggtgacattcaagtgatttcacagacatccaccaattcttattttcaaccgggaatcccaagaacacctttaaacatgcaatgcccatggaccctactgggtttctgctgcaagggctcagtgttacttaggaaccctgtgtcttgggagatacttaaatttagcacgtcaaattgcttttggaaaatgtttatctggcgtgactaggggaggcaaagcaaggaaacaggaacctccctctaaggagcagaatagccaacatgcagtaagcctaaaaaacctctcaatttatttcccggggctatgggtaccagtggctcgccggcatgggaatcagcagcctgggggcaccagtgacagcagaaccggggcttaccttgttggaggccatctcactgacggagtgcctggtctgtagggtctctagctggtccagacaccagtccagctcctccagggtctcgctggccagtttctggtaggcctcctctgcgaagagacagggaaagggggactcagttctcaagcgcttcacgggtccgctagcgagttcaaagggggccatcctgccataccccgccatgctcggatgcccggtgccggcacatgagggctgctccttcatattgcccagcccggcagtgcaacgggggcggaggctgtgctcgcggggcggccggcctcggggaggcacggtctctccagcttggcgtctcgggtcggcctccagggagggcgtgcaaagagcggcgagccaactttcacacagcgacgcgagcggaaaaaccactatgcgacttttcaactgtgcggcgggcccgagtcccagtccaggagcccggctctagcggatggcgagggggtggcgagcgcgcttgggtgcccgccccgcagaggagcgtctggtccacagccggatctcctcggtccccaacccggagccgcggccccacgcccgccccgcctgccgagccttctgcacggcacttgaagtgaatgaatcagccgcggccgggtgcgcggccaccacgtttcctgttttctttctcaactcctcgggcggcaggcgcagcgcggctccaacgccgcagctttccgggaacactccccctcacgcccctctcggccctcggcgctgcctggctcctcctcaacccccttacgaaaagattccgaattgcaaaagcctgtccctgtccgtgccacccgccgcgtccttcccctcgagctctgccccgggggccccgccacctcgcagtgccatccccccggcgcagccgggcgccactcgctttgaagtgcagacgaggaggcgcgggcgcgagcgtgtgtgtctgtggggctgctgtgggactgtctgtgctaggagagcggcggaaaacccggcgtggagcgcctgcagtccgccgtccggggtcgcgcccgccgcggggctcaggagggaccggcacgcaggcgcgcacggccgcgcacctgtctcgctagaaccccgcgcgccccgccgagccactgccctccaggttgcccagaccgctggagcctctgcgactccacgaccggctgcttcctgcgaagtttcacaaacaaggttatttaggaccctcaaggtttctgagggtttaagttttagggtttctgggggttcgtttctaaaggcttaggattcacctacttcaaggaggcagggttgtgggaattaagaccgcattctttttctacccagcccagtccctactaagtaccagacttctaaatgttggggcggacagaaacaagcaaacaaaatatacaatgttgtggggtcggaacgctttataattcacaaatttgacaataggctgcattttcatatgccgaattgcctaagagttctcttaaaggaacagcaatgtgaaagaaccacatggtaaggagaatttacgcatgtcctgcatactactcctttcccctgtgaattgcataagacctagatgatcttgggccaaggaagaaaatctggaagggtgtttctacccaccatgtgcagagtacactacaattttgagaaaacggaaagaccatattcaaaggcatacagaaaagcctgttctgtttacaaaggctgacccagggcaccagggacactgtccctaagcagatcagttgtgggagaacttttctacattagcatgcaataagcaaaccattcatagtgaggagaagtcaaactcccaagggtccatttgataaaactttgtcattgtcgagtggaaagaagatactgagaaacttacactaagtggtgggatcccttgtctttgtctttgaatctacaggtattggagaagaaattctgcccttgaaatttagactccataaattaacatggcacaacaaataaagttcatggactgaatttaggctcctgggatttttgagatagctttttatgtgaactttgtaaaagttagagtaacttttaaagtagttgttacatgtgccacgtggcttattgttatcaagaatacttgaactatttactgttcactttgagtactctaggttaaaatttgcctcttttttgttctacttcctccaccccgcagtctatgtaaatatatactttagatggacaaacaactgcctaaaccttgccaggtgaattaaagtttcagattgaagcttttttttcccccttaacaagcttaaagatattaataattttaaatggtaaatataaaatacctgctctgtatagcttccccaattctaagaatgtaaaaaatattacatgcttgttataaaaattgaagcattacacacaaatataggaagtccattgtaaccccacaccctaaagatcacaaacaatactttcgcctatggctctaacacaatcattttcattttactgaataacttccatatgcaagtatagcatcacctagttgccatggtagtgcatctactatatggtttggttttgatattttcctctctctctcattcccataatataggaatgtaggaaattttaagaggacattgacttgttttatgatcatttgagctgtccatagttagcctatccagtggattaaagatgcataaccattgtgtctgggatttgttcagtgccatcttttcaatcattggttacaatgaagctgggagtcccctctgaggttcggctttctgtggctcctctcccctgcactccaactttctcaaagcctgagcctcaagtgatttcccagtagctaagtaaactgcccccttcctccatcttcaccaagttcccaaagctgttcagactcaggcttcaaatctaacaggatgtggctccacacattatatttcagttgttattttttaatgtggaaaataattcaggaaagttttggctaatgcttcaagacatcatgcactttatacacaggatttgttcttaagaaggtagtatagtgacaggaggaacaatttacttcagaatatccattttatgtccaagccatgcaccagccacttttgacagacaggatttgagtatgatgataaaatggggtaagcatatattttaagttctaacatctgtataaataagaaaaatgaaaaatcactggaacacatctacatgctagtgagaaaataattactaacagagtaaagtttgctctgtgaaactgttgctcaaataaagaattattcttgatattagcatagagctgagaatattgcttttttccaaattcctaggtgagtaggcaatatagctagccacgatttttcaggatcatttgtaaagcttcacttttaggaattttaaccccaagtgttctaagacatcaagtaactgaccttttcatcccgccgaacaaacctcaaagtggagttgccaactatcccacaggaaattgagtcaccacaccaagcaacacacctaaatgtcgacagctagcaggacaaaaacagtgagccagtttaattttggcttttaccaagaacacatactgcattcattaataaaatacttcccctcaacccctgccagagtagtatacactgtggctctccttaaaaatacatgaaaactctttaactgcaccaaatcttgctaagtcaaggaactaaacagagaaaaacacccaagcaaaaactattggctaaactccctaaaggctgggagagggctatggaacagcaactgagaaataaattgagccttgaaggcccctgctacaacagcatcagttttcttcaaggcacctttgaactatgtaacacccgcattctgctgaggctcttctgtgaacaaacagtcctcaattcttgcgggccagcacttggcttctgtcacagtgatatgcttagaggttcccctgacacatggcctgaaactgtgccaggggctccaggagaagatgctgaagaagcagcttccttttgaaaaaggaaaaaagtaatcacctcagagccacagcagttagctagaggttgaggtcattttttgtgaaatgttcagtccattactcttacccacaactcacagtgatgttgaccattgaggtaaaaggatccactgtacgggatgtgtaactatgtggacattagtttctttgccaacacttgaaggtctgctaaaggactgtatcggcttgtcataattcctagatagacctattggtatacatgaagagaacaagtccaaaaaataccacttattttggacactatttgtatgcccttaatttaaaaaaaaaatacaaattataacagctgaggtcgggcacagtggctcacgcctgtaatcccagcactttgggaggccaaggcgggcagatcatgaagtcaagagatcaagaccatcctggctaacacagtgaaaccttggctctactaaaaatacaaaatactagccgtgcatggtggcgggcgcctgtagtcccagctactcgggaggctgaggcaggagaatggcgtgaacccggcaggcagaggttgcagtaagctgagattgggccactgcactccaacctggacaacagcagaagactccgactcaaaaaaacaaaaaaaattataacaactgatccagattttttttattattacactttaagttctagggtacatgtgcacaatgtgcaggttagtttcatatgtatacatgtgccatgttggtgtgctgcacccattaactcctcatttacattaggtatatctcctaatgctatccctcccccttccccccaccccacagcaggccccggtgtgtgatgttccccttcctatgtccatgtgttcgcattgttcaattcccacctatgagtgagaacatgcggtatttggttttttgtccttgtgatagtttgctgagaatgatggtttccaatttcatccatgttcctacaaaggacatgaactcatcctttttcatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagacccttgaggaatcgccacactgtcttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtcatgatgagcactgatccagattttttaaaaataaaagaactacaacaaaaagctcctaagagcaaatacttaaatctccctaaccagttccagcttctcttctcttaattcttacaaaatttcccctttgttctacggaaggaattgatactgtctacagtagatagaactggaaaaaatgatttctgtttcaccgtgtattgctttgagctagtcattcctttagtttgctacagtaaaagatttgtgtaggttaggtctaacttttgctgacttaattttttttcctctatacattttatctgatgggaaatacatgaaggctttggattctctttcaatgtgtacatgtaataggtttaagcagagtttgctagtggcaagctgctctcatctccaagtgtatttctggcatcaaattattgttttgaagtattttaaaattgtataaaatatataaaactttatttagtacttcataaagcttccaaaggaaagatgtgtgcaattttgtgacggttttctttttcttttatcttctcactaactacaattgtttttccgaatgttgcctatgcctctagtagaatttttatatgaaataaacatgaggttggctttcattgacttttagtcccaccagtaactcaacatttatttagcactgactatgtgccatgcactttattagaggctgcagaaacaagatgatgaaaagagtgtgtcccttacccagagtccagcagaggaggtaatttcagcaaacaactgtagagtgcactctcacagaaggaagcatgtgggctatgggacagtaaaagaggactatttaaatcagacagggacagaggtggagtgggaaaaggctgagtcctcaagaatgaaataaaagagagtgggaaggatttttaagagaaaagatgagcaagcacacagacctatgatgaacaagatgtctgtgtcggccaggcgtggtggctcacgcctgtaatcccagcactttgggaggccgaggtgggtggatcacctgaggtcgggagttcaagaccagcctgatccacatggagaaaccctgtctctactaaaaatacaaaattagtcgggcttggtggcacatgcctatattcccagctacttgggaggctgaggcaggagaatcgcttgaacctgggagatagaggttgcagtgagcagaggttgcgccattgcactccagcctgggcaacaagagcataaaaactctgtctcaaaaaaaaaaaaaaaaaaaaaaaagatgtgtgtgtcaaaaaagaaataaccatgagtagggccttgcttaggggaacagattctggagaaatctgagaaatcctcagccactggccatctcaaagactggccatgtcaggcatctgcaggtaggactatatcttcaagagtaggagtcacagagtgactcagagtactgtgtgacatgggatctgattttattttatatggaaaattctagtgctatgcaattaatggaatttaagaaagtaaagttgaagtcagtgcaaccattatctttgaccatattaagaataaaattaaataacttatagaccatttgcttctctgacgattattcttatctaagacaatctctgtattaaaatcctacgcagacatatgttcccacaatatgtcaggtatgaacagaaggactgcccaatgtgacttgaaagggagtggacttcttgctcttaaaaactacaaccttgtagtcactaacttattaatcatactgtaataagatggagaaaaaaacaatggaattcaccagaatttctttcacgagagtctgcctgcattaaaatgttcgataaagctatttatgacagaaggtgagactttgaagagctttggtttgggtggaactaatctgtgcctcatctacacaggaaaggggaggaatatgccagttgctagagagggaatatgtatgtgtgtgcatgtgtgtaagcgcatgagagagcgagagaatgtgtgtttgtgcacatgcatgtgtgtgtgtgtaagagaaaggagtcagcttggtctctgtgtgtgcatgtatgtaagggcatgaaagagtgagagagagagagagaatgtgtgtgtgtgtgtgtgtgtgtatgtgtgtgtaagagaaaggagtcagcttggtctaaagggtaactccaatttgtacatttttcctttctcccaatcatcaataaggttattgaagatgtgtgtgtgtgtgtgtgtgtgtgtgcatataagagaaaggagtcagcttggtctaaagggtaactccaacccgtgcattttccctttctcccaatcgtcaataaggttactgaaggtacaaaatcccgacttgttttgttttgttttattcattgaagggactgagcttgaaggccagattggcccaagcagaaatgtctctctgagctgacataagagaagagtcaaagaaagaggagaaagcttttataagaataaggaggccttttgtccaaaaaattggagtttgagctaagtttaattaggcatctaggttgggggcttcatgtgacatgtgtgcaactgtgagtgatattattctttgaaagaaactggaagagtggagaaagattccaatctctattccacttcatacaagcaattccaggcaattcagctactaatctttctagggccttatttcacctatagattggagataataacaagagccttgtaagttattttagttcaagtgagaggttgtgagttaaataatcttgcattgattgcctaatagattcttttcccttcctcctccattgtatcttcactttctcctggactcaagtctctaacttaaatgcaaacattctattaattttagtgagcctatcaactaatacctaggtataacctcggggtccagaaacttaatagttacctggaacagtttttagggtagttagaaagaaaaaagaatttcaaggaatgaacagggattcattctgaagaagttcacttagagaacacaggccattcaggaagctacaaacaggtagggatataaagtttagatcagacagtggacaaagataaagatggagaactagtcttggaggacttgtatactattctaagacaatattttcttctaaagaggccattaaaaatcttctaagtgaggaagtcacatggtcagatttgcttttcaaaaagattactctgggaatagtataaaggcagatcagaaaagtaaagaccagttaagaggttggtgaccagataaggagaaaatcctaagcagtccctgaaggggaaggagaagctgcagaaagttaggaggaaaaactctcaggagcaaagaaaaaggaaatgtcaaaggaaaatattgttatggactgaatgtttgtgtctctccaatattcatatgctgaaatctaatccccggtgtcacggtatttggagggaaagcccttcggaagtaattaggtcatgagaatggagccctcatgaattagattcgtgccattataagaagaggccagaggttgctctctttctaccatgtggatacatgctatgtgggcagtctgcaaccctgaagatgccctcaccagaacctgactatgctgacaccctgatctcagacttccagctcccagaactgtgagaaataaaagtttgttgtttaagccatcagtttatggtattttgttatagcagcttgagctaagacaaatatcaaggctttgccattgatattcagtacagaccgtatatacccacaggtttgcgctaagataattttcattccaaacacatatttcagcaacacaagactaaagagggtgttaaagaatgctactgaggaagcttttgtctgggaagttgtttgaacaaagttacaggacaatttttgcaaacaggtttaaaaaaagttacaattatgtatgctatttacgtattcttgttgtaattttaggaatcaattttatttccctggggggactgtaggagagcatctgtgtttccatcatatactatcaatcttaggatataacagtcttttgttcttcacctttgtcaattactgcatacagtattccttagagaaaacaaggagtttgaacagattatctttagcacctacccagctctaacattcatttattatctgatttctgaaattgtactatctgggttaggtgttggttttaaggttgttcattatagttagcctggatggggtcagctatgtttgtagagggaattcctaaactgaccagttacttgtcaaggatcccatccaataccatgatcctggaattctgtgagtttagctcaactgttcttcaggggtacatgttttctatttgaaattgaggtattctcagaaataaagctattaataaatagaaagttctggagtatatttacactcactctgcttatctccactcctacccctaccatattcccatccaatactttgccagttgacttaccaatttcttcttaatttctgtaactgtcaccttcagtcaaattctcatctgtgtatttctagattcatataatggtctactactggatctccttggattcactttttctcaacacagtcctatttataaagtcagaataatcttccttaaaccctggttttattgtttcattcttttaagaacctgctgcacaactctctcctacttattgtattaatgtcacacttctgttcacataggcctttttcggctgcttttcaatacctttcccttttatttacatctaagactatcccatccaagactgcccatcttagccaatctttccacctggaaataatttgctggcttctgcctgtatgacttttctaatgtcatttttatatttgtgtctaggcctttctataactgtctagaaaattcctgacatttacaggcactcagcaaatatttgtgagtgaataatcagtaagtatgcttgttttctatcagataagaatatttatttccaaacgagattcaaacagtaatactggcctgggtgtggcttcctacatgtaatcaccctcgtctatctcttgttctcagtcttttgctttcaaactctttctctttttttaaaagagtattaggaactaacattgccaaaatttggtaatggtcaagcagatcatggtgtcttactgaagtgaaatattaacattaaaataaaaatgacaagtattatggtatatcattcatatgtaatgatccttacaaaatagagtaaaattttaaaagaattcaccaatacaccagtatgatgtttgggagaaacagatgaatgcacaaaggtgcatctgatgcaaacacccccagaaaaatgagcataagttcatattatcaatatttttcactctaaaagtgttcactgacttccctgaagtcaccaaggactccaagttaagaatactttcctgagtgaagaaaagaaagcaattattttaatcaacactgccccagaatcttttattcggaatcgctatctctgctttcttcttcttcttttttttaactttctcataaatctctgtttagcatttatatctctctcactatgagatacctaagggttaagaagtaatgccaaagagacatttgtccagttgaagactgggattaagaaaaaacacacagccgggcatggtggctcatgtctgtaatcccagccttttgggaacccaaggcaggtggatcacctgaggtcaagagtttgagaccagcctggccaacatgatgaaccccatctctactaaagaaaatacaaaacattagccacgcatggtggcgggtgcctgtaatcccagctacttgggaggctgaggcaggagaatcacttgaacccgggaggcggaggttacagtgagccgagattgtgccactgcactccagcctgggcaataagagcgaaactctgtcccaaaaaaagagaaaaagaaaagaaaaaacacacaaaagatttcccgaaaagactaggcccttttaaacaggctatgaacagagtctcagaaaggtaatttcttatgtacaatttttaatctcattacttgcattacaagcaacacatatgagtgataaactattttggcctactggtaaacctacatttgttaactgtgtgtgcattatagagaacaaatttcagaactcaagagtatatcggttatatttggcttatccagttgtatatgaactggctccatacacgaataagataaattagttttataattttacaagaatatctatggagatttagatttggctaagaaagttattatacacacagaagaatccacaacctataagagctcttcatgggaaatagtgtgatagatcagaaagagcatggacttttgagtcactcagaacttgaattccagccttgccattgttctagttgtattatctgaaataagccatttaaaagacctgagcacattgtatacattgagaattacagggttattatgagaaatgcataagaaatgtaaagtaccaagggctgtatctgacatatagaaggtattcaatcaatagtaggtatactgaaccactttgcagagttgtttaaataagttaattttaaataaggtagttaatatttgagagtttccttccttttccacagattctcaatcctaaaacagttactatttttccatcatcaccatcaaccctcaaatattaaccagttctgagccaaatgtgagtgaacaacctatgatttagaatagcttttagaccaggcacagtggcttacgcctgtaatcccagcactctgggaggctgatgcgagcagatcacttgaggccaggagttcaagaccagcctagacaacatggcaaaaccgcatctctactaaaaatacaaaaagtagccaggtgtgtgtggcacatgtctgtagttccagcttcttgggaggctgaggcaggagaatcaattgaaccctggaggtggaggagatggtgccactgcactccagcctgggcaacagagtgagactctgtctcaaaaacaaacaaacaacaaaatagaatagcttttacaagaccacaccaaatcatgaaaagtcaactatgtaggaagaatatgtatttgtcattggttaatgacagagcatcacttacactgaggttactgggaagatcatttcaaacatttcccaaagaatgttccaatcaatattgtccttataagattctccttactaatgacgttttgtggtcaaacaagcttgggaaatattgtatatgtaggctttttacagtgatttctaatggacacgaacctaccaaaagctagaaggtccacagcaaaatgagatatttaattttattaacaagcattatctaaacctgtttgattttagaatgcatttttcacacaacaactatcacctcttgaagaatacctggaataggttttcctatacctatacctatatgtcaggtaactccaaaacattaacaaatacatgtgtttagtaggttcccatatggttgaaatctccactaacgacattttatttctcttcctcctgactttgtatgctatcgagaaatggtcagagagtaatcttcctccctccctttcttcttttctttctctctttttccccctgaaagagaatagtcaaaaaatccatacatatttattgagcctctctgatgtgatagttgctgtgaaatacaagaacatgaaagattcagcagcctgggcccaggaaggaaccataataacctgctgagaaaatcagacacatgatcggctgctgcctagagacagtgtaaggtagcatataaatcattcagcctgggagtgctactgtagttcgagcagggagagggaggtatggactatagctcagtgtgctgggtttcaggaagaaggtgaacttggatgtaggtcttcaaggaagactgtggttttaatggctgtgggaggagggagtccgctggcattgttttcaggtgtaggaaatgtctgcagcctgaataaaggttgtatgtgtggacagtaaatgggctgggtggagtagacacattccagggaggagaagggatatagagttgaacacttaaatgtgtggccttgagctagtggatattgtgggaattggataagtgcactggtagcctaagaggatagaatggagaagagagaaggatggagactaaggagctattgtggtagtccagatgcagtggaaagcaaagagttgtggaggtatccactttagtggtctacgatgacagttacaagcaatagaaagagtatgacttgggaacagtggttcaaatgctggctctgcaacttagcaaccatggggcaaatttgggcaaattaacttctctgtacctcagttttcttttttgtaaaatagggctaaaaatacattccctagaaggtggcctccaggccattttcccacactttatttgaatgttaaaactaactttaatctaaaaatcatatattcatatctctatcttttttggcggttcagttcaacttaaatgtgttatttgttaaaaacttgtaattatcatctattacatgtaaaatataagagctgcttttaatagtaattcatctcctccctatctttttttaaaacatggtcaaaattaacaaaacaatcttgtatttttgatactagtagtggtatcactactactagaggtacaaggactcttgtacctctctgaaaagtagcataattagcaacagtattgatggtatctgctattttagattatttaaactgtagtcactaaggtaagcaaggggaagaaggcatgtcatttatgtgtttttcatccttaagattagcgtttggaagcatatattattccacagcaatctggataggtcttgccatgccctgatcttgtaagcccaaattttattttgaatactccagctttgcacttaaatgacagctccttgataaaagaaaaacaattgcctaacaattttcttccaattgtctgaaaacataatgggtgtacatacacacacacacacacacacacacacacacacacacacacacacaatctctagggcatatttactagatagtattatgtaatgtgtagacatttttaattatgataattaagacaaaaatatgtgtagcaagtttttgatttgagacaaatttgagatttactaaaattattatatgtgtgtccttctgaagacttcatattttcattatatatcttcattcttgaagtataactcttaaattgttgaattaagttttatgaattaagttgttttgttttttgtttttttttgttgttgttttttttttttggccaggcacggtcgctcatgcctgtaatcccagcactttgggaagtcgaggtgggcagatgacttgaggccaggaatttgagaccagcctggccatcaaagcaaaaccccatctctactaaatctaatcttgtgcctcaagcgaggcacaagactcacttgaacctgggaggcagaggttgcagtgagctcagatcgtgccactgcactccagcctcagggacagagtgagattctgtctcaaaagaaaaaaatttttttccatttttaccaataccactattctcaattcatccactatttcactaggaattactaattcagtttacataatttattcaatgaataaattattcaatgaagaagcttctgggtatttaggtgctacatgctaatttcaattggcatattttgtttttcaaatttgttcttggtgacccaataattatacctgtccaccttgaaagtgtctttcttcatcaccttcaaggccaccgctaacaagacctttgaaaagaagtaaacagtagagaatttcaacttctgtgatgaccaccgtcttcttctgaatccccagactccactcatacaaggttttggggaagtttaaatgaaatgaagcagtggcttacaaagtttattgacagtaaactacagtaaaatttatattttatactataacctggtagatttgtttaaagtaagaggtgctcacttttgaaggcatgtggatgctggctttcagtaatataaaaaaaatgtacaaaaaggttttatacctatatttatttttaaaaggtagaggagagcagtggactcctatttaaagaaactcttgtgttttataaataatagtcatggcaaaatttgtttacagtctttaacaaaccatgcatttcagtataaattaaaccaataaaaagaattatatatataaaataaaaaggaaatgtatatataggaacagtatataccatacacataagagtaaatatatattcgagccaatacagagaattgaaacataatttaacatgaaataacatttatccttactatgtatgattcactctgatgttttctattttatttaattttaaagtattaattgtgaccccttaaattgattttgaaatctaccaattggtttgaaaacactgaggtaagaaattaccttgcttaataaatgttagttttgtttccctcttccctcttcctccctttttataattaaaaaactctccctctacttctctacttcacgtgagagtagaacacataaaaagatttcagttaactactgtgcatattttttgaagtaatttctccataatgtgtgagttttctcagggtactacaagtttaccaacagaacacataaagcagcggccactcactgaaatgcctataggagacagatagaccatatgaatgaatgaatgacatggttgctgggcatcctggttgcagtggctagaactgtggagggtaggagcagaccaccatatatcctaggcatttcattggcaaatgaacaggagaaggacacctttccgtttggccctcattttcctagatctttcctcccttcctctgtcaatccctcctacatagcctatgttcccaaagcaccccttgtattataataataattattatgatatctgtccttaatcaagaacttatactggatttttaatgcctttaggtcttccccaaacttcagttcatctattcgaagtccctataaaatctacctccttagacttgtctgcccccattattcccctgtggttgacctcacctccatctctatcttttgtcagcaagtttcctcagagttccctctctgcatacttgttcatgctgggttatttgtttttgccacttgatcatctagacctttttccctctttccctccttctattcaatttctgcctttcactgctgtacaaaggaggggcagggaggccctccagggtggagggaatcagtcttgagataactgagagattcagggtgatgagtcccaaagttgaagagaatccacatacttcttctgtttttgttttacctagcaaggagccttttctatagacaaagttgggaaaccagaggttatgacgtgattcatctttgcctacttaaactttagcttgattcatcacttctcaacaaatacttgttgaaccccaccagtaatacgagaagcttggtattctatgaggtgctcaacttccaaagcttagttcagaagaattctggcctcaaggcgtctaccatctagaagcaaacaactaacaaatgaacaaatgcagtgatttcaaaagaaattaaggtgtgctgtggtagaggcatgcacaggtcagaaaagttcagaggttccagacaggcttcctggggaggatatccatgccccgcctccacctggtagttcatgatcagagtttgcaagcttggctgggatagagggaatagcgtgtgaaccacagaaggagtggatctggtggctcagacacggcaagaaccagctcatggcactaggctgcaggcacaccatgcacaaaacagtcttttctttccccagttctccaaattctctaaagtggaagcctaggggtgagggtaagaaggaggtaggaagctacaaccactggagcaaaggacgaaagaaggggcttgagtgtctaaaagtgcagaaactcaaccgactggacgctgagacaatgtttaaaaaggagtttttttgtttgtttgttttcttgtgtttttttttactttaagttctgggatacatgtgcagaacgtgcaggtttattacataggtatacatgtgctatggtggtttactgcacccatcagcccaaactaggttttaagacccgcatgcattcggtatttgtactaatgttcttcctccccttgctcccccaacccccaccaggccccagtgtgtgatgttcccctccctgtgtccatgtgttctcattgttcaactcccacttatgagtgagaacatgcagtgtttcgttttctgttcctgtgttagtttgctgagaatgatggcttccagcttcattcacgtccctgcaaaggacataaactcattcttttttatggctgcatagtactccatggtgtatatgtgccacattaaaaatgactttttaaagtggcaactgtgggaggcaaaggagaaaaaacaggagctgccagataagggagtgaagagaacccagcactttgagaattccgttacattttgcagcttgaattcttcactttttgctcccattatgtgcctctttctcctctccatgaactgggccctgtggacccaggatcctgctgtctttgcagggcaaagaatggttagaaatgaattcattaaggtgagaaaccattgctggcataattctccttcacggaaacctggcacttaaatttaacctgtttggttagatccagctctgcctcccccatttttttctgcagaaacaaggctggcagatccctgttcctcttaatccttgaatggaccaaatgctgggttatgctggggcagtgagggaccttacaaacactgaaatttaagagaacagtttttggagtaaggcagtccttgtttccaaatctgagctttgccactgattgactagcttggcaccttataaaagtgaattaacctagcttgttttctaatttataaaatggagaaagcagtacctatatcacagtatgattctgaaaattatttaaataggactatgtatgtaaagcagtgcctgaaaaatagcaagtggtcctaaagtcactatgatgatgaattttatatgcaggcacctagagcatgttaggatttttgggatctttcccagctcacactgaagcttcactcttctccaacagtctgttatccaatgctggataactgagatagtcttcccagcatttatcaatgtggttaggaacagtaatcctggaaagcattctcaaattatttatctaattaaacaagcaaacctttttagcccagacatcctaaatctctgtagcttgtcttcgctgatttggtcagaatagctcagatggtaggaagggctttctgggtagaaaaaaataaattagcagtctggaaaacaaaagatctctgcttaaaagagtctctaaaacagcctgatcagcctgtgtattttgccatattatctagcattagtaggggactgggaaaaatccagggctccttgtagagatagagactggcaaatattatgtttgatgcatgagaaccaaatcagaagttaactctttaagttattaaatcactaaacagtctatcacaattatgtgtttattactagactgaatttctctggggctggaaccataatgaattcattttttgatctctggtgctaaacactggctgtcatatactaggtatccaataaatgtttgttgaatggaactgaaaaagcatgaaacacttcccctgttaaggcttcttttctataatatttccatagtttctaatgcatctgagaatcattaactggactgttagaggaatatgaatatggttgagggagctacaaacttcatgctctgagatgtcacatgattagtgtaacttttgttccaggggagagaaatccctaagagagtgactgttctccatgcccacccacccacagtgtcctatagagcctttcattctccagatgcctataatgactatcacattgatttgtttacatatctattgccttgtcttccttataggtacagagtccatacatcctaattggcctggaacttccaaggtctatgcctgttataccagtgtaattatgaatagcattgcctttcattctaaaaagtgttctggtttgaatgctaaatcatctagacaccctacttatgagagggttcactgtacatcgtttagtcccccaactcccctccccttggaaatctgggtactaccctctaccgggggctttccactatggaggcagctctctcaatcacagcattcaggaggtgtaagtccactcccaacagaacagacacctgtctacaaagagactcttggtggaagaaaaaaaaaaatcacttccgtaagtttaagtcttccttttaaacttgggtctcttttgcacatcagaaacaaagaatctctaataattacatccctaaatgtactgaagtctagaagacatgcccatttgaaaactctaatctagtaattaaagcttctcaggttaaactgcaccttaataatgtagcttattttgtcaagatcagttaaggccctgtaatgtgatttggaataaatggacagacagaaattaaaatgtgctggacaaggtaatcagaaatctcacttcatttagtcaataacaatggcaattcagcgggttccttttactactgggatgtaattgtgcttggctttaatttcttgtaatgatggaacaaattaaattacttcatacttttaggaacatttggctacatcatgttttggtgcttccataaaccccactggaaattaaatcagctctgtggttgctcattctccctctttagtgccatgtctgccttctgtcagcaaaatggtaatattgtctaccttaatccaccagatgcagttgagttaaaagaaattacctctcccacctctttcctttcaaatctccctatttgtagctatcaaattttggcatgcctgctggaacacagtcttgttagaacaagcacggtaattctctcgtgagactttaggactctctctacgacaaggtcagaatgtacctgtgattcaaatttagatgaggatatgagttggtaagaacatgaagagcatcagacagttttcaggacacccactacttttattttgtgctatcagtttttcctttcccaaattgcaggtggagatgcaatctttaacgctggaaatctcttgctatatgccattaaaattaattagtctagcacattttatctttaggcccttacctagggcaggtaaaatattctagcacaaaataacacaactttcctgaacaccatggctactaagttcatatggtaaagattatactatacattaccttgcaaatagagtgttgcagactgatattaaatatttaaaatgtatgcaggattattaataggcaacattgtggcagagactgctaaatgtcccctaatattgatgcttttcttcatcacttgttttcaaatacctgttttcatgtaagcatgtgactgcccaaaatagagaaaattcacagcctccttggttgccaggtgttgccatataactaagttttggtgaatgagttggtagtagaagcgttatgtagatattatatgatgtgctagaaacttcccttaagagaaatttgtcatctatctttttatctgcctgtatttattgttttctctttcctactggctagaatgtgaagttgatggctggagtcggagcagccatattggatggtgagttgaatttagcaacagaggctacacctcacagtgcaataagatggaaagagcacgtgtccttgaagactgtactggatagaggtgccatattaacctcggactgccaactttcagattttacatgaaggagaaatatctgtcttccttaagccacttctattttaaatctctctatttactgctgaataaaatctcaactaacgcaaacaccaataacaaaaaattcctattcactcatgatataggattataccttagtcttttttgtgtcatatatctgttcattcaccatttttgctttgatgttcaataaacatctcaaatttaacatatctataaaaattttttaaattttacgttcaggggtatatgtgcaggttagtcatataggtaaattgcatgtcatggggtgctggtgtacagattatttcacaccgaggtaataagcatagtacccctacagcttagtcttaagaagaagtatgttcacataggccaggctgagacttggatgttggatgactttcttccagcttactctgatttgaatatattgtgtggtagtagatggctaaactgcttgctccaaaactatctgacaatgctttttagaaagtctgccaaacaaaactacaagaatcaccctggagcttcccttaggcttcagatatttgtcttccctgccctacttggaaatcattccagcctggaagtcattgtgaggaaccaaaaaatggtctccctaccatgaagaataacactgcttccattgttgggaggctctccttcctacaggcactgtccctcactcattagacacttgaataataaggatgttcatatatttattggtgttggtatcagttagacagttgaatgatacaaatgttcatatatttcttcttattcaatagtctcacaagaacactattcttgtaaagtcattaaaaactggatggtcttttcataattatttccatgatttgtcatctaaagccagtgttctctcctcctgtcaatctgatagctttaaagctaagttctgggtgggtccaagtcatgcctgaaaggtttatcaaatgacatattgcagtcatatggtcggagcacaaacacctctgaatgtacaatattttaaagcaaaacagtttatgtgtaagctctatgaggttacggaccatgactatcttatttattaccaaatccccagctcctagaacagtgcccctcaatataaatctgtcaaatgaataaacgaagagtttgcctgcagtagtaaacttgttatttgcacacactcgaggcccacctctatgtgtacattgtcagtgagtcagcctcgtggatgactctgcaggactgtctgtataacatccactacagttaccaggggacccaattttcataaattgctccagcatcacaccctcctcttacagagactcttcctgtccattctaatccctgacacgttgtcatcctcactcagattccccaatagatagaaatgctgttaaatatacttgggtagagagggataggcatgctcaaactcgttttgggaaaaaaaattgcaactgtcagaaatgtgttagctatcttcacagattatgaaacataaatatcaattatctgttcacagcagtgaaagcctgcatatttttttaagatagcaagtataaaacggctataagtaccatgttgagtagagacctaccaccgaagtagagaccttcactgaaatagtgaagggatggttgtgttgcagggtcagaatgattacccactggttgacactccctccaggactaaaggcagcatcaccagcgtccactctgcttctccactgcttactgttaaggagcaaggcaatagcattatctaagtaggaactacttcattctttcaaaacctggaatcggctgatcagaagaagaaaaacagtataaaaatacagaaagacaagattctctggctgtcctaatgaatgctagctagctataatagcatggataagacatataaccaaacatataagatctattaattaaggggaatctctatttgtattaactcatctattttctctaaaaccagtatttagttatctcccatacattggcatattgtgtatatttgcagaattcaaaatgttactgatgtgacttttttccatcagacatctgagctatccctcaactaatagttgagctgttcctctatagctcagtatctgagttagaactcgaagtaaaaaggtataaataagtcatgctataaaattcaaaggcaatcagatgtttgagactatagttatacagaaaagtgtccttgttcttgggaggaatacatcgaggagtttagggatagagggctatgatgtgtgcagttttctctcaggtggttcagagaaaaaaagacaatgtgtgtgtatgtatatttgtgtgtatgtgcacatagagtgatactgcaaatgaggtggaatgtttacaatgagtgaatgcatgtggttttttttttttttttgcactacccatgaagctttccagtgtgtctgaaataacttccagataaaactttttttaaaggcaatcagaacagtggcaatgaataattcaattatttcatatttgagctgtctttcctgccacccccaccccctataacactacatacatacataggctcacataagtgacacttactatacttttttgcctatgtaatgagtgttggcgaagtacgtgagtgggaaattcagtcttttgcattcaagctctaagtaattctaagagaccttttagataatgatttgacttttaagacaacaattttgaggttataatatgatgtcatttcatataaacagaactgcccttttgtcctttcagatttgattgaaaatggcccatggagtacaaccacctgggaacatatcctcgagaaagacagttgaggcttattgcctaaaccacaggctactgaaaacttggccaaaggcgactactctagactggtgacttcaaaagtgctgatgaatacagtgaaccatgaaagatgcattatttgttttgaacattttactatgattgatgacccagatttggcaagttagttcactcccagtggagatgaaagtttcactgccttctttctttcaacattcttgttgagacagatttcacttttattggccaatgtactaacaaatcacttgcatttgcagcataatgaattcattagcaacactgtggatcaatgctatacataatattcctgagtcaacattaactcttaattaaacttccttattataatgcctctggaaattttccttcaggctactaaacttcaagccaacagtctaagtgttaatcagtaatcatgctagtaactttttgagatgggtcagggccagggccagggtcagtgatccatcatgaatggcaggtttaaaaatggatatacgtgatcaaaaatacccataagttgaccaaagcattctaacctttgggttattctaacactcagtgtatcagccttctgagcaagccaattttttattgccttaaaaagtctaaaagaaagataaaaacagagataatcagttttgtttggcaatggcaggggtgtgggaaatgaaaaagaagaaagttaaagatgagtgaaaataggatagtcttggcactttggtatgaaattgaagtacttatttaaactgatgaatattgtacagaaatatacagagagcagtgaggggctaagaacctaattccaaggtaactacaaggaaaaaattattgatctggattgtgaccagaattcaagagtttgactgttgtcattgttgctgttgttattaagttaaaaaaaatgagaaaaaaatatacttttttctagtatacttaccaggaaaggaaagagagaaggagggagggaaggagggagacatggagggggcagagggagagagagacaaagacactgacaaagtctggaaaaagacacaaattcagatttaagatcccaaaatatgctacatttctgcccccttcaaaatattaaactttgctaaaatacactggaaattttttttattgtttattttttaaatcaactagcagaccaattagccaagatgatattttcatccttggtactctttcaggtgagctctgtgggctaccaccagaaagtcctagccaaccaagctctcactgggtcactctgtgctagctagactacatagcctcctaaaaaagcacgcagccctgatgctggtcctgccaaagtgtggtttgctgtcatgtcctacaggctacccgtttcccagtgatttatcataataaaccaaatgggaatgaaatacccagaaatatgccataaatctactagtggtgaattttcaatattctgcacaccatggtgatttgttaattcagttggatctctattaaacctctctaaaatgtcattaaaccatctgttttgacttgttaatcaaacaacttttaaaaatgtatttagagtatcagtaacccttgaattaatgcatccatcagtaataatcccctctccaactttagatttatttttaagctctagcttttttccccaccattccaacaaatagcctgacttccaaaagtaagaatcaatcacttcagttgtagaaatgtccagagggtgccctactttcgaaacaggaagtaacttgatccagcagtcccacttcttggtatatatccaaaagaactgaaatctggatcttaaagagatattttcactgcagcatatttgtaatagctaagatacagaggcaacctaaatgtccatcaacagatgaatggacaaaggaaatgtgatatatatatacacacacacacacacacacacacacacacacacacacacacacacacacacacacatatacaatgaaatattattcagccctaaaaaaggaaggaaatcctgtcatttacaacaagttggatggaactggaggacatcatgctaagtggaataaaccagacacagaaggacaaatactgcatgatctcacttacatgtataatccaaaatagtcaaactgatggaagcagaaagtagaatggtagttgccagaggctgggggaagatgggaattggtagatgtggtcaagggttacaaagttttagtcttgcaaaataagttctggaaagctgctgtataacataagtatacaatcaacaatactatattgtatacttagaaatttggtaaaagggtagctgttatattaagtgtccttaccatgaaaggaaaacaaaacaaaaaaacccaaaaagatgggaggaaacttttggaggcaatgaataagtttatggcattgattgtaatggtggttttagggtgtatacctgtctccaaacatcttgcagaataaacatattaaatctaaagtttccttgggaaagaagatgagaaaataattgtcaagagactgtacaccaataaaatagtcaaggagtacaatgaaaacttaggaatcccatttcttcctttgactcacactgtttgatgatatcattcacatcggcatttggaagttattgagacatttcaacataagattgtccttatgatctatgatttgggactctcttataagaaagtccattctataccaatttgttttgttccttggtaactagaccttctttaattggatctaagaattaatattcctatctcataaagaagactaaaaggatccaagtagatggagtttcaaaggtggtccccataaaagcatttttaccttaagcaaagatgtcccaatttttcctgcttgcttttcggatgctgttctaaaaaaaatgtaccttattccttctactaaaagaaaacctatcaattcattgattcattgaacaaatatttattgaacatgtagtatgtactaaacactgggtaagattccagatatgcaaagaggaataagtccctgcccttaagaaaactcacagtgtggtcaagctaacaattctagagcaactgtgtgataagggctccaaaagcacatgcaggaacacagagagaggcactcttagtcttggaggggcttcctacagtgggcaatttttgatgtgtcacaaaaggaggagctattagggcacaagaagagcaagggtgaagtgcagaaaggagtgaatagatggggaggggacccaggcaaagagaataacatcagcaaaggtgcaacttcatgggaacacagtacatttggaagcctgcccaccatttgttacagcagaatgcatgtgtgggtggagatgaggctgcagagatgggctggagaggattatgagagatggatgactagcaaaggaagttggtcatgtccttatgtggtgggggaccatggaaagatttttatttataagacgtggtttattcttcattctgtggcaaaaagcagatactatagtctgaatgtttgtgtccctccccacattcatatgcgatgaaacctcatcaccaatgtgatggtattaggaggtggggcctttgggagataattaggtcatgagagcacagcccttataaggggattagtggcttataaaggaggcccaagagagctgccttgccccttccaccatgtgaggacaaagccagaggcactatctatgacccaggaaatgagccctcacaaaataccaagtctaccgtgccttgaccttggacattctagtctccagaactgtgagaaataaatttatgttgtttataagccacccagctcgtgatttatttatttatttatttatttatttatttatttatttatttagagagagagttttgctctgtcactcgggctggatttcagtgccatgatctcagatcactgcaccctctccttcccaggtgcaagtgattctagtgccttagcctcctgagttgctgggattacaggtgcttgtgaccacatttggctgatttttttgtatttttagtagagattaggtttcatcatgttgcccaggctggtctgaaactcctgacttcaagtgatctgcccacctcggcctcccaaagtgctgggattacaggcatgagccactgtgcctggctatgatattttgttacagcagcttgaatggactaagacagaaggaaaaataggcctttctgtagcgtgagctgaaagacagaaaatagccataggtttctaaagagagaaaaagatatatgtttgacaatatgtttcaattagtactttttttgaaatgcagtaagttacctataccttattccatttctaatctatatgatggcatttaaatattgactaggtttctgatacagtttttggagtctgaatgtcactgcatggatgaataaaccaaacagatcggattcatatgggtttgccaaatgacaaatttttttccatgtaagattagaggaaaaactgatttcacccaatttcctgccttatttatattagaactgaagtcaatgctgttatccctttgcatgttcttttgtatttaaaatctgatatagaattgtgctgttacagaagaaataatttaatgcattctgccctcttatttctcatgagttttcatttaaaagaaaacaaaaaagaaaaaggacatggacttttctttatttctagactttataaactttttagttatcaaataaacacatgtattaattaagtaggtaaaatattgcatatattaaaaggtacttggagactcatatgttgtcagtttttcatgactcaaaatttatgaaaaaccatctaagactatcgtaatgaagttcaattgtagatcttgaagtgacaaaacatgaaccacattgacttgaggtccagggcttaaaactgcctatttgagctctaggttaaaagcatgtgtgaaatgcaaagtctgacatctgcacagctgactattgtgaagtctcagtatcattgttcataagtaaagcttgtccctaagccataccacaagcattcccagaggatatagatttcatttgatttaacatgattgttgatattggtagtgtatttcacgtgaacttgtgaaatcattgtctatacagacaattgagacactaaaacttttttttaagtattttttgttaggggctagatctgaggttttttattcatttgttcttttgttcactcatttgttagttcagttatttactcaaaaatgtatattgagcaattcctatatggcagacactgacagatgctggattcagtgatgagcaaagcattcgtggtttctatgcccaaggatcctatcccgtggagtgtagagtcaagcaaagaatgtcaacaacaaatgaaaattttaatcttattaatgttatatgcaaaaatgtaacacctccaaaaaagacaatttatttcctattaaggaatgaaggcagtccactgaggaagatcaacatgtaagcacatgtaaagcaaaataatcaataggtaatgtagtttttgaaaaagaaggggctttaagcaggaagtcctgggtttggacttgggtttcaaatctagctatgtactcttgggccacatacccaagtcttgtaagtctcagtttcctcctttttaaagttagcctaaaactacctcgctcatctaatggtgtgagaattaggtaaacagccaggtagctcatcaaattgtaattattataattgttattttttgagtcatgaaagttttcacactgaagggaacatttcaacttgacctggaagagtaagtagtttatcaggcagaaagaatttgttagggtattccagagagaaggaacaaaatgtgcaaattcaagtagtcagaatcaaaatggtttcttaaaggaatgacaaacagatcagtgcagttggagcctaaagttatctaaataatccgttagaccttttctttaactgataaaataaagcaagcattccaaaaatcaatttaaatccatcttcctccttatacctctccattccccataccatggaaacacagttttacctcttttacaatgagttgtcagcatgaagagacttggttcattaagattagcaaacttcacagcattgaacaaaagataaagaaaagtttatagcaaatacgttccatgtgaaagcatctccagcaggttcagaagatgcaatgaaaagactaaaacttgatatagggatatttcagtggtgctcgtaccagcgtcctaacattttgttctaccttagtaaaatctatcccttattactcatcctatctgtagactctcttatggaacaagaagcttttttttttttttccctaatcccgtggggaagccctctccttccctgggtgattcctgagcaaccaggaaaacagcagtcacagtcaacacagctagtacttgcagaaaatctctcttctgtgatgctctgaatgactcacagttccagatggccttgtcagcctttatccgcattccactcttggcaccattaacctggtctactgtggttgcaacaaataacttttcttgttatgaggaccagtgttttgaaaaatttaaaatgttataaaattaaaatgtttatatttggaaattatttccaaatataaaaggagcctgtcttcattatagattatttggaaaaaatgcagaggggtgcaaaagaaaaatggaaacaagccatcttttttttacccataattctaccactcagagacaactactgtgaacattttgatgtatttatctccagtctttctagaaggtagatcactgtaagagatttctgaagcagaagtactaagtcagaaggaataaacatttttatacctcttaatgtgtattgccagatagtttttgagaaatattacagcaatttctacttttagaagtactgcttgagagtgatgttacatggtattctcactaacacatatacaatgttataaatatgtccaaaaataaaacttagcaactatgttatctccttgtttcaatttgaacttattacaagagtgatcaatttttaaatttaaatgttatttttagcaaagttatagatgcaaatagtttagagaactaagtagtaccacaaggattaaaaaaagagatctcctgcagtgcatcccccacccacaatacatacatgtatcttccactccccagagggtacccattttcaaatattttagctgattcatttgctatactccactctatctctaaatgatataactttacagttacttcttaatagttcatttttttgggcattgcttattgatacttcatagcggaagataaggatttacctttgcaacacttcacacttctcatcacccatccttctaatatattatagtcttacttagattgatagtcattgtgtttccatgagcagaaccaaagaaaaactataagcagctaaactatgtaacataccctgattacctttttttctttgttttccttcttgaaaattcttgtcttttgttagtttctttgttcccttagatgtccatatatacttatcactaattcaatcccaaacttttcccatattacaaaaatctaagtatggctcaaacacatcaagaattttattaaattcatcttcttgaagaaatctcatccagaggcctctttgacctggattggttattctccatgtctcttgctcagctgtcactttgggatgttctttccttattatcccaagggtaatgtttttagagtttattcccttgttttggtgagcacgttttccagtagcttcctgagtcagtatgcatcagagatacattttttaaaggctcgcacctcagaaataatctttattccatgctcactcttgatcaatagtttggttgagtatagaattcttggttgagaatcactttccttcggaatttaaaaggcatcacttcattcttttctaggtttcaaaacgaatcttcagaagtctgatgcccttttgatttttgatccttctatacgatacgataatgatccttagaacaagtcacaagtctcttttttaatactttatattgtgctaaatgctccaattaatgagttctggaaatttttcttcaattttgtcctcctgcagttttctcttttttctagaatttctgattttagatgttagatttcctgaactggtcctctgatttcccactttttcttctgtattttctacctttttgtatttttgctccatttccatagagatgtcctcaatttacctttcaacccttctattgagtttttaacttattctatcatgtttttactttccaagagctcttttcctattctctgagttgttttttttttttccatagcatctgcttttgtttcgtggaagcaatgttaatatttatgaatacaatatcaagtgtatttcttctcctctctctgatgataccttcttcctgcaacatctgtacttttttatttctcttctttttttttttttttttttttgagatggagtctcactctgtcacccaggctggagtgcagtgggaccatgttggctcactgcaacctccatctcctgggttcaagcaattctcctgcctcagcctcctgagtagctgggattacagttgcctactaccacgcccagctaatttttttatatttttagtagagacggggtttcaccatattggccaggctggtctcgaactcctgacctaaggtaatccccccgccttggcctcccgaagtgttgggattacaggcgtgagccaccgcgcccggccaacatctgtactttgaagttggtctttttccatttgttttggtttctttcacttactttttctaagtatttgataaatcttatctgtctactcatatttaaggctagagtactaaaaatcagattggaagctctgtttgcataggtaagatttgtcaactacatccactttttgatgatccaactgaacagtttcattcagaaataccttgcaccattatctttgggttttttctcttgggttggtgaattctccaaaggttatatcaatctcctgtccagaaggcttaagcatagttggaagctgactaggggaagaaggttgggactttcaaccttcggaattcattcaacaaatatttgagcatctatatttggcagcctctattctagccaccggagacacagtggtaaacagaatttaaaaagccttgtgttatcatgaacacaaatatataagtgtttatttaatccctctgttttcagaatggcactcagtcttcaacctgcctaggccccccttgtctagggacggttttacattcatcaggaagtataccccttgtatacttgtttttcagcttccaaaattttgttgctgttatctcccttcccactttctttgtccttgtcatttatgcctataaacatccattgatggttttctgaaggcagaggagttaaatggatatgttaattactatagatgtaatcagaggtcttcatgttgtttttttgttttctgttttactattctaacttggcatttatagatcttctttgtgagtagtctgaatttgtctttaatgatttaacattgaaacagtattttccttacttatttgcataagctctttctttgttagtgtattagccattgacctgcaatatcttttaggatgaccgattctgaagcctgctgactgagttgcttgtggttcctgtcatttagaatgtatgcaggtcatgaatcgcttagatggaacagatggaatgaaacttgctctaaatattttaccaaaataaatacatttaaataatgtaaagaaaaatcttcaatcactaggctttgaacttataacagaaaggtatctgcttttaactatattaattcaacaaactttattgaacagttggtaagtatgaagcatcatctctctgagaacaaaataccaaggaactgagtcccatccttacaggattctcaggagtaaatgggtcaatacatagttataaaatgatgagggctgatctatagcagaagtacaaagctgagaacaactcacttgacctgctaagctggggaattcaggaagggttcagatctaaagagcagacatttgaggtggttcttgaaatatgagcacaatgatggttttaccaggctgcaaaggtgacaaagtgcattccaggctgataaaagagggcatgcaaaatatggcaggtacaaaaatgtgtatttaaggaagaatgagaagtttctggaagttgctgaagatacagaaaataaagtggggggcggggggggcgggtggttggagatgaggaggagatggtaggcttgattcaaattatggaaatgtatttataatgcaccaacttgtaaagacactgttgttccctacccagcagccactagaatttgttcaggtgtcaggcggttggtgcttcaagggagatcaggcccctcccaggaccaggatgaaccatgattacttcccagccaatttcatagcatttctcttgccaatgaatggcttagatataagcatatgatgaatttgtttctaatacagatctgagaaagaaatctgttaaggaacttctggtaaagtttttatctttcttaaaaagtgacagaagaaaaggaagttgtataaatatacttagagctgctgtagtcatcttgagaccataagaggataaaactgagatcaaaaactactgtgctgaggatgggtgactagaaagaaggaaagaatctggattcttgatgcatgtttgtactactagaatcattctatcactaccttcttattatataattcaataaatctcttattatttaagctattttaaatgaagccttctgttatatgcagcctaaacaaatatactgattcaagctcccagcaaattctgtcacacataattcaaggaacgtttgttaataacttcatactattatatggggaataaatgattagtcaagaaagactttctgttttgaaaaattctggaaagatgataatacagtatgtagatttattgtcatggctaatatacatctacatataacatgaattaccttggagtagtaataaaagggcagagtaataacttgtgcagagccctagactagaaaagttgaaaatataaaatggaggaaaaagtgagttatgagattcagtaatatgaaagtataagaaataaaagaatccaaaagccatagaaggttgaaactgaaaagaattttagaaagcgtctaggccaggtgtggtggctcacacctgtaatcctagcactttgggaggccgaggcaggcagattgcttgaggccaggagttccagaccagcctggccaacatggtgaaacctcatctctactaaaatacgaaaacataactaggcgtggtggtgcatgcctgtaatcccagctacttaggtggctgaggtggaaggattgcttcaacctagggaggcagaggttgtagtgagccaagatcgtaccacttcattccagcctgggtgacagagtgagacactgtttcaaaaaataaaaagagagtctagcctaaaccccttaattatacagattgaaaaccagtcctggagaaattggaagtcctcaaagagtttaccattaatggtggaaccaggacttccacacaatgttctgacttcctttagagcactttttattatatcatatagttccttacttctcactattaatagagattattttactaagagtaagtataataagagctgatcagaagacctgagagacataatggagtttcaattctaatttgctgttggctccttgaaatgctttgttgagaaggagtaaaaagcttacaaaacacacacacacacacacacacacacacacacacacacacacacacacaatttcttaattatgtctaccatgggcatgggatggtaggaatgccatgtaactagtttccatggatggaaaccacctaatgggaaatagagaaaaagaaaaagaaaagaaattgtgtgtaaattttcagctcattttggcttagattacatgatgaaacttatttctttgaaaaactcatttgattttgaattagattatatggaacttctcctttgtcaattttaatttcttgtcttgttttagtttgcttttctgagcagtagatatcctcccaattggagattccgcaaaattagtacttagtcatcttggttcctttcaagtagaaaagtttcttttaaatacttcaaatcattggtatgcacatttgttgcaaaaaaaaacctcattctggaaaatgttgcttattttattatccaaaaaataggtatttattaatatactgcatttcttttaaataaaataaattacagattttcttccagcatccacttatttggaattgggtacatatgaagaaaagacttcttataatatggaattatttcaaaagctattattacttcttataaatataaagcatacaagaaattctcaccattttctaagatttacattagaaagatataagtattgtcttttagaatactgtttttatttttctaaatattccttataacttacttattaattttatcctttctttgttataaatatccattttttttaaagacccatactatcttttcctatgcaatttaacctaacatattttctgtaaatgaggttatttagttatccatttttctacctcctgttgcttggcagtcctcaaaaccattgcagatctttctagagagcagtttttaagaacagtgctttacttttcaactcttgatcaacctgatgagaattctttgaataaaccagaaggaaggctaaagagacaaaagaatactatagtttccttaaagttaatgagccagaatcctttggcccactttggcattgaacaatgtgaataaaatggccactctcacatcagtaatttacattttatacagtgtgtactttacactgatatttacaaagaggaaaaacaacagttttttacatgtaagaggagctccttggcagataaaagaaaaacttactcccattagtacaacactggagtttaaatctagagaacaagtacttcagaacctagtagaaaaagtccctgatttgtactttgtatgaacaattaggtttgagaatattgctatataatcacagaaaatactggctattatactacgtgaagtcttcagtgacaaagagagaaacagaaaaaatagttaatgccataacaatgaaaatgtggaatgtgaggaacgcccagtgaccgtaaatatctaccttaataagcctgacaatttgtatacagttcatgcaattaacaagtgtgataaatatgattattactctcaagttgaaatcaattttcttggctaaaagcaaagaattgttattgagcagatgggattacttttctttgccaatttatcttcataaaactcaatcaatgccttgccttaaaaatgtcaaataactcagatttcaggataacacatacaaactaatctcttctgcctgtctctacctgatcactccctacttcaaaagctccaacaacatagtataactgacacaaatcaaagcaaaaactatttttctcactgctacatggtcttatcaataatccagtatttcaatatctaataaaagataccacaattcaaagcagtaatgtgccccaagctaccgatccacaacatatatattgatatctaaaaatatatggatataacttgttatctactaaataagtttctttgcagtgtggtgttaatagccagaattttaaatacataaaaacttgggttcaaatcctaactctgccacttaaatgctatatgacaattggtcaagttacttaacctctctctggtctcaagtttcttgtctgtaaagctgtaatagcttttagagtgctcttctgaatattaaaaaggcattatactcttagcataatgtctacatagagtaaatatttaacaacaaaataacaaatattaggtgtgttattggagaattggagttttaaataaaggagttgtccctaaggtacattcaatttaactatgatatttaaaacttcaatttttcacattatttttccaggaaaatatttcactcttatttctccataatttgttttgaattgtaaaagagatttgcaagcggctgaagcagttacactatactgtatatctgcaggatgggcaactgattttttttttcttcttttttttttttttttgagacagagtctcactctgttgcccagactggagtgcagtggtgcgatctcgctgcaacctctgcctctcaggttctagggattctctgcatcagccccctgagtagctgggactgcaggcacacgccaccacgcctggctaatttttgtattgattttcaagatttgtcaagagctcctaatattttcttttctcaaacacatcttaggactaccatgcatatcagtcagtcagctactctggaggtctgctgcaaggatacacaccttccattcccacccatcagatacttgtctcctttctcccccactccaagacagcaaccttccagctctagataaaaagagctagtctttcttgcataagaacaacaaagacaaaaaccattttggtagtgtatactgcagattttaaccaaaacttctctgaagacctctgatttcctaaaaaacctcttcatcccagtgcagttgctctttcctaaatgagcaaccgcgcatctggtcaaatttggtgaatattctgtgctccagaaacaactgattccatcccctttaatctcttcttctcttatatccatctccctccttgttgtttctctccatgtttacaactagttcattgatttaaaaaccaatgtaatacacaaggaagtatgcacgacaatgtttagtgtagtatggtttgcaatattaaaaaaggccatcagtaagaaaatagttaaaggataaacttgatatacatactatgctgcaatttaagaaaactggtatagatttatacgtactaaaataaaataatctccaaaacatagtaagtgcaaagatcaatcacagaataacatctgtagtatatcacttttgatttttaaaaattacccctaattctaaatgttcatatatataaatattcagttaaaaattctgaaaagatactgctatggtttgaatgtttgttccatccaaaactcaggctgaagtttaattgccattgtaacagtattaagaggtaggactcttttttttttttttttggtgacagggtctcacttcaacacccaggttagagtgcagtggcatgatcatagctcactgtggcctcagcttcccaagctcaggtgattctcccacctcagcttccagagtagctggaactacaggcacatgccaccatgcccagctattttgttgtatttttttgtattgatagggtttcttcatgttgctcaggcaggttggtctcgaactccttacctcaagtgatccacccacctcagcctcccaaagtgctgagattacaggtgtgagccaccacatccagcaagagttgggacttctaagaggtgttaggtcatgtgagctttgccctgatgtaagggttaatcctgttatcactggagcaggtttgttataaaagagtgagacgtttggtcccctttcctctctctctcccaatctgtctatctctctcccttttgctttctgccatgtggtgatgcaacaaaaggacccttaacagatgccagcaccttgattttagatttcccagcctccagaactgtgagccaataaatttcagctcatgataaattacctagtctcaagtattctgttagagcagcacaaaatggattaaggcagatatacaccatattgtatccatcactaagtggatactttcaagaaagacagcaagactaaggagcatgaaaaaggactttctcatattctgaattttaaaaatattttatgacatgaatatatttatctattacctatgtaataaaactagacattaagagaaaaatctcatggtagaaatcttaggaaatagagaaaaattagagaaaattaagaaaaagcatgcataatttcacaaaccaatggtagccactgtaaaaaaatgttatttcattctaatacatttctacacacatatgcacacagtgcatttttgaaaacataactgagtcttttctaattgacctcttactctacaaaatttgaaatagccaaaacaaatttttgattcctataaagagatagcactagagctggaagagatggctcatgcctgtaatccctacactttgcatgactgaggccagagaattgcttgaggccaggagtttgagaccagcctgggcaacatagcaggacccatctctacaaaattaataataataataataataataataagctgggcataatggtgtgtgcctattgtccttgctacccagaggctgaggcaggaggactggttgagccctggaagttcaaggctgcagtaagctatgattgcattacactctacccagtgtcaaggaaaggaaaggaaaggaggggagaggaggggagaggagaggagaggagaggagaggagaggagaaggggaatgggcaggggcaggggcaaggcaaggaaaggggcaggggcagaggcaagggaaggggaaagggcactaggacctatgagccaacataggctatggcttccactagtacaacttaaaactcagctgaagacatgacacatagaaaagggttgctgtgtctgtacacacacacgtttcccatgttcccaatcccagtctgtggtcagtgaaagtgaagattgcctcagagcctgcattatctcaagctactgacctaattgctaatgctttactctggtctatttcctgcatgacctcagaatgtgtcagtgtaaattccatagtaagacagtagttgcacattttggagtgtggattctgctttgaaacacaaataagtgtgatgaacgtgaccctggcactctgtagccctcagtttcctcaacgctaaattgatcactacagttccttctagtgtaaacagtcccacgaagaatcgtgctgaatggatgactacataatggcctgctcctagagttcttaaatcaatccttaaaactggctgcaaaatgacttcactcctttaacagtgtgggacttgtctctgttctccagaatgctcaccagatggtgaagaagtatctctctacctaccaacatcgtcatattgcttcttgccactcgctactcaaaaactgtgaaaaacctgtgggagcaagtatcagctgaaaagggtggctttctccttaggcaaaagctacagggcaaaacgggggccccaaacttctatcacgtcaaagacatgaaacagatgatccctagttttgatcttctttgaagtttattaaaaacaagcttgaatctgtaccaatcctgacaggtgtgaatgtaagactcacaaatgagaaatgctaagctttcctaatgttcaatttaatcttatagaccatgaaacatgttataattaaagatctgaactattaatatgaaggagatagcatatattcttaccccaaatatgactaactaggtaaaatcttcaaaatataatcatggcctgattatcagccattgtggaggagaattttaaaaagttcttcattgacatcccaagtttatgttttagacacttctaatcaaacatgaatagattaacttcaagtaaaaattaatagtcacattattgattatcatgattggaaatgtatttgaccagaacaatgaggaaagagcatagagtcctgctatcttcaagtatgaatttacacttttaactgatgtcaagtcatccatagtatgaaaactcatttatttttatttgaaaaatttaaaaccatcaaaatggatagtgtgggagccaaataatatataagcaatattttatgagaactacaaaactattaagagcagtaactagaattcggttactgccgttccttatttcagaagagaaagtcaaatgttttctgatatttaagaagtaataacttcctgttgttcagttatgctttctataattatatatgataagcaacagaaaaataggtctggttttggctgtaatgtgtatattcaattcaatattaatttggactttaaatcattttgctatcaaatattttgaacctcatgaccaggaagtaatcaggtaaaaaaaaaaaagaaaaaaagtgggtttgttacctgacctatctcttaagttcaaactttctataggtatttttctctacctttgtccatatggttatacaattatcactagatgcttgaattactaaatggttttgtatatcttttcctcaaatttatatttgtcctattattggcttagtctctcaaagtattacttttatgatattgctataatggtcctctatagtataaagttgagcccacaccatttatcctgccacttaacaatgtccttaatgtagattatatggtttggccatgccctaaccaaaatctcatcttgaattgtaatccccataatccccatgtgttgcgggagggactgggtgaagataattgaatcatagggcagtttcccccatgctgttctcatgataatgaatgagtttcacaagatctgatggttatataagcttctggaattttccctgctggtgcttactctctcctgctgccctgtaaagaggtgcattctgccatgattataagtttcctgaggtctccccagccatgcagaactgtgagtcaattaaacctcttttctttataaattacccagtctagggtatttcttcacagcagcatgagaatggcctaatacagtagtatatcacacttattaaagagttgatagtaaaatagcactctcagtacaataagaatagaatagttccttttcatggtaatgaatagcttttcttcgacatctataattaacaatgaaatcagaaacaaaaagaagctgtctccactattactgaatgttgctcagaaaattctaacgtaagcaaccaaacaagaaaaccaaatatgctgtacaaatatttttaagagagaaggaaatcattctattttaagataaaaattctgtaactcaaaattcaggagaatcaactgaaaggtataaaaaaggtagaccattatgatttataagaaaggtcaaacattataaagcatgtatccacaacaggtttttttctatataccagttagaaaatagataaatgatcctattcataatagtaataaaacatatcaaatatgtataaataaacaacgaaaaatgtaaaactcttgtataaatattattgcaaaacatcactgaaggacatttttaaaaacttgaagaatatatctagtttcctacatgggaagagtcaatattataaagatatcaagtcttagattaatctatgagttaaatgcagttacttttgccctaaaatgttaaaaggctcttaattatgcaattcgaaatgtgatgtctactttcttcttgaaagcatttttcctggaaccttctgatgactctaacttaggctgcctgctttctaggcctactactacacagttgtcatactgggatttattttcataaacatctgggttggttccaatgctctttgtatcctaggttttctgtataggattcccgttgctttgttttgcttgaatatatcttcgagtaatacttccttttaattaggaagaatctgtaggaggtaaagttgtaaacttgagtccttccatgtttaaatacatctttagtttgtcttaacacttgatagtttgactatcaattttgggttctagttcttcttcctgagaactttgaaaccttgcctagtctgcattcacttctaatcttgctgatgagaagtttgatacctttgaaagatcctttttttttgttctctggaaggattaatttcttatacttagaattccaaaattttcatcagcatgtgtatacacatctagatatgtatccttttttccttgttcggtgttggatgaaacttttcaatctgaggacttgaattactcttcaggtcaaggattttttttctgttattttcccacatcctttcccattcctccacttctaccacattcttcatatcttttttacttttccatcatattttatatccttggctttttgctctatattctaagatatttgcttaattcaatattcaagaatgaatattacttgaattgcattttatccaatctttatatatacatatatattcagtattctgctatttatggaaatcagatcatacttaatggttatattctccccctgaatatctctgaaaatttaatattgacaaatttttcccacacttttcattgtctctgtttcttctggaaagcagaagataaattgtctcaggaaaataaatttgtcctgtttatttattagttcctttttgtttaggctactggtttttttgtttggtttggttttttgtcttttttcaaatgtctggtgatcctttcttgactgggaatatttgtaatttaagaactaggagtttcttaagtagttggcagggatatcataaggagctctgtagtacttataaactgcttataagcaacttaatgcaatttcaatcaaaatcttaatgggtttttttgggggggacttgacaagtagattgtttgtataatttagcacaacgatgtgagaataacccaggaaattctaaaaaataagattaagagggaatatgttctcccagatattaaaatgtatttcttaaaatccataataattataacatggggctttttgtctagaaataggatgtaaagattaaaaaaggaactaaccataaacagtagaagtggcatttcaagccaataaggaaataatagattatgtaatacctaggattctgacaatttagaaaatctaggaaaagaacatcagagccctgaaataaagtaaaataaattccataattattagagatataaatatatgatgtaaaatgattaaatactagaagaaaatattggtgttggaaaagaattgctaaggatttataaaatatatttatatagagactatataaacaatataaacatacaggctacatagggactatttaaacttctatttattaaaatagagtatctgtaaaagtaaaaatagaaatgaataaatggcaaaaaagtgtaaaaaacaaacataaatgaaaagttaatattcttaatctctaaagaacactctaaaatcaataagaggccaggggtggtggctcacacctgtaatcccagcacttcgagaggcagaggcagtcagatcacttgagtccaggagtttgagaccagcctgggcaacaaagtgagacacctgtctcctaaaaaataaataaaaataaaatcaacaagaaaaaacaaatcagcccacgaataaataataaaataataaaaagcaaatatgtataattgccattagacacacaaaacagattttaatattcttgaagctaaattaattcttattaaaacaaaatactatgtgattcatcaaataaagagaacaattaaaatgataaaatatagcaacggaaataatgtagaaatagagactgctgatgaagtatatataaactttctgcagggcaatatgacaataatagcaaaaataaatctttaaaatattgggcaattctttagtttgacaattctaattctagaaatatatagtaagaaaacaacccagccttgctataaagactctacacaaagatattcatcacaatagtgcttataatgtgaaatctggggagagcttcaaatatttaataatagaaaattgcttaagtgtagtatattcatgtaaggaaatgccattaaaatgttatatagagaattgtatttaatggtaagaaaagtgttcatgatgcaatatactgtgaaattttaaaagcagattataaaatattaccttcagtataatctcattgttgttagtaaaactccttctctctctacatacacactctcacacacagagacagaaaaattatctctcaatggcataattattgacagttcgttttctcccccttgcttattattattttgtaatagatatgctatagccactcaataaatatttgttactaatttcaaaaagtatgtattattatatccaggttgttcatggaatttatcatgcaaacaactaccctcttgagagagtcaaaagtggacactataaattatgaattcatataaactatatcaggacaatgggcataaactgagtgtcccaggcacggcaaaatgtgcggataccctggagatgtatcttgactttaagaagtttacaatctttcttggggatagaagattaaaaaacatgaaaccattagaaataatctcccacaattagttttgtaaaagcaagtgcttaattgtacttgacaaacattagatgttactggaggtctaagaagtaagagctgaatactcgtcagaaaagctccctggaggaagtggggactgagtgatacttttagaataggtaagaaaaagaataatgagaacttttcaaatggaggttggggttgtagaaggaaaagaatcaagtattcagaggtagctgataacgatgttgtatatataaaatcaccctgacttttgcaaggggtccgtctatacagaagagtaaaaagtaaacaatctattaacaatgtactatcactgcctccactttacacaggagaaaatcgaggctttagaaggttacataacctgccaagggtcacatagctaaaagtggagagctgagatttgaacctaaggagttggtttcagagtctatgctttccaccctatgctgtactgcccactacagtcaagctctggcttcttgtataaatctgatgtcactctttgtgggactgcttataacatttcctcacccagaatccatacctcctcctttctgctctgtcagagctctttgtctattcacacacagttcaaagaataccttctccatcaaatttttctaacaattccaatcttggaattctctcctaccttggagttgagaacaccactctcctaaatttctgcctacttctcagccactacttctcaatctctttgttggattcttctttctctatatttttgtttttttagtctactcattgcctgtgtgagtaccttcacccccaaaactacaatacctacctaccattgtgctgaaaaccccagcttacattgctcttccacattccataaatttctatctggatgtgcacagacacctcaaacttcatatttccaatactggcatttaccctatctgcagtttttactatcttatggacagcagatgccagaaatctaatcactgaaaccagaaacccatgtacaattcttgagtcctccctctctcaagcctaaaatcctggaagtcaccaagttctgtctattttactctataaataactattagattcttctttcatctgaactcccttagttcaagccctctttgtttctcatatgattattgtagtaggctctgaactggttttcctggtacctgtctttcccctgcctactccaattctacctccacatcaacatttctcaaatttgaggggtcatagacttccaaggacatttccacaatccctgagaagtatacagtttccatatgagaaatcactgtagctaaaagttaaatacttttcttcagttgattatgtatagctaaggcaataattcaagcattagtaaatacaaagccaaaatgcaggcacattacgcagaaaatgcctgttcttgggtttttaaaaaatacgttaaaaaaataaggccagatgtggtgactcccacctgtcatcccagcactttgggaggctgaggtgggatgattgcttgagaccaggagttcgagaccagccaagaaaacatagggagaccttgtctctacaaaaatttttaaaaattagccaggcacagtggtgcgtgcttatagtcccagctacttgggaggctgaggcaggaggatcgtttgagcctgggaggtcaaggctgcaatgagccatgattgccactgctctccagcctgggtgacagagcaagaccctatctcaataaataaataagaccacaaaggaaaaaaattcttacagagaattattgaagtataaattgtgtcaaaattgaagaatataataaaccctaagattaatagtcctgtccttgagaaagatcatcaagtgatgcccccatgctttaaaaaatattccaagctttttagcataatatctaacatttcttagcagttcctaataggttacttctctgtagttacctctctcactccttccccatcacctatagtgccacaatctgtaacctgtttgaggctctctcacacctttcatactgcaatatttgctcgaactattgacccccaaccttactcatctttcctttctaactaactaacttctcctcatcctcaaagccccagctcaagaattttcatttctggaagaatctctgattttcttctcttctctagtcttgaaatggtatgtgtgaacccacagcttgttgtaatgtcattgtcctttctgtttaacaccctcagttgctggtccttgaagtctgggactgtcttaatctactttaaagtcttcaagccaagtacaattcctaggcatgcaatacatgtttgttaaatagatggatgacctttatttatatttatctttcccttttctgctacaattagttaactcattcatttcttcattcactaataaccacttatctgttattttctgggaatacaaaaattcataaaacatcatccttgcctccaaaaaacactttattattgtgccatccttctctctctttctctttctctccttctctaattatctagttgtgtaggtattttcttcaaaggaataacaggtactcagaggaacacttatacactgttgatgggagtgtaaattagttcaaccattgtggaagacagtgtggcaattcctcaaagacctaaaaacagaactagcattcaacccagcaatctcatttctgggtatatgcccaaaggaatataaatcattctattataaagacacatgcatgtgtatgttcattacagcagcattaacaatagcaaagacatagaatcaacctaaatgcccaacagtagtagacaggataaagcaaatgtggtacataaacaccatggaatactatgaagccataaaaaagaatgagatagtgtcctttccaggaacactgatggagctggaggccaatatccttagcaaactaacacaggaactgcatgttctcacttgtaagtgggagctaaatgatgacaactcatggacacatagagggaaacaacagacactgtgacctatcagagggtggagggtgggaggagtgagaggatcaggaaaatcaactaatgggtattaggtgtaatatgtgggtgatgaaataatctgtactacaaaccccatgacacaagtttacctatgtaacaaatctgtacatgtacccctgaacttaaaagttaaaaagaaataaaaaataaacagaatagtagggattcattacaatatcttctctcctcctcataattcttaaacctgtgtagaagttcaatacatatttgtggaatagccttattacgcctttagggaatggagcaatgccttgcctattaatctatacttctatcagagtttcctgctgtatggaaaacctgagtgttacacttcaaacaaatgaggcaatttatacatttttgttgttgttgttgttgttgtttttggcataaatgtgctaagtgagctggagtttcagaagagaaactgaatgttatatgtgaatccaggtcagtagcttggctctgactacaatactgatttcattcaagataaggaaactaattggtatcaattttagttgacattatatgttagttttataatattcaggaatttttgaaggattatttgatttttatttttatagatgttcttgctctttaacactaaataatgaggaaagataatagggctaacatttattaagcatttatgttggacaggcactgctttaagtatttttatatgtatcaactcattgaattttcacaactcttagatctatttgatagctggggaaactgaggcacagagaacctcaagtaacttgcccaaggtaagccagctagttagcatggaccagtgattcaaaaacaggcagtctgtactccttacaactgtattatgctgcctataaaaggaccactagactaataattatgaaaccagatttttaatcttaaattagccatataatagtagagtgcatttaaggatgtcatctgagtttcattgtccttgtaccccttacagcctgtgagaaggaacctttatatagtctttcataaactgtaaagtgttataaattcaaagatttcttataatatgttaaaattacttttaagagttgagaagtccaaataaaagcagagagatgagaggaaacactagcactaaatgttcagacacccactgaccacgtcaagctgcacattttgttgctaaacctaagggagagattagatatgaggagagtgggaagcaagaaggtatgaagtctgggtatttagggactaatagaaatgattttctcgattagtttaagaacattagcaattacttacgggataagcacagttaaaggaatttctggaaggaataaaactataaaaattagtcaaattgttaaaatatcagaactgtgtaaaagcatataaagtttcatcatatctttcttttgaaaaacaaacaaacacttcatgttctagccagttgctaatagtgatcagttgatgaatacacctcatgtttcacgcatataaaattttacaccatgtctagtccataggcattagtgtaggagtcagaatacaacctgaattctgttcgcagctttgtgccttgtcgataaagcagtggacatctctccacagggagatatgtttcctcccgtgatatagaggatgttgattcacttgtctcctctctatttcgaaaagatgctctgaagattagtgagacaatggctgtaaagctctttgcactgtttacaacataaatcatacacagacatactggcatgagaaacgctatcatcatctcttttatacatgagaacaaccataaggaaaacaaacctcagagacagtcctgtattataaaaatgttgggtagagatgccaaaagttgtagggtaggaaacagcaacaacaacaacaagacggaatccaaagaatatttgcattctataatatattctacagagtctcagacgggaccttcgttgagtgctcccaagtattatcagtagccatgttttttttttctttttcttttttttttttttttttttggtaaaagggataaatagtgatgtcaggagatgctgcaaaatatattccagtgataagcatatggcaagcaattaatggatgaattcgcctctcttattgccatgttgtgacaaatactctaacttatttggcctttggctccctaaagggtgctcagaaatgctgtttagaaagtacttttcatgaagagctacaacaacaacaaaaacaaatacaattcaaatatctactaaacatatgaaggagtactcactctcattagtaatcagagaaatgcaatgatcccattatagagccctgtcatttgaaaaaaaagaaagaaaatccaagtgttttttattagaacgtggagcaacaggaattctcattaccttctcaaccactttgtcaaatgctttctgcttatctgctgaagttaaagatatgcatgacccatgaatccactcctaggtatattcccccacaaaaatgtacgcttatgtgcatcaagatacacgcacataagtgttcgaaatatctttattcataatatttccaaactggatatgttcaactgcataaagaaagaagattggacagtaaattgtggttcctttatacaacagaatgctatatatcatgatatatattatgatgtgcaatcctcagctacatacaacattgatgaattttacaactataatattgcacaaaaggagcaaaacacaggagtatctacaagatgagtccatttacataaaatgcaaaacaaactaaattgaactgttgttttggcatgcatacatacgtggtaaatcataaagaaaagtaggaaaagtaaaagtaaagtcaagatagtggtgacctatctggagaggatgaaacaggaaattatagggtctttctgaggggtgatcatagtaggtatttactttagaacaatttgttaaacttaaaatttaaattttacatactttcttaaattttgttatatttcacaatttaaaaatttataaaatgataattttacaaagcctaaaagatgaattatttgggggcttttacttctctttcatctgtacaactgctgatgaaaatcaccaggtgtgtataacatgaagcatctccttaaatgacatgcatttattgggaaaaaacacaaagtccaaatggtaaaatgttagcaaggtaaaacactgaagatttttctccccaaaactgccaaacaagtctggtttaactgaaattgacagcaaagacaacagagcacacttaattgaattttaatctcagtgatctctaagccatgtttgaaacataaacagacatgtcagagttctttatgatgttggacatgaattcattttcataattcaaaggcatactttgcttatgaatctctttaacaagctttggctgaatattcttttcttccagatgtttgctgttgtatacacacagcttccatctctttgcagatgatttaaaacatagttagaaagagtacatttatttaacaaaagagtaagagtacagaattcaaatagatcgtctgtgggtgtatataatgatgagtacataagtctcatgcagtcctcataaagacagcatctattaatctgaagaagtttctcttactaatttgcaaacctaaaagcattttacattactaagatattaataaataggtcaattaatacttttgatagagtagagagactcctaaataatggacatgaaaaatgattttgtaaaagtacggtttcattttaaatccctgcttaagcaatttgtaggaggcaagatagtgtggcagttgagaggatggtctctgaaatcagatctgaatttgaataccacctctaccatttactaacctaaacaagtcatattacttctctgtgtctcaatagctacttcctgaggtgttcttacaaaaacacaaataaataatccatgtaaagaactttgcacagtgcaaatacatagtgagcacgcattgagttttatttatcatcatcatcatcttgctgtacttttgtaaactcaccttctcccgtctttttctactctaaggtgctcttccaagctactttcctcctcagctatcgttcccctggatttccagtaagagagggtgaaatcatgcctgcttatcttctttctcttttactgatacttcactgaagtgaaagtaaaggaataaaaacacaacacacccacccacaaaggcacaaataataaaggaaacaagatcagcaaaggagagatttctactgattttttgaaatcagaaaatagctgaagtgccttagcataatcgaggaaatggttacggagagtaaattccaagagaaagtggactaatgtgttctcccgaatccagaaagacttactgcttggaggcagcagaattaaggaaggcaggagtttagcgaggggctgaaagtgtattaaaattatatggagcctttggatccaaactaactacttcccttacctactggaagcggagtctttcttttttggaggaaatcggctagagagatttgaaactgatgatactaggcactgtagcaaactaggagaggctgcaggttgcgaaataggtgcttatttgaaagcctatagagtttgcaataagaaacccaacttttttatttgtcatgctccccagacattagcagtcagttatatgccccaggcgcaaatctcgcaggcagaaagtggggtaccccctaatcatgaccttggggaaacatttcaaagaacacaccggctttgattgaacaacctatgatgcaacagtgcaaccctacagttgacgagccctatccatgatcacagaacttctgacattgtttcttgccatcattgtcattgttgctttgttttgtgtgtgtgtgcatatgcacctgtatatgtcttgcttttaactaagaatgaacagcctcttaaggaaactctccataatgaagaagagaaactagaagaagcaaacatcaactgaagaaagaaatctacaggaaagagagagacagaggaaaacctcaagaggataataatctgtgaccttagataaaacacacttctgacataagaacatataccattaaaaaggagaggatgaggctgggcatgttggctcatgcctgtaatcccagcactttgggaggctgaggtgggcggatcatgaggtcaagagatcgagatcaccctggccaacatggtgaaaccccatctctactaaaaatacaaaaattagctgggtgtggtggcatgctcctgtagtcccagttactcgggaggctgaggcaggagaattgcttgaacctgggaggcagaggttgcagtgagccaagattatgccactgcactccagcctggtgacagagcaagactccgtctcaaaaaaaaaaaaaaaaaaaaaaaaaaaaaggagagaatgagagtgctaaattatttttaaatcatgaccaaaataaacattttaatagtaaggttggaaaataaaaatgtgtgtgaacaaatcttctagaagaccaaaaaacaaaaagacaaaaaaggaagaaaacaattaagaaattaaaggatatgatctaggagatccaactaagataatgagaattcaaggaagaaagaacagagaaaatagagggcataaaattatcaatgaataagagcaaacatttcagaactgaaggactcatatctctggagtgaaaaggtctattgcgtgcccagggcaatggataaaaatgcagaccaagacaattgatcatgaaatgtgggaacttcagtaaagaaaagaaggtcacaaaaatttctacacagaaaaagatcaggatttcaccaatagaaaatactggagtgatgcctacaaaatgttcaaaaaaatacatttttaacatagaatccaattgcagttaatccatgcctgagacaaaaaaaggtttaaacaaagggctgcctctgaatagtatatagaaaagatttctgaacagaaaatcttaaaaactagcttttatccccaacttggatactaaatatagagacaggcaagaattaggggtcttcttgtcattcttctgagactctggagctcctgagacttctttttcactaacaccattgaatccgggaatcaacaagctgcacaaagttataaagattgccagacttcatgtttctggaaaaaaaaaagtactattttttcatacagctgagacctctgaaaagatggctcaatgggcaagatgccatgagaaatcaaagccaaatactcattctgaagtcagttttgctcagactttgtatactgccactcaatttttcaagtcatcagaaacataactaagaatgagtgactttttgctatcaactaatgacccaccattcaacgatcttgtatgacaaagtagaggagtatcttcttatttttaggcttattaaattacaatggaaaatattcattaacaatctcataatgaggcattctagatgcttattcttacctaaagggaatggaacaaaaaataaccaaaaactaaaaagatgaagacaaaagcctttcttggtattatagtattcttttacaaaggatatggtttatcatagtaattgattccctctgttacactagagatactattatattaaatgcctaaaggttaaacttaggtaacagtggagctatagttctttcagaaataaaataattaaatagctatgtatgccaagaaaccttactttgaacatttctattgtaccatctcattattgctggctgcctgattagcaagcagtaaacttgggtaatagctttcctctgatatcacttcaagtctactcgagttctagaattacccagactaccaggactttacttgcacaatatgctgaaatgtttataacattatgctttcccctcctaattctcaagaccattttgataactggctaagactggataatatcaacaaatatgaaataattataagaatcattctttcttaaaataagaagagtttccagaaacagaaactaaaacagaattcaggctaagctgctaaataggctatctcagggattctcagctcattcttgatgaggatagattgctttttatttcccttaagtgttccgtatttatttcacaaatattacttaactgtgtaccatgtacaaagccgtgtgctagttaagctggttactgtggaagaaataaagggagtgggagcatctagcttttttcttcaaaggagatgggggaatctgtgggagttagtggtaggggcacctacagaggaaatagctgaaaaggaggagctggggaagatgaggatgaggaactaagttgtgaataaaggaagggcagagcaatggtttttttaataatattggaatgggatttgtttttagcactgctcccctttcccttaacagtccccttgagctacaaataaatgtaactggcaaagtggataataagacttcagaatcttctagctaaccatgatcaatgtgtcatggagcccagtatacaaggagaggttctatttcatcaagaaatatgactgcacttttagtgggcaattggttgttatgaaggtccagcatttatttcttcttccttttgaaaaataacaccctgatttcctttggggaacatccccatggtcagatgggaccactgtgattgactgattggttcaggagaggggctatacccttaattatgtgggagctactagaaagagatgctctctttttttgttggacataaaaaacctggaaaggtatggcactagattgcagacattggtctgtctcatgtggatagagcagagaatgaagccaaaaatggagagttcttctgatatcaggcatcagggagaaaacaaaacaaaaaacaaacaaaagaataaaaatggagagttcagatacaggacccatagacagagaaactaaatcctcatgaagtgttctaattgaaacagtatctatggtctacctaaacctcatgggaaccacattaaatggcggataaagccattaatatactatacatagaagagatacatccacaaggacatcttaccaagtgtggacacaagtgtgtaacaaccacttattggtgtataatattataatccacaacatcagattttactctttaaattcactagggagtattctcaaaggaatggaagaaacaaagctggctatcagtgaggggcattatgtgggtaaatataagtagaaacttcaaaataaatttcttaaaagcaattttcactttctgaaagtttatatggaattggcaaatgacaaggattgtgatcattgatacatgcaagtcaacaagcaaaactaaccaaagagacaaacagacacatgaataatgaggcagttctgatgaccaaaaaacacaactttacaagactgtttgggtaatttattttgactggtaatacatcatgtcagtttattttatttaagccacagcaacgtttgtcttcctgacgatagttattgcattccagagaagtacaatacgaagtttcagactagtgctgggcttagtcacacagagaactgcagtaggttttctaagcccctgctcactgtatttcacaaaaatctcatcccttctaccctccactctctaaacacacatccaagcaaatcacaccaaggcataatcattgaagaacaccataacttgccaattaaaatttggcaaacagaaacattgaagcaaaactgaaaaaagaatcatgtaattaacttagaagaaagcttttttcttaaatattatttttcttcccattcagcatgcacaagaagcaaactttgagcactaacgtgttcctttttagcctttgcctgtttgtttcaaagacaagaggagaagagtctgcttaaaagccaaatacactgataaatgtttactgataaaatcttccagatgggactactttcaaggaaggtcaattacaagccttgtgtctctccttttaatgatatcctttaatgatccccttcctctcctagaaaattaagtcacaaaaacatcttaggctgagagtgacccagtaatcctcataatcacattgcaatgacagacaagaagatcaaagtacaggtgcagtgagaaatagggttttacatcctattataaaatgtgaacttgccattaaccaaagatcaaatgtacctttaactcccaaattcccaacttccaatattttttaaattctgtggttttctggattaataaactttctctaatataatattccccctcccaatttttgtactaaacattggtggttttttcttcacatatggtgattatgttttcatatatccaataactaaataattttagaaatttggtaaattgtgttgaaactctaatagcactaagaagttcccaagctagttggtaagctattgtctccaatactgcaaagagaaaacctagcaatggaaattacataaagataatctgatgctaatatgttagttagaaagtgaattaggcatctagtaatggcttcaataagaaagaggtttatttttatctcatattaagaaaatgtagcctgggcatgttggctcatgcctttaatcccagcactttgggaagccaaggcaagaggatcacttgagtacatgagtttgagaccagcctgggtaacatagtgagacctcatctctacaaaaaattaaaaaaaaaaaaattgctgggtatggtggcatgcacctgtggttccagctactcgtgaggctgaagtgggagaattgcttgagtgcaggaggctaaggctgcagtaagccctgatcacaccactacactccagcctgggtgacagagaaagactcaaaaaaaaaaaaaaaaaaaagaggaaaggaaaaagaaaagtaaagaaaataatctagaaacaggtcaaggttggaatggtgacaccatgtttatcagggacctaggttcctattatctttctgatccaccatccgtaacacatggcttccattctcaattctgccatttaggttacaagatggctactgatgctccagccagcaccagcaccaaatcactactacacaaacgggaggaggagtaaaagtgagtgcttctaggcaggagctccctctgctaacatgtagttggctgcatcaatctcttagaaagcctgagaaatgcaatcttttgactaggcagatgtcacccaatataattaagattcagtcagtcatctttattatattggttactaaatgaacaaatctgtaaggatattcagtcagcaccagcagtctttgtcacaccatagaatttctcaatcctggatggaatttggtctaatcccttacttacagaaagggaaatggagagcagaaagattaagaaatttcccccaaaggacacaactggttagccaaagaactaggtgcagaattcagatccttgatctatcagtaaagatccggttctttactggagcaaacttcagtgaggtcagcccaggaaattcagctaaccaacatgaacaaataacacatcttactacctgggtcagaccctgtgactcacacttcaggctttacagtcataactgctcatatgctgtaacatccaccctctttggttataaagtgagaatcaccatattcaccacaagtcatgtacatgtttacatggccactaaataaccaacaaaatgagagatgcgccgcaaaatgtgacagtacgagttactgtttgtaaaagagcagaatgttccacactcatgggtaaaaattggtacttgaacttcatgagtgactctagatcttttatggtggtggctttttaaatacagacaaacacatgattatggtatctcctgaaactgacattctcaaaataacatccactattatacaaaggaagtttgaatgttttgaggcttttttgcttttaagccattgctcttacctcttatctcttcttcgattatggccatcacttacttcctcagactccacccagctgcattctcaacaaaccacagtccaggatgagaacttctataatgcatatgcttccttcagcactttgagatacattattaggccctgctctcatgttttacttcttttatgttccaagcttcttgagggcagggccaatactttctttattttccataacacccctcatatgaaaaagattctagcattctttcacaatgtcatgcttagaacattccaatatttttccaacctatctcccaaactgcttcccatggttccactgattctcttctttcacccctactcacaacacagggtacccgagtgattgctccaaaatacagaacacagcaagccacatttctacatctttggcggtgcgccactgtctataaactttttaataaggtcgccctaacttgctttctcacatagtcttattccttgccatttcctctgtttgcgccctacatactgtaagttactccgaaacattcatctttttctacatgcctgtgactttgtacatgtagttccctttgtctgaaatgccctttcttctttcgtttatggagattccaaatggtctccaaggtatatgtcaattattatccatgaaaggttttgctatatatatccagtattttctgggggatggggaagcttaaacaaaaaaaacttgaacattactctacacacagtccattatgacatcttagtctatttggaaaactccactcgtgtagaaattgtgtttatttcagttgactgtgaatacaggttctgatgcacaggagctactcaatagtttgctgaatgaatgaatgtcagttttcctaaacagacttgaatgattttcttgagagtctaactgcttgtcatactacatcttgtctcatttgattctagatccacagaagctagcacagtacttagatgtaaaaattgttatatctcttttgtttttccagttaatcactggagaccagggctgccctttcaataggaaatctaatatctctctttttgaaaactacccctctttcaaataacccaagaacctcagggattattcagtctaaagcagagtcgtgcttctaaacttcaggtgtagagaggacggcaattggtatgaaggcttctgccactgccatgtggtatcacagtgaacaatggtcctgtccagacctgtgtccttgctggtttgggtctccatgcccagccttggactccaagagtttggctctttgatttaactcatttagtaaagatcagccctcactcaacaatctaagatgctcttcttgagcaggcagcttaggtttccccttcctctacacagatacattaatccctctagggcccgccgtatcagcattctctcccgacaatacaccatgggactgccctttttcatccattctcatgggtttcctcagtacttctaattgtgggacaaagtgagaaagtctcttttctcctggtagactcctgaattcttaggtagtttggtccacgctatcctcaaactgtaccaagaggaggggtagcttttaataagaagggggaaattttgtcacactctttctccaaagaaaaagatgacaggccttatgtttatatagctaagggaatccacttaatgatttttccaaaaataataaatacaaaaacccctagcaggttttccaatagtagagttagaagtggacagtcagatagaatttctgcctctccagtcaccctcttacataggcatggtaatatttattgaaattcactataaaggcaaaactggatgaggacaattgagaaactcttgtcctaaatatcttttcctgactggccaaggaaacagtgagtctaataatcaacttttttttttttttaagtgcatagccctaccagtccaataagacaaaaaagattcattccaaaggaaagatctggcatttcagggtcacatttaagtaggagaggatgcatacaataataagatatttcaattagacgacaaagtcagccataggacacagtaccagtagtgtcttttccactaagaattggggaagggaggcttaaaattcaccttatgtttgtttaacaaacataccagggaatccttccttcaactgtgcccatcgagttgagctacacacatacaacataatccaggggagactgccccaaactgaggctttatttactaatttgcagtacctctgaaactgttaattttttccctacttttttttttttttttttttttgagacagacttttgctcttgttgcccaggctggagtgcaatggtatgatctcggcttaccacaacctccgcctcttgggttcaagcgattctcctgcctcagcctcccaagtagctgggattacaggcatgtgccactactcctggctaattttttatttttagtagagatggggtttctccatgttggtcaggctggtctcaaactcccgacctcaggtgatctgcacgcctcggcctcccaaagtgctggggttacaggcatgagccatcgcgcctggcccctacatttttaatgcctctaaaatccagacatgtttttataatcaatggcaccttggacttgatgaaataaagtaatcaaatagttttaataaatcaaatacctttaaaaatataaacaatttaaaaattgttctaagacccaggttccaacctcaggatctggatatgaccataatgctatattagcatattaaagcagagacacagacaatagcggtaacccttcaaaggggaaaaagcctgtcagctgaagatgatagaggaacccagtgcttctcaaagggggttccccatccagcagttcatcagcatcagcatcacttgggaacttataagaaggaaaattctcaggacccaccccagaagtactgaatcagaatttgtggggcatagggctctgtaatctgtgttttaacaagggcatgggtttgagaaccactcatatggtagctaaataaagaagacacttggtcagtatatacttggcatgcctggggagggggagcataacacttaacagccgaatgttaagactaccataaaaggaggaagaatctcaaaacccaatgcaggaaagccctttaaagtctacagttcctagtttctgactccatatatgtcaaagcagcttctaattagaagtttgtttctcaaggggctgaactacaaggacagaatgaactgatctggccaatatggtatcctgtctacttgtcaatatatttctcactgtgaattccctaattcatgttcttgctcttgcataaagttcatgagttctgagtgtcagtgacagcacctgatctaattgggttctgagaaaatcaattctgaacctgaaaaactaaaggtcagtctttgaaatttgtatatattacaaagacccagtccaaaagggcccagaacatacctaatactcatttaaatggagtatttaccaggtcaagagaagtgaagaattaagggcaattaggtcaagattgcaaactggcaatcctcaggccagatctggtccacagatgtgacttgtttggcccacacacgttgttcaaaaatgggaagtttcgcattaaatattggatttcttccagtcttaaaaaagcaaaaaaaaaaaagatttgacaatagggagcccacatcctggcacttgagcactagcctggagctaggcagaagctgtctcctttaaacaggttgtagcttccaggtcaccccagtcccaggaatctttattgacttctggctggcaagcttctccctttatgtgaatatgatctgcctgacccctggtttgagacgagtttgaagacctttgagctacataatcatttttcatggaacagatcattagactgatttgaataaaatgaattgctcagaaaattagctttattttgtacctttagagctatttgtatgtgtgagcagggatgtagaggttagttacttttgaaaacagacagtgatgaaggcaaatgttgccaggcagagtataaagagaaccagcctgggctgtctagacttggatctgccacttactaaatgtaaaactatcccacagccgtggtttgcatatccactaatgggaatgataatatctactatacacagggtttatagtgataatcgaattagataatatatgttcgagactatatagaacctcaaaaatgttagctgaattaaattttgatggttttgttttctgaattttactttagaaattgttcctaacagattacaaacttttgaaaaaacaatcaaaattaaacctcaatagtcttacattgtgatcaaataatggaattaacatttattgactgtaaactatgaaccagatagtatgctgggtgctttaaatacattgtctcatggaacccataaagaattactgagttagtattatctatcttttacacattaaaatccaaggctagaaaagtttaggtaatttaccaaagtcacacagtaagcgttggataaccaaggtccatcttactccaaagcccttacatgtgtgattactgtagtgtttctcaaactaacatgattatacgaatcgcaggctagtagttaaaagcgtaagctctcctatttatttccaagcttactgaaccagaatctaaagggatacatagccttgaaatgtgccacattttaccacagccccatgtaattcacaacagcggcaaggaaactgcttaagaaagctgataagaatcaaagtaagtagaaaaagaattactttgcgttttattcaatagaagaaaggaaagaaagggggaactaggaagaaaaggagggaaggggagggaggaaagaaggaacaaaggaaagagggaaggagagaggaaaagaaagaaaggagggagggaaggagacaggcagaaaatgtcctggagctaaggcctatggcatttgaaggatgatgtgaatgcacttactagatggatgctttctttctaactgcacccagcctgtttactgcaaacataaggaatcagccaacaggaagctcagcttgccactgcagaggagtaaagcactttgaactacaggcattttgtacacccaaattacatactgtgatacacatagtatttgagctgttccgcaagacagaagccaattattcttggcacgtacttctgtcgtgctatccaaatcaccatccctcacatgtggaactgtgccacatcaaacgcaccaagtcacaaattccttaaactctttgagatgaaagtcaaattttggagaaaaaggatagtctggtatatacaccatatagccaaaaagatgtgtgcttaacttagaactgctgggtctattatgagaaaccggggcagcaaaattctgccttaggaacttttcagagttttgtaaactgaatttttccaatgtaattcagtattatcattgccttttctaatcttagttatttcatttatagtattcatcttaaaataattttccagcctctccctttaaatgtttttaagcacagtggaaaaacatagacactaaaacaaggagtagaggttgtaggtaccatcaaattctattgagaatcacagaaactatgcataagtcctgaatggtagcattatttgataatcagatcagttagttaacccactccccttaccccttacaaatcctgaggttaaaggatttaatcaaaactgtcagatgatatgaaaatagaaatcaaatgataattgttaatagtattataaagaatttaaaacataaatcctgcaagattaaaaagcagaaagtggggtattagatgcaccagctttgtgcttcttaagctttaaatatgctgtggaaactcctagaaatcttgttaaattgcagattctgatttagttccaagattctgatttctaacaagcaccgatgtgactggcccaggggtcagactcagtagcgagtgggtcaatttaagaaggcttgcattggtgaagttctagagatgtgatagagaatctccccataggagggagtgtgacctaacactagtaatacctagaaataaaatgtaaagatgaaagacagatggaagtgttcgtgtaagtgtccagttgctccagaagaaattggttacctatgaaatagaaatataatcttagttttaatgtgagaagaattctaagaaagtaaacagatttacaactaatatataattgggtttctcaaacttaagactctgatgaggatactggatcatccacccagaaaaatacagataatgtacatgcacatactgcacacacaattctttacacagtttcaggaagttcactgagcttcctttggaaaggtgtgaactacctaagggctcatatcacaatttaagactaccaatgcacatgtgtagctggtatagaggaacaacttgtagttttaagactaattgatagagagggcagattagaatctgcttatgtgtttgactgatgatgttattgcacaaaggcttatgatttctcagtcacttctgtaaaatataaactggttgaaatgtatatttttccaaggtaagacattaagtatcttcatattaggtaggaaaaaaaccaccatgttaggccgggcgtggtgactcatgcttgtaatcccagcactttgggaggccgaggcagttggatcatgaggtcaggagttcaagaccagcctgaccaacatggtgaaaccctgcctctgctaaaaatgcaaaatcagccgggcgtggtggcgcatgactgtaatcccagctactcaggaggctgaggaaggagaatcgcttgaacccgggaggcggagtttgcggtgagctgagatcgcgccattgcactccagcctggggtacaagaatgaaactccatctcaaaaacaacaacaaccaaaaaacaccacaccattttacaaagttaaatatatactactttggaaaaaacacaagacaaaaatccaggtttgaaaatgactgcacagtacaggggtttctgaagatgtaaagggcaattgttgttttatgctggtagcatacatcagctttttttctccaatagttttgaatatcccaccacctgcctttttaaactagtgagaaattataattatttagagctgtcatttaaaagtcatagaaaaccagttaatgttttttgaaaaaaacagttattgatcacccaatcttagataagcaacttaaaatctaaaagcaagctacatctgtgtgtgtgtgtgcttgtgtgtgtgtgtaaagttatatgtcaagacataatatgaaatatagacataatgctatgagagtgctgagggcatttttctttttcttttttcttttttttgtttgagctggagtcttgctctgtcatccaggctggagtgcagtggcacgatcttggctcgcaacatccgcctcccaggtgcaagtgattctcctgcctcagcctgccaagtaactaagattacaggcattcaccaccatgtctggctaatttttgcatttttagtagagacggggtttcatcatgttggccaggctggtctcgaactcccaaccttcagtgatctgcctgtctcagcctcccaaagtgctgggattacaggcatgagccactgcacctggcaggagtgattatttccaggatgagataatagagatgtatgaaggaaatcactgagttagctctgagctggattcaggatgagtaggatttcagtagaaggagaagtagaggggaggcatttcatataaaggaactcccaaaagcaaaacattatagagggtaagagtggagggaggaatatgctgtttggtctaagaagagaatgatatttcatcatacttgtaatattactacttgtgtaggctcttcttgactcggtttgctttaaccaacagaacacaaaaaattggccacatgccagttctgggcttaaacattaagaaagcctggcttttgtgttcttggcagccctgagttgccagggaagaaattctgactaccttgctggagagttcacatgaggaatccacatggagagagagaaaagccatgagactacatgaagaaagaaagaaagcaggtcatctcagctaagcccagcctccagtctactggagtgactgcagccatattggggaccatgggtaagaccagcaggactgcccggctgagcccagcacagactgcaaaatagaatggttgtgtttcaagacatcactttctggaatagtttgtttgcagcaatagaaaactgaaactgagtgtttatcaacattttaaatcactactgccttttgataaatacaaaatgcgtaaacccaactggagattcagatgtagcactgtccttctacactcactagtcaagacttattttgaattttattattttgtatcctaatcctaaattttgtttaggatacaaaactctaggtttcttctttttacaaataaaaactattataaaagtaaataaccatcaaaaaccattccctgaatcacctcttctattgctcctccttaacagtagcactttagatggattagtgtacatgtgtatgtgcacacatgtgtgtatgtgtgtgcatgtgtgcatggtaatatttggtcatagggaagattaagaaaaggattagggctaaaaggctgaacatagggtgatatcttcggttttagagggaacctaggacagtgtttctcaaaattcttaccttaaaaaatattggccaggtgcggtggctcacgcccgtagtcccagcattttgagaggccaaggcgggccgatcacttgaggtcaggagttctagaccagcctggccaacatggcaaaaccccatctctactaaaaatacaacaacgacaaaaaattagccaggcatggtggcaggtgcctgtaatctcagctactcgggagtctgaggcaggagaatcacttgaaccagggaggcagaggttgcagtagtgagtggagatcgcaccactgcactccagcctgggtgacagagtgagattccttctcaaaaaaaaaaaagaaagaaattaaaaaaaacaaattcataggaactcaatgtgtgtgtgtgtgtgtgtgtgtgtgtgtgtgtgtgtgtgtgtgtgtggtgtaggcctgcctatccatactgaaacagatttataaaagttattccctatgcgtgatacattctcatctttttctactctattccagttctttttttcttactgatagttgtgacccactatatcagtttcataatgcacatagaagttgaggcactcagatgaaaaacactatctaaaggggcattaatcattaaaaaaaattcgttaaatcctgtatgtgccatacattgttctagtcccttggataaaccagtgataaaacaaacacagttccttctttcatggacaaaatagtcattaaacagcaaccacaacaaaacatgcacaaagtatgatttgattacattcataataaatgctgagaaagaaaagtatgggtgctataagaagctctgataaggagacttcactgaatctggagcatttaagtggatcttttcatggatgccaagttaaggaaagcccaaagtaatagaggtcaatctttagaacatttctgatctgccaagggctagcagaggacaattgcaggaggtcgctgaataagccaagtggggtggaagctgggctgacactccgcccaatcctaaagctggctttaggggctggtgcatgctgtagcctattgggcccagctcatattaatcctttccaacaatttttggcttgtgggatctagagaggagaggtcaaggagcaagagtgaagtatcccccttagagtccagaagtaagagaagtaaaattatttaccatctttcaggggcaaattatgagatccatctagagttatgaaaaactgtgtccaagagactcccaggctggacgctgacagtaattacttgaaggtgttaacatatttggaaaaagaaagttcccattagaatgagggtggttggcaagtaaatcaaagacaaaggagacttgccttgtgctgcccatggagagagggagcgcctgtatgagcctcgagagtgtgcccatcctcctgtgatgatctccctactgctcacatgcatgtcctaggccctcaaaactatgaccactgagccttctgatcatatgtaaatctgtctattctaaatccatgttatgtactatttagcattctaaacctacccataagagggagaatgcgtatgttggcaaggccaaaacactttgtagcttttaaggaatcagctgatactctggctttaaggctcttgtgagcttttgagagtttgaatcagcttactcagaggctgtgacaagatcacctttctgagactgcttggttgaggacagattctggaatatagttaattctccagggaaaacactactctgtaaggacctgtctgggtaaccaactgtctttccctaggcgatacccctagtaactcctaacctccaactacacaccattttaaatttaaaatttctacaaggtagcagctccagcatgtacacagcacacagctaactgttgatgaacactgcctaggcattgtttcaagcactatgtagattatcttatttaatccttataccaagggaggtgctatcggtattcctattttaccattatgaaaactgaggttagttgagcaccgtggctcatgcctgtaatcccagcattttgggaggctgaagcaggtggatcacttgagcctaggagtttgagactagcctaagtgtcatggcgagacccgatctttacaaaagatacaaaaattagccaggcatggtggtgcatgcctgtagtcccagctacttgagaggcagaggtgggaagatcgcttgagtccaggaggcagaggctgcagtgagctgagatggtgccactacaccccagactgggcatcagagctagacccagtctcaaaaaagaaaagaaaagaaaactgaggttaggaagcacaaggtctcacagctagtaaatggcagggctgggattcagggcagcctgattccagactgcaacctttaaccaatttatgacattgctcctgtcaatgcctccacacccaggaggatttgaactatgtcaaaaagtccatttgttcctaaactgtggcttgcaaagctacttttctttaaagggagggagggaacaaatgacctctatccatatgctgtgataatctatacacttttcttggtgtctcatagaacttcaatgttttctcccttgggatattcaatgcttcatgcaaactagtgagaagtggctcgttctctaccccaaatcccaccttttcttcttctggcttttctgtggtctcactggggatagttcctgcagattttcaacttgtttcaatttgcctccttccaagctatgactatgcaagcatgatcctggaattgcagaatggtcaacaaaatgctggcttattctctggggaaattctacagttttctagggagatcatagaaagctatttaggatcccactttccaataggctcttgaggttatgattgttccctggatgctttctattgtgcaactgccctaatgtacaactggccatttatacaaattcagtttataactaagacattgttttgagaaaaaaaaagccatactttctttcttttaaaatactgataaagtgtgggatgtttgaatgtgttctccacctgcatttttctattctaaatcccaaggggaatgagacagagaccaaagccacagctttccaagaccacaaagcttgaggtctttgatgttccttatcttctgagtgaaactttcaattatttggcaaagaaaacaaggctcttaatgggaaaccaaagaagccaaatcatctgtgtaacagaactgagtacatcgataattcatttattcaagaatgtactgagcaacctagcatggctgaggcactgttgtgtatatatatctgtatcagtgaacaaaataggcgaagattgttccacatggtagtttccagtctagtacaggagagagataataaacaatagatatagtaaattatgtgttagaaggatagacatgctatgaaacaagcactcatacatacaatagagcagacattgggaatggtattaatgtgcgatgcatttaaaaaatgggatggtcatggatggcctaatggagatgaaacacaagcaaagacttaaagcaatggaattggccctaagataccgggggaaagagcacttcatgcagcaccaaggtcttaaaatggaagtgtgactgatgtgcttgaagatcagcaaggaggctaatgggctggagctgagtgaatgagagaaagaagagttaaaaagaagaccagagatgaaacaggggtcaaattgggctacacgttgtgggccacaataatcacttttaactctgagggaaatgggagccattgcaaggttatgagcagaggaatgacatgatttgcactgactgctgtcttttgaatagactgttatgcagcaagaggagatgcagggtctcctattagacagccactgcaatcatccaagccagagaagatggtggcttgcaataggatggtaaccatggagatggtgacaaggatgctgggctctgggtatattttgagagcagaggcttcaggagttctaatgtattagatacgagatgttctaaaaagagtagacacagggatattctcaagctttggcctgagcaactgagatgaagaatttatggttagagcacattgtgtgggaggcagttggggaaatctataattcaaccctccctcccttccttcctctcttctttctacccttcccttccttttttctttttctcttcctttttctttcttttttttttttttgagacagagtttcgctcttgttgcccaggctggagtgcagtggcgcgatctcagctcaccacaacctctgcctcccagatttaagcgattctcctgcctcagcctcctgagtagctgggattacaggcatgcaccaccacgcatggctaatttttgtatttttagtagcgatggggtttctccatgttggtcaggctggtctcaaactcccaacctcaggtgatccaaccgccttggcctcccaaagtgtctacccttcccttcttccctccttgttctcttccttccaccttccctcacttccttctttccttccttgcatgcacacctgcaaatgccagacattatacccagtgatacaacagatacaaggcatcttcactagcaagccaaatatgaatgataaaataggggtacagaagtagaattgatggtaggggacctactatattctattattcctttcttaaaaatttagattctgatatgagatttgaataattcacatttctgaaccataactctgaaaatacatcaacatttgcacattgattcttcttcaaaaatcatgttaaacctaaacttaggattccattattaaattgatggtatgttttttgcctactctgttatcaaaaacacatcaacaaatcaaaataatcaccgacatgaatgaaacattcattactacatcttagaaattgtgtcttttttgtttctctagacactatctatcaaaatttctgaaaacttagctaactaactgcactatttattggttttattctaagaaacataaagcgaagtggtacactctggtagaaaggatgccctagggtacaacaaaaggcagataagcattgtgttaggtgaccaatcttggaaacagactgccaaaggtggactcctggctctgtttcttactacttgtgtgaccctggcctagtatttcactcctccgggcctcagtttccacaactatgaaataagaacaataatgtatccaatctcacagatttgtggtgaggattatgcaaagtccttaaagagtgtggcacatagtaagctgtccataaatggcattacatattgagatattgagtgtaactaggccactgttactgctactaccatacactagaaaattctctcctccctttccaagagctaatttttatcactgatattatatacccttttgggggtcattttcaatagtcatttcttaagaaaaaagcaacaagagaaataaagttgcaaagatgatgtaaatgtttaacattattagttaaataactgctagaacatgagcaactacaaaaataattttgaagtatactttgatgcagaaaaattttttttttgttaaatgggaaaaatgtgttatagcagtaagtcaccaaatatgatccctttaaatatatacaagtatacaaacatttggaaggatttaaagtatatattaatggtggcaatccttacatggataaatttatagagttttgatgcttttatgacgtatttttattttattttctgaacatgatagctgggtagtgtcaccaactgagatatataaggaggcacaaatttagaggaaaagctaaatttggttttggatatgaagaattttataaacccatgggatactcagttgggaatttccaataaatattggggttccaagctttgcagaagaggttaagatggatttctatataaatttaggggctttcagcaaacaggtggtaattaaaataagaatgcacaagtcagtcttggaagacacacagagtgaggaaagcaggaatggagaatgggatcctgggaaccccaggtcaaaggaagggtggggggaaaggaaaagaaagagtgtacgacctcatgcaaagatggaaaggtttttgagagggatacactggcaattgacttagagaaacttgatgagaaatgaactgaaaaatatctacttggtttggcaattgggagagcagaggaactacagcagtagttgcaacagagtggtggggctgcaagctaacttcaagggggtagaggaataagtggggggaaaagaaaaagaaaatgataagtgtaaactttctagaagtttgggtgcgaaaatcaatagagatatgtggtaataactgatggaagatacaggatcaaagaggaagggaattttttccttaggaacttcaaccagttttgaaggagatgcagccatcaaagagtaggtcaaagaaagagggagaaggggcgatagatggagcaatgtccaggaggagacattgaaggggatggggattaaatttgggggtagtcttacttttaagtgcactaaacagaaatcttaccataatatagaagagcaatacagattgagcaaaatataattttgtattttttgatgatttggggtcatcagtttgaacaccaaaaattatactcagttgtccagacaggatgcgctcagtgtttccaaagatgggttgagcttattgcccctttcaaaaaggccccaaatagctatgtctgtggttttcaaatgattttgtagattttctttttctgttgttgttttcaggccatcagctgacatttggctaatatcagttgtgactttccctgaaatctcctacccagcctttcttaatttgcttcatccaattatagaaggtttagaaccacatgaccaagcttgtatgaatcatcactaaaatatgaacatacatttctctggctaatgacctacattatcttcagtgagtgaacattgtgaacatctattttgagtgcttagagacctcctttgcttccttccttatgctgatctatgttctagaagaaaggggacactattagggttgcaggctaagttcttaatagttaggatgtatattgttattaataattgaggtataatagatatcatgcttatcaacacataatgtacatatagagaaaaggttaatggaccactctgagcttacttatcaaagtctactgctcttccacaaaacctacatggtttgttgaacaatttcttcagtcttctgcaagccataatctatgattacataaataattaataatagttttaaaataactttgcaatgattttggttgtttagatccccaacaatgtaaatctcacaatcttctggcagatttataattattaatggaaaacacatttcttatctcagtcgatgaattagcgtttgctgtagtcctaataaatatatatagtaaatataatatacagccaaaaaatgtgtaaacgtacaggaaataaaatgggaatctttgtccaaattcattagcaacctgttttcagcatatatagtactgaaccacattataatgttttttgagcacatatattcaagaaattaaaattgtataaagcatacaattccccattatataatcagagtaaacaagaaggaatgatttccaggaagctcatcccttggattgttttctatgtatatgctacatgtaatttatattgtatgacgatgatacaaacgaattttttttgccttctgaccctgatttcccaaactttcacagctcagacctgcagagacaggttttaaaaacaacatttggcaagaacatgtgcaaacgtgatcaatgagcatcgaggtacacgtatattttactacctttcctttcttactcagagtgcttttaaaaatcagcataactgcaataaaaagaacccacaactgccctattattgaattacaaagcaatgtgtgtcggaaacacccctcagcattttaagagggtcaaaaggaagatgctctgcacgtactccacggctgcaggaattctggtgaaaggagataccaacccagagctgtttaaatgatgacgctgcagccaggcaagaagtagagaaagtgactggaaagctggattgcaggcagaacaaggaatggtgggggtggtgacaaagtggactgcgaaaggacagaaatgacagcaggaatgagaaggatttcagatgtgctactatgatagacgtcccattccaagtctccatgtttcaagcaagtttttaaaaagtttcaagaaagatgactttctgcaagatgagaggttgctttaggcacctaatttcaaataactaacaacagctggtaattattcaatacaatcattagcaacaataacagcaagactaaataccaataaaaatactttatagtacacagtggctccatgtgccagttccttcatcttaatttctctacgtttagccactaatttctttggcttcacagtggctttacccaacatcccaggatacaatttctcaccacagaagttacaaatttccaagattactgctgaattgaattactctcacttacatgaggcaggtctcttattctattctggggtctcactgctatcaataattcaactttttataaaaacaaaatcttccttaaaaattgcttttgtcaaaacattgctatgaccatctgtttttaaaaaccattaatggctgtctactaactttaatgtaacaaaatgtattagtttgacagaccaaggctttcatggcctaaattttacctggaccctccactacagacggccacacttgtcacacacatacatgatccaatatttgtgcatcacggtgggagtgtttgttcctttttatttacatttcttatctataagtcccaactcaagccttacttccccctggagcatttcctggctaagctggctctcaactctctcttcttctttgtagtacttatatgactttttggttctattatttgacattgagaactgcagaatcgctgttgcaggaatatgctggaactggatcttgttaagtgttaaagattcaagaattctgcaaaagaactgttgaaccagtggtagcttggaaccagccatgggaggagtatttgcaccatggccatagacaaacactgcagatcaggtttttaactttttttttttttttgtgaggggtggtgggatggtgagaaaaggaggaaggagaactggcttgctagcataccacacaatagattgtcaaattcttcttactacatttaaaatattttgtcaactctctactatagctttccagtataaattcaaatgcttccgggactaagtaattcatgacctctcaaggagttaaattccaacatggacatgtatctatgtacacacattaaagtgtaggctccataatagctagctattttgtattcttcatggtgcccggcacagtgtgtggtaaaaagagatccttctacctttctagcctcagtttccagggcttacattgccctttaacttctggccttattgaaccttggaattgtttcttgaacgtatcaggtatgtcttaccttggtaactttccaaaggccacttacttgccatggctggcccaggctgactgaatccctcctgccactgagtgaccctgtggctttaacaggcctttcaacacgttgtattttaattgtctatcaattcaaccacctctctgctatacaataagctgcttaagtgttattttttccacctgcgtatctcatggctgaggtccccagcatatagaaggtactccaataaatatttattcatagtgaatagagcaattcaaacaaattaatttatataaggtaggtctgctctagcacttttccacaatattgattactcaaaaaaaataggcctcatggactttatgacactgttgcaactacacagcaaccatcgaacataaatttcaaagaggagagagtttatttacaattctatgagcactttaagttttgctttcttcccaggcactgagggagtatccctgaggttgttctcctctctttgtgtttagatgtctgtacttgctggtatgcctctgtcctctttctgccctgcttccacaccaatggcagacgcaccacaattcaagtgaaacctggtttatccccaagaagtcttcacagttgttctgttggtctctgcttaataccacacaaataaaacttaggccagaggacttgggagagtgaatgaatgaaacaaggaagaatggaggaaaaaatataaaagtaaagtaaggcatgagagaattgtataaagtggggtggggaggatacaatttaaactgtttttaagaaaagatataaaagtaaagtgaggcatgagagaattgtataaactggcgtggagaagatgaaattaaaaaaagcttctgagaaccaaatgaggttgtaatactccaaaattcttaattcaaatgttcttcctgcctcctttaaggttcaaaagatagctggcgtgaccatattcacgaaagtgaatttctctttaaattgccaaaatcttattatcattattattactattatttttggtttacagatccaggaatctttctaatgatggagaagcaaaataagaataaaatgcattttataaaaatcctaattttaaataccaagagagaagaggaaatttatgctctctatatattgtataggggctaccagcatatggcctctgtccacagaagtacatttatctgggaaattgaaataattatttagtgagctcaggcaaaagtaagttctaacaccagagcagaggacatagcctaatttcatgaaagctgatttattattgtttataaaacaccaaattgtcattacattttctaccctacgtataacttgtgtttttccagtggtgctaatatgacaaaggaaataatggaagactatcataaagaaagcttaaaatatggtgacttttacatcagtaacactatttttcaatcattgagtcctgctgtgcatcttgacattagctcttcaatcatactccaaatggagtaaaaattatcagtagaggaaacattctatgatccatttcaattccactacctttcccactgttcatattcagagaaatggatatgaagtgctagagacaagagcagaacaaattaaaattctgctttttctgtgtgtcattgctttttgagatggggtcttgttctgctgcataggccagtgtgcagtggtgggatcatggctcattgtaacctcaaactcctgggctcaagggatcctccaggctcagcctcccaagtagttgggactgcagacatgcactactctgcttggctaatttttttattcttagtagagtctgttccccaggctggtctcaaactcctggccttaagtgatcctcctacatcggcctcccgaagcaccaggattacaggtgtgagccaccaagctcaatcaaaagtcctacctataaactaaagttccacagagactgatggttaaaaatgcaaattgaaatcaaatcagcaacactctaaaatctgaaaagattcattatttctccaccagaacactttttataaacaagctgaaggttactttaattttgttcaaggttgtgtcctacctttctttgatctatcccacagcatatagtcaagtggtagccccatgacgtgcacttcactaagaggaggtcagagttatccattcattcattgattaaatacatatgaatcaagtctatgtgtcaggcactttgagtatcaacaattccaaaatcaacaagacacaatgtaagctctcaagaacatcacagtttatggtagccaagaccatttttaaaaaaattgataaacatctactctgatgtacttagtgcccaattctttctccctttctctttaaaaaaaaaaattattgtactgctcaaagcaatctacagattcaatgcaatccctatcaaaaccaatgtcatttttcacagaaataaaaaaaaacttaaaatttctatggaaccaaaaaaaaagcacaactaaccaaagcaatcctgagcaaaaagaacaaagctgaatatatcacactacctgacttcaagatatgttacaacgctatagtaacaaaagcaacatggtataaaaacagacacatagaccaatggaataatacagagagcctggaaacaaatccacatttttacagagtggactgatagatttagagtagacagagagcataatgatagatacatttgattttctataaaggcaccaagaatatacattagggaaaggagatctcttcaataaatgatgctggaaaaactggacacccataagcagaagaatgaaagtagacccctatctctcaccatacaaaaatcaactcaagatggattaaagacttaaacataaaactgctagaagaaaacacagaagaaacacttcaggacattggtctaggcaaagattttatggctaaaacctcaaaagcacaggccacacgaccaaaaatagataaatggggctgtattgaactaaaaatttctgtatagcacagcaaagcaaacaatcaagagagtgaagagacaatctattaaatgggagaaaatatttgcaaactactcatctgacaagggaataatattcagaatatattaggaactcaaacgtctcaatagtaaaaaagcacacaatcccattaaaagtggacaaaggacataaataggcatttctcaaaagaagacatacaaatgtccaatatgaaaaaatgctcaacatcactaataatcaaggaaatgcaaattgataccacaatgagatatcatcttaccccagttagagggctattattaaaaatgcaaaaaataataaaaaataaaaaaaaaataacagatgctggctaggatgcagagaaaagggaactcttacatatcaccagtgggaatgtaaattagtacagccactatgaaaaccagcatggagatttctcaaaaaactaaaaatagaactaaccactatgtccggcaatctcactactgggtatttatccaaaggaaaagaaattggtgtatcaaagagatacctacatccccaagtttattgcagcactatacagaatagcaaagatggagaatcaacctaagggtccctcaacagatgaatggataaagaaaatgtggtatacggccaggcacagtggcttatgcctgcaatcccagcacttttggaggccgagacgggcggatcacgtggtcaggagatccagaccagcctggccaatatggtgaaaccccatctcttcttaaaatacaaaaattagccgggcatggtggcactcgcctgtagtcccagctacttgggaggctgaggcagaagaattgcttgaacccgggaggcggaggttgcagtgagctgagatggcaccattgcactccagcctggatgacagagcaagactctatctcaaaaaaaaaaaaaaaaaaaaaaaaagcaagaaagaaaggaagaaagaaagaaaacatggtatacacaatggaatatgattcagccataaaaaagaataaaatcgtcatttacagcaacatggatggaactggagatctttatgttaagtgaaataaactgggcacagaaagataaatatcacatgttctcacatatgcaggggctaaaaaacttgaactcatgaaggtagaccgatagataccagagcctgggaggagtgtgtaggtgggaggggaggggatgaagagattgattaatgggtgcaaacacacagatagaataagctctaatgttccatagcagattaggtgactagagttaacaacaggtattgcatatttcaaaatagctagaaagaggacacacaggcatgataaatacttgaggtgatggataccgtaaataccccgattccatcattatacatattgtgtatgtaacaaaacatcacatgaaccccataaatatatacagtaattatgcaccaacaaagataatttactgaagtgaaattcatatcacataaacttaaaaatagtaaagtcaagaattcagtggcatttagcacatttacaatgttgtgcaaccaccacctctatctagttccaaacattttcaacattccaaagtaaaaccccttacctattaagaagttcttttctcaagaccacttttaacttcaatgtatgggaagccttcatttcgaaacaggttttgaaaaaaattctatgcccacaatcacttaacttaaatattagaattgagactaatggagtcaaagagtcctgtaacatcagacacagcctcttagggtttttaaaatggcattctgcattctctgttttttttgtttttttttttctttggttttggttttttcagtctgtcaattttccagattcctatctcccaaagccggtagatgtctcctttgatccagtagctaaggcatggttgaactgatcatatttataccgaatttccaaagatcaatcaacgagaattctcgggtctatgtgcttgtttatttagccctgcctctatgcctgaacttcatctggaagtcacacatagtcttctttctgtcttcagccatgagcaatagtgtatttgcactaaaaacgtttccatggcatcttcttctttatttaattttctatcagcagacccttctttgatacttcctttttctgcccattctggtaattcagttgactaaaacacaaaactcttcccaggtaatctttgtttccctttcataatctgccgtttatacatctacttaattcataattttgctaaacatctccaattatttgttcctacattgttatcttgccatcaaaatattgattttaatacctgtgacccctccagtccatttaaaatattaattaccaagtttcctgccttggatattggagttcttaatactaacatcaaaccaaatgttttatcctcatttctaaagctctactccattgcagacaccgtgacatctaacacttagcagatagaaaaaaagtatgccattgtaaatctgaaaacttctgggcttgcatgtcagagactggaagtggtttgtttgaaaggagcttatactgaggcagcatagcataacacagtggttaaaagcaagtctgtgaaagtgagaaagactggggtccaaatcttggctctaacacttctaagctacgtgactctgggcaagttgcttaaattccctgagcaccagctttctcatctgtatgatgtaaaaaaaagagcagcactgtttagtaaacatggtcttggctttataccacttcctaatatttctacaactgtcaagtcaatcaacatgttaccttagaaactgtggaaaaggtataacctttggaaaatgtaatcaggggggaacaacttttcctagcccaagtccagcttctggttctgccctgacaggtatctgtaagttataatgttttactaggtcttcatttccttacttataaactgagggaggttgagtgaggagttctatttgtttgcattttggctctgcaattcaggggttttatttgacacgtgaggaccaaggagtagaaaggagcaatcaagtgcagtggtttggtcaagatcacataaaaagtcttgctgtaaaaccaggagctagtcctaaactgctcaccagcaagcttgatttatactcgagtagaccatattctcttgctcctccagctgcagctccactcctcatttatcttagcccaggctgactctaagctgctttcacttctacctcactgcatttcgccctgataattttgtagcttacctagcctccctctttgagatcccttcttaaaagggtcattctattaacctacccatatcagttactttactactgctgatctatcgctacctgtcaattcatgggaattacagggtgcactgggacaagagtaaaatgatccaacaaacataatgttgcatttaaaaaaataagctaaaagatactgatgactttttataactacaacatattcgtttgtgaataagaacatatatagtaaaaagatgaaaatgtgaacaggttgactatttcctaaatttatggcagaggttgttctggagaggatggaagaaaaatgaggctggcagtgatggtggggaaatgcaacctccaaaattatctatctatatatttttattaaaaacacccacagtaattatggcaaatgttaatgtttgtttgttctaggttttggatacatttaagatctcttgctttctgggtacatttcttttcttttcttttctttttttttcaaattaattccaaaagacttatatctgctacatgaagaacgaagcaagttcagctctcttgctgaaatgttcaaatgctgaggcaaggcctgtactacaaatttgtgtaaccaaaaccacagtgctctcaatgctcctagtgttgcattacagcagttagaagagattgagctattttgtttccatggctcattaagctagagttagactggtgtccataatcaaatttactgcacttacccttgcttcttccctatgaagtacagccagaccttagggaaaatctcaactattccaggtccatggtaatttggtccacgaaagaaattaacacacctgaaaaggattaaattatttttccttttcaaaatgatcctcttccttaagcttcctctgtcaattgactgccaaccttatttgctaattcccatccctcatcgggcttcctagcacttcctgctgcaaattagtgtgcagtgaacctgagcctgctctccaaaacacatccagactcttggggctttctgggcttccgctagggtgcctggtgcaaagggggcctaaatcaatcaattaaggcctgggaagattccaggcaagaggaagggatatcttgggggacaaaaggaatgtgtaggtgggaagaagggagaaagtctttcttcgtttttcactgcaggaaatgatctggacagagagcaattcgaatcatagacagggagggttgggcaggatgcgatgggggagcgaatgacagacacaagtgacaggaacaacttagggagacaggtcagaaaacatctaatctaggcacatagcagaaatagtgaagggaattgaaacagttgttctgtattttgttcacagtgttaaagtcaaagtcagtgctttttaacctcatgggatggagcgggggagggggcacaaggagccttgtgtgaaggctctggctctgcttattgatcccccaaatacaataatacatcctcacaatcataaatttgagagcaaggggctctgatcctgtgatatacaatctaggcccttattggatcctggaactgattttcagaatcctttattcttttaagtacaattgtaaaaaaaaaaaaagagagagagagagagagagagaaagcaaggaagaaaggaaaaaaggaagggaagaaggaaggaaggaaaaaaggaagaaaggaaagaagggttccatttataaacctcagacaaaacaaaaatgaaagcaaaagagaacaaaaaatagccaatacgacccaagttacaaatttacttgtatcctttcagaggataacccaaattcctgcaagacaattagccatctttctttcgattattacagtaagcaagacgggttaagagtatatagtaaatgtgctttgctaaactccttctccctttattgactctatcacaagaagcacacttaatataatttttacaattttttaaagaacaaataggaaagaggagaaggttgtactttagctacctttgtgtatttgaaaggaatgctgttcagggcttcttccttttcaaaaagaaacaggtctttgaaaacgaagaatcattactgtgcatatctctcgagggctgctcctctagtatcagtccatttgaaataggagtttcacataattcaatttattaaacccacatttcctgccagattttgctttatgtgcctatgtccttttgtttcccggctaacatttccacatctcggaaatcattctttctagtataactgaagaatatggatattaaaatcagatcagcaaaagatttttatggacttggaaagctgcccattaatgccgtaaaataaagcgtgttatacagctgatatcatcagttctactctatgttgttttcatattcctggcggtgggtggagagttagagtggaacaattaggagtgggaaagagaatgaaaggattcgatcaattgtggaatttcaaagcggagacaatttacactaaagaattcaaagacttcgtaacctccaagacattttccagtccaggtaaccgttgaattatagctggaggtgatgttcttggagctgcctgtgaaagctgaaatcacaacatgcctgcagtgttcccttcctaaaccaactttgccattttctcaggcagacacacaaacatgcaagcgtccacagtaatgtgcgtgtgtgagggatgggggaagagtgattgttgctttgtagtagctcctttgaagtgtttaattcctcccttgtaatctcttcatcaacacacatttaaagcatatcagttttacctcagcaatttgattctcagaggcttatgtggctcagggcctctgtccagcacctgggtggcacagtttgttttatgtgcatgcagaagtgttaacagaattaatttttttccttctttctctctttcttcttcccccacctcccccaatttaggttaatgagcccaggcagcagtgtgtgtgagtgagcgggcgtgtgcacaggagggccgtgagcctgcctttttaaaatacaggaaacgcatagaagaaagaagagttcagctggagccacgacttccctctttgcttctttccctccccacccccccaccccccacctcaccccccacactccagcaccggcttttaattttcaaaagcactgcaattgcttggtgtggtttcaagagctggggtgccattctccctgatgatgactctgctgacgtcaatggcattcttatcatgcctagtgcgacatcagaaaccagtcctcagaggctcctcttattcacagtgcctgggctctcagcaaaatgtggaccggattctgaaacgcaaaggactccccgttcctaatcagcgctgcaatccaccagacagtctccttctgccggcagcttgccagttaagactttgttccttagcgttctgtcctgcaaggaccccctgaaggagaagagagggctaagtggatcacagcgtgtcctccgtgtctgagctttcagagccgtgtgtgtgtgtgtgtgtgtgtgtgtgtgtgtgtgtgtccctcaaccaaggttagagactagtcaatgctgcttctgattattcttcaggttttactaaaaggcttcagtctttgatataaggctattcccccgacacagtggctaagaccctcttgtgtaagtgctcctagctcactctctggatcagaaccagcgcccaggtccccacgtgaagcccatattcaccccagatggcagcatgcacctcctctcctttttttaataaagaaaaagaaataggaggttgggaggagaaggaaaataatcatagctgaataataatagcagaataggaaaatagtatcactaagaattaaatatttcactctaaatactcatgacttgttaagaggtctgctctcaaaagctgaattcacaagggagttaatacatactaaacccagtatgcattcctacctagcagtttgggggcaattattatggggatgatgaactttctccatttacagtggagtgtattatggtccaaatctaccctaaagcatttgggaaatgtctacagttcaaattaagatgtttagagtcaaggtcatttcgcttgatgatggaatgatacatgtctagttagatttcatctgaccaatctttgacacaaacacatcagaattgtcttggtatccaccaaccaaataatgtttgtttctcttgaagattgctgagtgacccatagtaagcttattaggagattaggagcaactgttccagagagaagctgtttaacaacatatgaaatgtgcaacataattccatctagaactatttagaatcataacatggaagaacagcagcttacacctggttcaacccttctacctttaagtgaggaaactgatgcccaaaggctgcgtcatgctttactcaaggtcatccacctattaagaggcaggactgacaaactaaagctgtctctctctaaatggtatgcttttcctactacaacacatagctcctgattattcaaaacctaatgaccaaacctcaaacccacttgccaagggagtttccatttttcttttaaatctgagcaatatttcttaattttttgattaaagtgatatttcaggaatgtttagatgaattataatgagtttctcctttgttttcagtgagtttcacaactagtgtaaaggttattaagtagaatggaacaaaataatatatgttggaatgcatgaaattcagatggttttgttctttgttattttttgtagagacagcatctccctatgttgcccaggctggtctcaaactcctgggctcaagtaatcctcctgccttgcctcccaaagtgctgagattacagatgtaagccactgagcccagcaaagacgtgtttttaaaaagtgatgatgggctctgggaagaaggagcaaagatttatctgggttccaaatgtatgagctccctgagcccagccatcattctgcttcatctactacatagctctcaccatggtttgtaacattgcttgctaatatattttatttgccacctaattcaagccattaagttaatattcgattatataaatatgatctttatagttactttttccctatccccaatagttttgccttctcttcagaggactgtaactgcttctataaatcaccttttgctactctctttttggtagacgtgcatcacattctggtcgcgaatggtgaggagatggggcagatgctggttttagagtcagacaaacctgtgttggaaacctggcttaaccacttgctactatataatttcaagacataacttctctgagcctcagtttccttatctataaaatatgaccctaccttgcagggttattgaaagggttagagatgatgtttactaaagtcctatcacaatgcctagcacataggagaaactcaatcaaggataattttattaatgatttttaaaaaataaatggggaaaatcataaaattaataaagattagtaagattgaacaaaggacatatagtatttccccccttataaccagagctgttcctcagtaccactaaaattggaaggacaatatttctttaaagaatttttctagtgaaaagctaagccaaatatatgatcattggcctgcattatgaatgcatgtttcactgagtatctgattataattggatgtcaaatagctacaaaacctaattgtggtctcaaaaattgtctcttctccctgagacaaacatccaatatttcctaggtgataactaagctttgtgtacactgagataagacgccaaatcaattccttaaacttaaaggcacaaaggtttcggaaagcctcattgtccatttgagagacaagccacggcatctcgtaaagcacattttcactgtatactatgttactacaaaattgagttaatttcattaataacaaaatttatcaaaataaaaatgctttctcctttgcaggaatccataaataacataaaataataatagcattttaactcagaagcaaattacagccatgactgtttaagttggctaacccaaatttcgtaagtgaaactggagtggtctgcgtaagtcctagattgcatatgattcagggaaacccagatgtcaaaagggtgtgtgaatcaaaagaaggtattcatcttggtgatttagccctgaaccaatcaattcttcccagagcactggagaaaaagttcttgtttctaatggaatcatcctgcccttacctacctagtaaaaattttgtacccaatcaataccttagtcaactttaaattcctgaatagcccttctgcctcattcaagtgaatggaaagaaaaggtttaatcatatttaaatactccagactattgagtaaagttaaatgcaaatttggtcatgttattcccttctttaaaaccatccattcattagtgatgatccattcacctaactatgccctcagcaggcagggctgttagcctgaggaaggggtgcccttttctatttcatccagctagaagatggccctttggaatctatctgctcaatgatattgtatttctagaatataaaaaagatgccttaaatatacaaaaggcacagggggagtcctttttaggtctcagtttaaggctgatttctgagttggttatatgctctcacagcaatttgtatgttgccttcatggtgcttaaggcagttcaatcatacattttgtttttctttcccctactagagtataaggtagaaattgtgactatatttttcactttcgtatccccaactccatcccagtgcctagtacacaagtaccaggtactttattgactgatacacaagtactagtgaattaaaaaattgttatataaagttgggttgttgtcttgtccaatagtagctgtgtttcgcactgcaagtcatttttgagagcatatgaaataactctatgtcctcatgaatgactttatcataatcattcctgaacagcacgggcgtgtggtattccaaaagggagttttactggcccttggttaaatttaaagaaataataaggccaatttaaaacacacacacacacacacacacacacacacacacacacacacacacacattaatgagagatttctaagccccccatgggagatgactgccctttttgtccttgttttgcatattaaaagtatatagaatgtggaaaataaatgtcataatatgaaatcatggttccagtatatgttagtgtgttctgttgaaaatagttttgtttggcaaaaatgaagagttggtaattgtatgttgggcctcacagttttttgttttgaaattccaaagtctgggaaccattgacttagcagggttttcccatcagaacacagatttgagggtttttaaggatacatgtcttagtttctagtcgcgtatggctccaacctacaatccttccttctttcgggtcccacctttattttttacttttctgatagttcccacaactttgcccacaaagttgccaattcctaaatattattatcaaagtgcaattttgtataccccaaagctaatatataattaattttactataagagaaatcagttaaaatgtaaaaagtttaataatatacattataataatggccctggtacactcccccaccgttctttggaataagcaaaggtataacccttgaaagtaaaattaacttttctttgcacatattagacttctcaatggtgtgccaaagagtggagatgacaggtgagccaagctattgatttcccttggctcttgtcgctagtgggtgggagactgaacacaagccacatcctttatttactgcagttttcgtagaaatatagttatcagcgtatgtcatgaaggaacaaatgtggggaagtactgacctaaataacttttacgtgattcagtatacatgtaaattgaaataaagaatattaaatctcaaaactatccagaggaccttattcaatggtataatatttcaaatttaattttttattacagtatattttcaggtacagttttaaaaatggggagcatgcaattaacgaatacataaaaataacactagtttaatcttccctttaagaaaagttcctgtttgctattcctgttacatatacaggcataggacttcatggcctttaagacatgttgataatattaacatttccacttgattgtgggaagtagcattcattttcagctttgcttagagcttattaacctgatgtcaacaagatatactagaaatgtccttgtcagtccaaacccacaagtagaaatgatcatgttgttgaatgtgttcagtctgatttgacaacggtaacaagtcaacactgttctgctaaaggaaggtcaatcatcccattgcaccagggatttctttatttcttttgctaacattagcattatgaccagtgtatgtcaaagaatacattgggataaaaaattctgcttgtccatttctgtttttccattctcttatgacttagagaattgaaaaattaatctcaatttttttctgtctgtaaatatacaatatatatatacacacactcttacacaaaatctctgaaaatgctgtcacatgcatgaaacacaaaatgaaaaaggtagagattttttcataaacatgaaacagaaaaaactttcctcctcactacaattcatagctaggattcatgattttctagtaagagtagcaaaatggatgccgattctatggcatagaagaccaatggctttagacctggattcaaattttaactctgccacttcctagcttggtgaagataagcaagttaagtcttagttttctcatttgtaaattggagtccatagagtcgtgaggatttcacaaggtaatttatttgaagcatttggcacaacacctggtacaaattaggaactcaagcaacagaagacacagcattaaaatacagtgcactacatcaggacattacaaaagcttaatttaataaatctcttgtctgattcattctaattctgctagtatactgtagaaaagtacactaggtcctgtttgtggcctccccaggtcagctctgcccaccctaccccttgggcataagccactctcccagtttcccaggcatgccacagcagccccagtaaagcagcggttatcactgcaattgcctcatgttttccacctccccatccttgcgggcttagcgtgggcaatggcctctgacttgacaggaaccatccagctacacgtgagatggacaaaggctctgtattccccagggactctgggagggccaagggtaccatggagcaaactttgaccaatgagagacaaaagacctatgcacagaaaaattgctcaccctttcttctccatgtggaatgttttacgacacagcctcacaggcaatgtcccttgtaacttagcaactagttttgttgttgttgttgttgttgttgttgttgggaagctctgacaagcttagtaatgcattaccttgtacatggtttctcttcttccctactgctgttcctttcaccccctcaactccacttttgctttcttgggattgcatgactcacctccctcataaagctagcatgtaagctgtccctagggaatttgatcaaaaactgtgagatttagaaaaaaagatgaggcaactagatacagtacaagaatgaaagagaaaaagtcataatatttgacatcaatttacttatctatgattccttggattctctcagtagtggaagctcttaagaccacattaccaccttattaacaaagaataactgataaaatcaacgggacaatgggcctttgagaacaaaccatcattaattttgttccacagagtccaatttcaattataacctaagatatgtttggaaccacttaatgctattttatgagagagagacagttttctctttgaaaagtcatgttcctttgaatttaactaaaacgtaacaggatgttaaaacgaaaccctggcatttttctttccttcagaaatatgcccacattttatagagaaagctatatattgaggttctgcaaacaacaaaatgcaattttcacattaaacatggattctaacatctggcatttctcctagtgcttgcacataattatccaaaattgcagtttttccaacaggggacccacagtggtagctctgattcattccacattatatatatgaccctttctcatagtgagggtggtcttcaacaccaatgctcctgactgctatcttccttcaacttacatggaatacttttcctcatggctccaaatgtatgagctctaggttgttattcagggttctttcatcctcattttttgtaccttttatgactactttctgaaaaggcacatttgctgagttggcgcctcacaggtggtttggtttgtggcatattttaatagctatgaaaccatgagttcagctattgggttgcaatgagttacataatgcatgtgcaattcagtgcgcaccaacaagaagattttcctaagaccccaaatgacccaggaaacggacacattgaaggggttgcacctcaccaaatgtccctgacaaggatgcacttatttggaaggatgtgcccttactctgaaggctggtggtctgaggagagtagatgtggtaatcatccaactacattaaggcacatttatttctgttgctttttggttcattttattttgatttggtttgttttctgttcttagcaatcagtccattttatgagtactttggcaagtagtagcaaaagctgttttctctaggaaatttttaacctttcaaacacagcagagatgttagggacattataaattcaattaaatgtggtccctgtttctggggttgatggtcataaccatttttctttttcttaccactccagtttaatttacttggaatgaaaaaagtaaatctgagcttctgaggattatcagttgagattctgggcctttaaacacaatcctctctggtctggacttatttgcaacccagcacttccagaaatgcccatcattagctcaggaggatgaactccaaataatccacgttctatttatctcattattctctatatttatgtattcattcaatacgtatatctcccatacgccagcactatgcagatgatagggacatcattttgaacaaaacagaaaaaccactgcctgaagatactgggccatgaaattctgttcaaagatatgttttggcattcattttgcaaatctctacatagcatgaggaggaatgaaaagaataaattatatccttcacttattcatgcattcgttgtccatttatttaaaaaacatttattgagaatctattttgtgataggtactgcaccgaatgccaggaaaaacaagcataaaagatacagggtgtccagaaaccatctgaaaggatgaatttgactactcaaatattttaaaagactaaatgataaaaaaaaaaaaccctaaacaaattaaaattttttgaaaagtttacacaaatgaggagagttcattttcttaatatactcaaaacattaacatatccataaaaaataaactcctcaagataattgattcaatgagtctttggaggtaggagggaactggcccataaatgtatgaaaggtgactaattttctttgcaattaaattagatggggaaaatatgttttttgtgaatctcagggtcagtgtgtatagaaatacaagcatttcttgtgatgatggtgggattgtaacttaatatattctttttagaagacagcttggcaatatttatgaaaattttaaattcagtttcacagctaagactttattcaatgggtaaactcacaaagatgttcaggcacaaggatgcctgcagtgttatttgtattaattgtagtaaaaactggaaatgacccacaagactatcaatagagttaaatgggtttttagacataacataatgcaatactatgtgtcaaataagaatgatcattatctctagatcatgatctgtataagtccatacaaaagggccccaagatacactattaaattacaaagagcttggtgcagaatagtatttgtaatactctcttggaggatatgcaagaaactattaacactttactcccgacagtcatgaccaagcaattagagttgccccaggtaacatctatttgctatcctgctctgtcacataacatttactgtaagtagagctctctctgagaaatgtgctggtccaagctctttgaatatttgtatacagttaaaatcacgaagaactgaagatcactgcaattttcaaaggaatgaggactttaaaaggacagcagcagcaagggaaaggtagggtgaccaacttgtcctaatttgtccaagacttccccagttttagcactgaatgccccacatcccaggaaatccctcagtgccaggcaaactggaacagctgatcaccctcacctgccttggggctgctgcagaggcctaagcatgaaccgtagacacaagagaaactgagaaactttctttctgcccccatcctggcttccctgtacctctgcccagatgccaaagagtcctcctcactttcccacagccacaactcccgacttcccttgcacctctgtcctttggtacaaagatttctacgtttgcgttagtgatgtgacctcttggattaggatttccaaaactagaaatgtttttggagtttatgtagggttttacaggagaaaagaagctattgtgaaagaactgtgagggaaggaattggatataggaacaaaagttattttgggggctagaaatcataaatctaaatgggttttcaaggcaaagaaaaacttcatggtatagataggaaaggatacagtattattcattagaaaaatggaaatggtatctatgaaattaatttagatttaaacaagaatattttaagagggaaagtttcttttttttttttttttcttgagatggagtctcgctctgtcgcccaggctggagtgcagtggcgagatctcagctcgctgcaagctccgcctcccgggttcacgccattctcctgcctcagcctccctagtagctgggactacaggcgcccgccaccacgcgtggctaattttttgtatttttagtagagacagggtttcaccgtattaaccaggatggtctggatctcctgacttcttgatctgcctgcctcggcctcccaaagtgctgggattacaggcgtaagccaccacgcccagccttaagggggaaactttcaagagagaaaaacgccaaccctgagggaatatgggattaaaaaatgtatcagtaatttatatgcttctgacactttctatgtgactcagaatactctgctgggaatagctaatggcagaaaatttcaattattcccagttgcaggtgctgtgttgtgaaaggcacaatagcccctagcaaccctaacgaggttaaaggaacagtccctgaggaatctcactgttagtatccatggcaagagaaaagctaaacactggggatacatattacttcacttttgtccctgaaattgggcaaagtttcagatttgagaatggcatcagaagtatagctgtttagtgcatgtgtttctcatcatagtattgatattcatttcacatatattcccacagtaaccatttactgaaggaaagccaaagccattttagcttgattacattttctttttttggtttgttttttttagacggaatctcgctgtgttgcccaggctggagtgcagtggcacgagctcagctcactgcaacctctgcctcctgggctcaagtgattctcctgcctcagcctcctgagtagctgggactacaggtgcatgccaccacacctggctatttttgtattttgagtagagatggggtttcaccatattagtcaggctagtctcgaactcctgaccttgtgatccacccgcctcccaagattacattgtctaagacttcctacagaaagacaacttcatttgatattattcacaagccatctagtctcttgccttcaacatttttggccatgtagtgggtgggtgtgctcctttttgcactgatagatcagcagccatgccacttttctaaaaccatatttattttgccccctgtatcatccattcagtcatttaaccaatatttgctaggaaatgagtgagccattttagcttgattacattttctggggtttcatagatgactaagatgtagcgtccactctcaggagttaaggatacattaaggaagacagataaaaccaactaatattatgacattgtaggatgaaagaggtgtgtgaaagatttatgaaagtatagaggaggaatgcttaaattcgggagaaattcaggaatagctatctcaaggggcaagtaggtaccctgcagtttctataaaaggtgaaggtagggaagacttacagggagactgaacaatatacgcaaaagttacagaggtgtgggagagcttggcttgatcaggaaactatacactgcaggctagaatcaatgagtgctttggaaggaaggggatgcacatgggagaaaggaacctagaaaggtaagtcgcagacaatgagggaaaggcaaaagacaggacatttacatttactgagcttttattttgtgccaggctttttatgtttggtatctcacacaattactccagtaacttcctgacaatgtttgttactccattatgcagatgaggaaacagaagatggggaaggttatacctgggctgacccattttttgaggccaggtgtatctaataccaaagaccctggtcattttaccgcagaacattgtttctagaaggaagtttaaactttaccctgaaggcattgcagactctgatggacatcaacaggagagaggtatgatcataattggattttattttgagacagggtctcactgtcgcctaggctggagtgcagtggagcaatcacggctcactgcagtctcaacctcccaggctctgcctcccaagtagctgggactactggaacctactgccatgccaatttttttattttttttatttttatttttggtagagatggggttttgccatgttgtccaggctggtctcaaactcctgggctcaagcaatctgcccatctcagcctcccaaaatactaggattacaggtgtgagctattgcacctggacttaactccattttagaaaaaaactaaaaaactaaaaaaactaaaaaactgtcgtgtggaggaggaggaactgagaaactgggggcttttcctaggatgacagagaaacattttcctgcaacaaacttcaatgtctaccatcacatacatacaagtctaagtttcataggccttgatgttgtcattcttgcatttatgcctagaaacatgtaagtctgagatgtaaattgcagaactaaagatgatggattccagaaactctgatccacctaagagaggagtaggattgtggaaggcacataagggtaaaatagtatcacatttctaaacttgaaaaactcaattcaaatatgtgcagattcagtcccatatgaacagccatgttggctagaggacatcatacttctcaagggcaacagagatgctgggagcagattaagtagttataacttgcacctgtgtaattactatagcgagtcacacttctgtcaaatgatcctattgctttaaaagtttgagatgatgcctggtctaagagctttctttagctgcatgtctcaatgtggctataaatttcagtcaagtcatgtcctgcacattgggtctaattaaagaacacaagagtgagaagggcagggtatacactcagggatggtggagttagtttatttcttggatggaaaatttaacggtcattataatgcctctttgggttggaaatacagattcttatgtacacattcattttgcacaaatgaaaatggtaaaccaaaatcagagagtgttgaagttcttaaactaaagactaccttatagtgagctctagtaaagaaggttagaaacaatttttaagaaaatttaataacaatatttcagagaaaaatttgttactgaatattttccagaaatagtaacaagacatctgtattcaagtagatacaagtgattgtaccagagggtcaatattttgagatggcaagcacacattcttatcataaagatatggtacaggaactagaagagatgtaatattccttgacgtgattctgtcataaaaggttaacaatgttacatcttagggccaaggagacaatcctttgaaggttgcaaaggactggctagagtcaggaatcatcagcgtattcctttaaagataaaaattatatatatgcatacaagtgctacttttaaaatcaggaatgatcttctatttttaggggccaaagagaagagttaaaaactataaatggatatttgacttatgtggcagaagaaaagttcagaggtttcaggatctgcaggtgagaagaaaatgtaaactaaatggcaatctgttcagtgattttaaaattcctaacaaaatgcatttcctacaaatgttgctacctgaaaagtaacaattagacatccatttatttgtacttacataataaaaatatttcagagtaatgtataccactgtctaagtctttctgttctttatctgtagccaaacctacttgcccaaattagttgtactaagagttttcaggctgtttacaactgaaaccatcttacaaagtattttaggccacatttgttttgttgatgaggccaagagaagtgaaatagtttttccaggggcatgcagtctgttattaacaaagttaagactatggacaatttcaggatcttgttccttggtgttttggaggttctgaggaagttggtgaaaggcttctcctggaaagtaaatgtggttaagagccaaccaggtgaggctccaggcctactgcctcacttcacctaaagcagatgggctgtgttacagagacttatagaccgggctttttttgaagactatttatttgaaacatctcttctgtcaaatgaatttttaaatgctaaatgaaattttttaaattttaaatgagtggcccacgctaatgtattaggcatgtgaaagggacgatgttgtggacatcggcaggcagcctacatgttcctgaaggtcagacccgtaacccattcatcttggaattttcctcacttggtgccttttaaaaggggatttaaaggcaatagggtctggaggttcttgcagttatagcttcaggggctcccttctgatcttgcacagttttctaattattcccttgttttcttccactgacccatgggatgtggttaacttgtgtcttctaaggccagctgtgactttttccttacccacgttacttccaagttgggaacacaatcttgcaacctggccccaccctgttgtctctgcacaagcctgaaaactcaggtaaatgaatgaatgaatgaatattaggctgataataactacagggaaaaagataagaggtaagaaaaataacagtgatgaaattagcaggcaatagagcccctaaatatcaaaggaaggtaaatgagttcattctagcattccactagccctcttaggctttgtcatgattgctttctcttttttctgtttacgttaatattttgtttctgaaatgcatctcatcctttcctccctatagagtctcctaaattgctttcttttctccccaaccttcattttttcctccttcactttcccactttcaattctaatttccaattagatcacttaggtttacaataatccccaacactacgtattattcccatctcaaagcaaactttagattgtaaccttcaaattcaaagtcccttatacagttttattctggaaaagttgacttcaagcaattattgattggcttgacttcttgctaaattttgcctaaaggcgagcctttttgaaatcacacaaagggtggaaaccacacaaaagtagtggttctcaaactaggtgggaattcataatggttataaagaatgaaatgggctggtcacagtggctcatgcctgtaatcccagcactttgggaggcccaggcgggcggatcatgaggttaggagatcgagtgaaaccccatctctactaaaaatacaacaaattagccaggcgtggtggcacacgcctgtagtcccagctactcgggaggctgaggcaggagaatcgcttgaaagcaggaggcagaggtttcagtgagccgagatcgtgccactgcactccagcctgggtgacagagcgagactccatctcaaaaaaagaaatgtaagtaatggattatttgggagttaggtaaggagcactgaaaaatatgttctaaaatttatattcatgaaaaataactgtatttttatttttaaaaaataacatttattaatagagattctatagaggaatgaagttactttttatttcctttcttttcctttactgtttccttctttccttccttccttccttcccttacttcctgcctccatcccttcctccttcccttcctccctccttccctccctcccttcctccttccctccctcttttccttctttcttccttccctccctcccttctcatcttggaatgagaatacacaaatcctcagttaactctacacttttattcaaacacaaacttcagttgccttgactagttttacagtaagaatttaattttgaagaaaacaaaaattaaatgtcactatcaataaatcaacctaaagatcaagtagatgtatagcatgggcagatatatcaatttaatatagggattaagaggttgtggagtcagcctgacccagtctggacttcagctgcaccgcttactgtgcatgtccttgagcgagttaactaaaatataccacacatccatctgcaagcatagcagtgaaggttaaataataatatgtacatgaaaaacttggactgtgcatgggacatagtaagtactcaataaatattataattaatacagttttgcaaaacatagtatctcatactgctcacatcactgcaaagtgataaagcaaaggacatcccaatatcctacctaagaaaattagtgttcaggcaatatttaattcatgtgcttctagtgctatttataattatctcattcaaatgtcattttgtaacaagtatttgatgtcccagctgacttgattctagacctagaacttggaaccaataataaattggtgggctttgaacttggaaaagcttgtgatagagtctaaagttttaattccacagggttgatgttggttcactgcttgtcacgatgtgcaattgaagctggctatcaaagcagaataaggcaaaggtactttaactccttcacaatcacatgttttcactttaatccaattatagctgctagtcacatgctttaaagatcacagatccaaataaagaaaccatcgggggtttctctatggcttataaaggagcaacatcttttatgactttaattagtctaattttctattgttaaagagaaaagaattatctgtccttaactaaggcagtcagttgtgcacaaagccaaacgtgctgtgggtcaggagatgtgagttctgacctctgaccaaccatgacctctctgagtactgagactagtcactggctgtctctggtttcactttccttgtttctaaaatcaatccttgcactgatgatcagtgagatcctttctagccatcatagcctattatttcatacaaagtgatttttccagaataactaaaaagctgtaaatggtatgttcagagatgacaaaatgagacagtaaataaagggtaaacgtatgtctccagaaagcaaaaataaataaataatactcaatgagaaaaaagatgagtggtgttttgaatattaacctctatgatatttcagttattaaaattagcttcatagttaattggctgatataacaggactttgtgtttcttaagcaagtatttgttaaacactgatgaagtctgtagtttatatctaagccccatgaagtttacaacatttgagttcaacaaagtttatcttgcaggagcttgcaatcaagtagatgagtaaaaagtacggatttaatatacattgcttaaaaggttacatataaatcacatcaagccaaaatatcagcctagttaagttgcttgacccagggttataactcgaatacacaggtctctggatttcccttttagagaccgtattccctttaatagggtttaatgggggggggggggggaaccatccagaagctgattgttgttattgttttataaatgtctttgttcttttaaaggtatgtttaatatgctgtttttattacagactatgtatccatgaaaagtaagtttgaaaatgcagaacatagattttttttctcaaagaaaataaagggtgaatttaatggaatgatcattttcaactggaaaggtgtatttgttgaatgctttttgtgagcactcaataatttagcttttggagcattctccatacagtctaatttaatatttgtaatgatccatagtgttatcactatcccacatgacagtaatggaaatgaggttcctggaggtccagtgatttttctgaatttaccaagtaaatatttgggaaagtgaaattaaacccaggctggcaggctggaaaatgtgtgctcttccgaatctttcatcttcttctggttcttggtgcttctctggaattttgcatacagagagaaggggacaggttcttttcacttttgatgtacagaggttatgagaaaataatcttaagaaatttactgaacagctcggttactaaaaatgtacatctatctttccgcatgatttttaagaagtgagattcccaatgaatggatttaaaatgcaattttacattcacctagaatgaatgtgcagatctttcctaaagatataagaaatcgactgaagtaagcaagaaaaacactattccggaattgcaaagggtatccctgaagagtatgtgtgaatgccataaaagttatactatatctaatattatcgagccctaattgaaagccgctgatttcacctacataattccatgtctgcgaaatcatgtggtgtttctagtgaacataaacacatttacagttaaggaaaacttaaaatatgtatccaaagataagttcaataggtttaaaaacccaaaatctggctgggcgcagtggctcatgcctgtaatcccagcactttgtgaggctgaggtgggtggatcacccgagttcaggagtttgaaaccagcctggccaacatggtgaaaccctgtccctactaaaaatacaaaaattagctgggcgtgatgacatacgcctgtagtcccagctactcgggaggctaaggcaggagaatcgcttgaacctgggaggtggaggttgcagtgagctgagatcctgccactgcactccagcctgggtgacagagcaagattccgtctccaataaataaatagatacatatatacatacacacccaatatcttgttcttattctttttaaactaaaaaaaaatatacacataactgtaggaagctttccttttcctttctgatagacacctttgaaatattaacttggtcagattcaacccttcctatgtttttaagagtgctagccaatatgtattttgcttgtatatgcataagatttgtttacataatacacaagaagctgttaataatcgatcctttctagggcacgttttgaattttgaagcatacgaatcaattatcttttaaaatattttcaattaaaaaaagttctagggtggtactacaggcaaggtatgatggaagtgccacattctcaaagccactgaagagagccagttgaaagttagcaaatgagttagttgtttcatcaagaaatggaagtggtctgatttttttttttttccaaatcaaataatgcagtacagtgcaaattcttgaaagatacttttattttcaaattgtacttggaagttcttcttattctgattctgttgagcagtgcaataggattacattggtagtataattgaataaggctctgtacagaaaaactataaaaaacaattgcctattgctttatttcctgagaaaaaaaattaccttttgataaaataagtagaaatgctgaaaagaatgtattcaagttagaagtatactccccactgaacacctctttcacatttctggcccatatagcagggatccccaacctccaagccacagactgcttccggtccatggcctgttaggaacctggtggcacagcaggaagtgagcagcaggcaagcgagcattaccacctgagctttatctcctgtcagatcagtgggactgtgaatcctattgtgaactgtgcatgcgaggcatctaggttgtgcactccttatgagaatctaatgcctgatgatctgaggtggtttcatcccaaaaccaacccctctccccaccatccatggaaaaattgtcttccatgaagccagtccctggtgccaaaaaggttggggaccactgctgtatagctacaacactcaagaatacatggcagttccatttaaattttaaaaattgaatgtctttggtttaaaatattgaatggttttaaatattccttataatgcaagaccacatcttaagctacaatggagggtaaaggacaaaggctatatttgaaaagtagaaaggaaatacaagagttttcagttaaattggaagattttttttaaaaaaaacctcaaacattttctaaaccctcaaattattcctaagatgcattcaactttgaatacattgataaaattcattgcttgacaaagttgcctatatttttcattgaattgggcagtggtgtgattgaattggccaaatcagaacctagagtgagcattctataaactcacctttactttgatccttgaagatcacaagttttgatactgttgaaatctctactctttcaacactttaattaaatggcatttagaatttcatatacttctgttgttgtttccacaatcttaaactggatttagaaatacttataatgtaaatgcaagagctttaacttagtaactgtatttcctattttttgttgtttttcttttgccagaatttctgtttgtctacaataaagtccagcgaaatacagtatttggttaggttacttgttaacataaaattttatcatttgtagagtttttacttaaccttcctattctctagtctctataatctttcaatgaagataaccagttacgaatatctcctataccatattaggcctgccagaatgtgatttcttggtataaagtgattttcaaatgttttcctaactcagtagccacttccatcatttatatctgagttatttcctctttttcttaatagagaaatgaattgatattcaagccaataattgatattcaagtgacatagttatgtcactaatgaaggtaacccatcctcagctaggaaaaaaaaaatatgtattttccaaaactgctgacttttactttgttgtcagtgaccttggagtcctggttctatactgtataggctgtgtgaccttatttcagttgagggtagaagagaaaaattatattgcaaaagtgggaaagaaacacacttataagattttcagtggaacttgagaggacttttcatttttctttttactataactcctcaaacagtatctaaaccttcaagttgttgtttctctccttctctaagcttcagtgctctcatttgtttcatggagataataaaaaacatctgtgcctcatctcatttatagcatggagacaatgacaatagatccacacctcaaacagtgtggagagggtgaaatgatgatgtagagagaaagcgtatcccagcacctgcatggtaaccactcagcacaagttatttgttattgttttaattggttacgaattgtattttacatataacctgtcctgtctggaataaatccattaccaatgaaaacttttaaataggaactccgtagatgataggttattcaataaagatctactggaaataaaactgttttccaaaataaaatatatagcggtgtgtgtgtgtgtgtgtgtgtgtgtgtgtgtgtgtgtatctgtgtgtgtacatacacattttaaaaaattgattctgttctcaatagcagaaaaaagtctttccactaccttaaacccacatttgactcaaatacactaacgatatgtaaccactgttcaaaggaaaagctgacggacattaggctgcggaatcctgcaatgcttgtgctcagcttgggcctgggtgtcaggataggaataggagatgccagacctgtttggtagtagtggtagtagtcattgcctaacctaggcaatcatcagctcatgggatttggtgctttaagcaaaggtgttaattattcccctcctcccttttagtaccattttctcttaaactaacacccatctttgggcttaactaagcagaaaagcaaacagggaagaaccaggtggttaaggaccagtgtcttaaagtaaatactctgtatttgagtccaaaatgaatttcaaactcaggttagatgtttcttcttaatcacttaggagccagtaagactctctaagccttccttcctacgctctttcactaaaggaccaggttctttcaggtgctatcctatttggaatttaatttgccctaacatttctccaagagccattacagcacaccacattgctgtatcccatttaactcccaaaccgcagagaagctggctgcagcatcaaacactattaaaaataccacaagggaaccttagagtgggatttcaggcacaagttacagcctaaggacaaacagcggttgtaaagagcttgaatgatactggaatggagatttaggagaattttcagagtctgaaaaaacagtccttaagattttagtgttggttcctagggctggttctccgtggttatatgggttagttaaaacattagagtaactttgcctttctccctctctcctcgagttttttttttttttttttttttttcggtcaacagatttggtaccaagagtgactacaagtgagaatggcttaacaaatatttccaagaagaggttcctatcactaggccttgcaaaggaacaacagactcattagatttttttttaacctgaatatctttattgtgccatctaagcacttatttgaaagtcttcaggtgtaatcctgattcagggtgtttaaaatgcaaatgcagaaattagcccagccatggctacacaagaggccccaggcatttcaaatttgaatgaatattttggaaatggagcagaaacttaatggattagtcattatttagagtcctgtcatgtgggaggtccaaattcagagccttagagcggggaggaatatgttatagtgtggtggtggcagcctcaaaataggtagtagtggtggtgaaggtggaggaggaatatgaggataaggatggtttttctgggtggaagaacaagaggaagagaagccagtacttgcctttcaagctctgcagtagtatcactgcaaactgagcacaacaatggaagaaatggcttctggcatccacttgctcattttctcttattggccaacatacttctggaatcttctcaaaagatccattctgacagactttttattttcccataaaattccaggagcatgtgtagactggacttctgggcttccattcttatagaatgtttccttcatataaaatgcttcagtttggaattttacattcagtacagattatttcattaatacagtgcatatctcccctgtcctggaccctagattataaggagtaagaatggggataatgcttctttttggtcatcaatgtatctcaagagctttgattagggcctggcacatggaagactctcaaaaaagtattgtttaaaaaaatgtctgaattgttaaatggacctggtctgaatatctaatccaaaggcaggcaattcatgggtttaccagcagccaataatctataatatttaaccacagtggaaagttacctcattgtatttgtaaatttgtaggctcaagttgcaattataaatgggaaattgcaactaaggtaattggtgtcaagagaaaaaaaaatttttaaatctactgatggcctaaaattgggcctagagaagctatggcaagccatgtacaaactcaggcaatgagaaagcagacactatggagagtagagaactatctctagaaaacaaaaaccagaccagatatataaataaacaaagggcagagtcctgagaaagacaccatatttactacaagcaaaagaagaagtttcaggtgcctagaactgtgatggttcccaaaacttctaaaccctagtccacctgtgtccatgtgagaatgacatttattttgatctagttatttctggtaaccgagctgatccagtgaggatattgtcatatggtgatgagggacgtttgtgaattactatgtaaagaaaagatgcttactctgtgccagtagcttgggaatctggaatcccttcctgtaagcctcagagtgtttccaggaaaagtcaccaaatagctttgattcaaggaaatgaatctcttctgtcctgtactggctgcttgaaaacatagtcacctgagtaatatgagtccaaagtactacattacatctcagtgtttcttgcaattgactaacatgtagaaattgtgcttggctgggatctcacagttatctggttggtttctgtctgctgcatggagctcacttcctggtagtgaccatagaaggaggcattatctttttccagtcactaaaaactatatgaacatcaacaataacctaatttgtgagctctctggcaggaatgaaattcctctttataatcactgatggtactccctgtgtatggcagcagagtgacacacgctgtcctagtggaacataccctcactttgccttgtgtttaaagctgggcaccacttctaccttagggagagagatggtgcgaaagcagaagtgaggaatcacagatgggacagagttggactgggtgatgctgcagtgaggaatgagggagcatgatgaaggaagaatgatataattttagggagctgggaatgaatagggtgaagagggagagaaaagaggagatttagacaaagaatgggaaacaagacaaataagggaaggagtgagggaagagactggaaaaagaagaggcagatataaggaaaggaaaaaggcaagagaatagagtagagaacatgtgaaaaggagaagatcggagaaaacaaatgaactgagataaaatttgagggaggcagcagagtgttgactgcagggtgtggaatctgaaatataactgccaagttttgaagcctggctccacagctttccagaataatgaccatgggacatatccctaaattctctgagcctcagtttcttcttctgtaaaatgggaataataattttacctaccttatgtgatcatgcatgcccagtcttagcacagtgtttggcacacagaattgttattattgaggttaaaagagagaaacaaagcaaagaaaataataaaatggaggaagtaggaaagagagatgttcagacagtggaaggatggaaaagaaatgtatttctgctaataattttaaccttagtttttccacattataatcaagatttctatgcctactatattgtttctacctgctttaataacagctggaaaaacatgttgagtatgaacataccttttttaaaggtatttttgtattaaaccagcctgtaatagtttgcaaaacagatgttcacatttccttgagttgaaattattccctagaaatgagtaagacgaaggatacatgaagctaaaccggtcatccaaaaaacggtttgtttatttgccctacctctttactgtattgactaggtcgtttgatgggattaactaaattgaccggttattttgaaatgtgttaacccaactgtaggctttagggaaaataaagcccctagtgttcttggtggtgtttctttccaagtttctctccacaacacaaaccacttccttttacttgaagtcattttgcttttctcattagtctcacagtccaggggctggtgttgagtgctgaggcagctctcagttcaagaccataaaacaacacaacaaaattagcccaaaacataaaaggaaagcactgtggagttgttcttctcctctcaagaaaaggaaagtggaagttagggcagataaagtatgagaaagagatcagagatctattcttgcataggggtggggaggtagaatgaatgaaaccacagcccaagtcagagggaaagaaaatggaaggagcaaaaacaacaaaaatcccccaccacctctctcgacattcatcacaacaactctctgtgcacctggcatggtgctgcacagttgtcagatcccaggcatgactccctagtgtttccatgaggctgaataaatagtgttctcacagactctccagtagcagcgggtgaaaggccaaccttcattgaccactataaggcttttcttaaatgctactcggacacaccaaaagaaatgttgtccttttcacaaaaacatgtccttgttcaggaccatgtaagttatttaaaataatggtcaatgaaacaaatatagcaatggtatcgcttctcacattttcctcattctgctcagagggctgacagagtggagaagatcatccatcatccacttctttcaagttactcccttctgccaaagggattaagagacacattttcatcccactttctcaaataggagaaaaagttttccatgctggtttctactgttccatgttttgctcttatattgcacccaagaatcatttcaagatgttctgagaagagatgtaaaagagtcagctgatcttccctacttcaggtctattgaacacaggtaagttggcatgacagtgccccagaaccacacactagtactatgtgtggttataacaaaagaattgctatactggtgggcagggtttttttttttgttgttgttgtttttttttaataaagaggcatagaccataatttttagagcaatttcattaggttatgctagaggtaggtttgggagaagagcctgactcggcctgaggaaggggactgggcttgaattttaggtgtcctctaaaatgagataaagtgaaccaggcaattatgagagagaagcgagttttagatggtgagaagagtacaagtaaatgaagacagttgtgaaacatggtgcacgtgggtggaaaaagtttgctgctgaaagagtcagccaggggctgggctggagaggaggtacaatacatatctggataggggctttgggtaccacacgaaagagatctgattttatcatggatgatgggaaggcttgaaaaggttttaagaagagtgacatttgcagattaatttttcaactacataaatttgctggcatcatggaaggccagagctaagaagaggtgcaacagagatcgaccatttaagaaagtagttctctaattttaaaaattatagtaagaaatacattttcatggcaaaatgtctgtgtgtgtttgcatgtctgtgggtgtatcaataattttataaaaccatatttatctttgatattatagatgtggttttatactcttattttttacgcaattctgtatcatatttttaaaataaaatgctaaatgcaactgacagtttcaaaaacactatttcaggtactagtactataattcaggggagagttggtgagtgcttgaactagggaaatattagcaggttagagaagagagcatggatttgatcaatagttataaaataaaataaaaattgtattcatttggggccgagcatggtggctcacacctgtaacctcagcactttggaggccaaggcaggaggatcacttgaggccaagaattcgagaccagcctggccaacatagtgaaacgctgtctctactaaaaatacaaaaattagctgggtgtgatggtgtacacctgtaataccagctacttgggaggctgaggcacaagaattgcttgaacccaggaggtggaggttacagtgagcttaaatcttgccactgcactccatcctgggcaacagagtgagacaactctgtttcaaaaatatatatagacagacagatagatttggtagaaggattcatgatttataagtttcgatcttggctaaaagtgtttcactaactgagataggaagaacagatttgcaaagaaatatgtgagtccagctctggacatattggatttgaagagttggatatcaatggacattgggcttttgtgtgaataaatttggaaattggggaagtgcctactctgagtagagacagagttttgggacccactttcataagatggaaaatacaactatgaggtacatgaaaacatctacagagtacacagagtgagaaaaccaattaatcaaaaagaacattctagaatactcacatttaagaggtaaagtggggaggaagagagaccatgaagaatagtgaaaagaagtattcagagcagcaagaagagtgtggaaacatctggaacaaaatggctcccaacaaaaacatgttgaataaatatttactcagtaaatgaacaaagaaagagtttaagaagaagaagcctctaagaactaagaagacaattaggagttcattggcaaccaagggagggcagctggaacagaggtgttgtgagaaagtcgtactacagtggactgcagactgaatagggatgaggaggtagagcaacttgactgaaaagagaagatcaagaactagctaaaggatcaataaagagttggctgaactttgctgtggtttgctgtgtattgtttttaagattgtgagagacatgaatggggaaagagccagaataaaagtaaagattgaagatgtgagagatagaaaggaaaacagacgaagcaaggacttgtgggagctgggaggagagaggatcaagggcccagatgcaggggttgacttagagcaggagggagaagggaaacgtcatccgctgagaccagaagggaggaagggattatggatgtcagtaagagacctatggataacatctatggcaagaggatgtaggagctgaggaagttcatgccttgacacagactttcttcaaaaagcaacaagttatttgctgaaaggagatgaagagctgctggtttgggaggcttaagagagaggacaggtttggaattagcatgaagaggactgagagaggggcacagcaggaactaactgtcaagtgctctgagagtccgatgaggtgacaggtcttgactttgttggaattccagcttgaagtgatgtgggattatttttcccaggaattcaggtaaggaagtggaaaaggcagactgtaaaactgacagagctggattttcccaaagtgagtaaggaggacaggatggcaagagattcgagagagactgggcaggccagagggagaggttaggagaagactcatttgcttaaaggagattgaaatccctgaactagagacttgccagaaaaaaaaaaaatatatatatatgtgtgtgtgtgtgtgtgtgtgtgtgtgtgtgtgtgtgtgtgtgtcttattctcttttgtggcagacactaaatttgagccaaggagatgtaagtagaagcattatgtgggatttctcagaagccttttctaaaaggagtgggtgtactattccttcttttttcctccttcttgctgctggccacttagttgtgatggctagggctcttgtagtcatctcagaccatgaagacaaagcctataatctagaaatgttaaaaaaattatctgaaagaagctctgggcccttggtgattttagagcagccacagcagccctggactgctcactctgaatttctggaaaaagaaatcaacttctgtcttgattgaagcacaattttaaaaaattgaaataaaaatattttatatatttatggtatacaacatgttttggtatatacagcgaaattttcaggactcatttactaaccatattctagctaaaagagaatatatacacagcaactagagaacgaatagagatttcttggaacagaatgctatctttctaccatgtaatgcctaagcagggcacatactttatagtaagcaaaaagctttgatctttgcaggagattatagactgcttttgatttgggtagagaagaaacaaaagtcaaatcttggatttcttcattaattaaaaaaaaaaaaaggcaaaataaagccacatgtatgttgttttttcccgtaaggtcaagcaaagacttctttatactttttgtgagaaaatgtattgaaaattaatgacattaatacccaggatggtacatttccattgcttcacaatttttttttctttctgaagggttagaatttccaccagtcagcataaaatggttaaaactgaagcctagtaaatcacttgtattgcattgttttcaaagtgactaaacagctgtagttttcaaggtcagccaaatcatctgccagggtcacacgtgtttcacatgtcaagtaacgtatatgggttcaattccatccaggatcctaaggaaaaagacatttgcaaacaagtgatccgaagacatttttctaaacaggtgctgtggttactgggataagagttactattgtaaaccacttgaatttacgactaagtttccaatcatttaaaaagaatattcatttcaaattataatgtccaaaccaagaggaccagctcctgatcataatgacattcaatgaggacagaaagtaatattgtataattgttattattaccataatgacattgttcatgtacaaatgagaagaatgtatattgggtatcaaaataaaaccaaccaaacacataattaggatggaacctagttaaacagttgaagagaggagacttaaagcaacaagacttggctaatacttctccctccaattcttgctccaggaaacattgcatagaaacaaaagacatgactaccatatgccaataactgctttaacaagctggagtaattggtatcatggagccagactgatggaacaaagaaaggatgacctcaggatttaaagagtttagggacagaaaaacattttaaaaatccagtttaattcagaggatagttagagatgtctggctccaactgagagaaggaaagggtattgatttgcgtgagtggctctccattgggctcttctaactcaaaagagataattggccttgaatagtagcttttatattgaatttatattgagttctcttgatgttcttggtatgtgctcttcaaagcccaagaccactccctgatcttgtttatatttgctagtcctaatgatctttcatgtgtcagacgtgctgaatgaagacgattgccttctgatcatttaactcttctctgccagtttcaaggttggcttccatattttagcaagcaaaataataggcatctccaagtcacagtatgcagacaggaatagacaaatacccactttagctaagtatgggctgcagtcaagctggaaaaggtctctcagctctgagtcacttatacaatcgagtccctgaacatgtttctgtccctaatattttgttgctctgggcaaccatcaagtccacatgaagacttctgccaactggagaggatgactagataggagtgccagaattttcttttaactctttgttgaaaactcaaaatagcaaatggtgtcaaggatatcccctaaacatccagattggaaaaagtggaattcacacattgccttggtatcttttattcacttcttagggaaatatgactaaagaagataaaggcaattcatcagaggcatgcatttttttataataataaaatattaggaaaaagttagatgattaggtactatttaatccaatatcatcattttacagaacacaacccaggttaaattactgaccaaaaattacacagagagctaggcagagctgggattatacccctggtcttaaaaccctgaggtcattgctctttcctggactttcagaagcccagtgccagaggcaaagtgaagaaatgttaagaaatcacaagtgatcacctctcttttgtaatagcaaacggttctagttgaaaagggctgctttgctgggatactggaagcaatcctaaagctctggagtagttatcacccattaacactcccaatacagaaagtgtgactatggcacattaaactaaagcatctaaagagtgttcaaggcccaacaaaaataccatgtttgctggaagccttcattgcttattattctaatttggtctttgcctcctctgaattcttacgatactctgtggtacagtcctgagactacttaagattttttgcccaggctggagtgctgtgatcatagctcattgcagcctagacctcttgggctcaagcaaccctcctatctcaactcccccagtagctaggactacaggcatgtgccaccatgcctggctaatttttgtattttttttttgtagagaaaaggtttcatcatgttgcccaggctggtctgaaattcctaggctcaagtgatcctcctgcctcagcctcccaaagtgctgcgattagaggtgtgagccaccacacctagacagtttcttttgcacatgtacaattatattgtgtcaagtccttgggggtaggactatatcttattcatttttgttttcttgaaacccagagcacagaattaaacatattttggttgattttattttctctagaggtacagtgacgacttacttatccagattaattatccaggaatttatactattcaaaatcagtaagtaggtgaaaagaacccagaaaagtcaagtaaacacttgtaggatcttgttcactttatgcatctcatatcctaaaggtctacctcagaaatgaattgccctcaaccttcacttttattttgaattaatttacctttattttatgctcaatgcaatagcttggtaatcaggtttgccaaggaaaaagcagcagcagctcacaaaagatgccaataaagccaagcttagtaacatcatgaactgaccaccagacaatatgggacagcagatgagaaattaaagtgcagccagatttgctgctcgttactgtaggggaaaaaaaagtcctcatagatcattagctcctaagtgcatttgtgaatgacagggaagtacaaaagcagatgttcatgaggaaccagagccagcaaaaatgatttaattacattcagtgtacacctttaagaggttaagaataagcataacacctttcagagattttcatgaatattcaatatacaggacattttctcttaaatgaaatgtaggaaatctaaggatggagataaactagccttaaattcagccttagaatccaggtcttaacctatgtttatcctacatataatacgaaggattataaattttcacacattatcagaagcattttacacctactcagtaaaatcatatgattagcagttatgaaatcctatacatttatcctccttatattttttgtaactatctcttcctttttattctggctatctagctatctagtgtacaacctttattacatcttatgcttgaatatcgctgttgtctttgagttggtttcaaaacctcggatttttttttccttcattagctgcattaaaaaaaagaaatttccaggtgattattattatcttctgtagaaacaggatctcactgcgctgcccaggctagtctggaactcttggcctcaagtgatcctctggccttgacctgctaaagtgctgggattacaggtgtgaggcaccacgcctgccccccaaggtgattttaaggaacagacaaatttgtgaaccactatccctaagtgcttagcacaccattcatttcactcttaattatatccttcaatggaactaactcccttagtggcaggcgtaatatgcctgtgatttctgagcttagatgctctttaaaaatagttgtttttggccgggtgtggtggctcacgcctgtaatcccagcactttgggaggccgagatgggtggatcatgaggtcaggagttcaagaccagcctgaccaacatggtgaaaccctgtctctactaaaaatgcaaaaattagccaggcatggtgacgtgtgcctgtaatcccagctactcaggaggctgaggcaggagaatcacttgaatccaggaggtggaggttgcagtgagccgaattgcgccattgcactccagcctgggcaacagagagagactccgtcccacctcccacccccgccaacaaaaaagttttttcatattcattgtgttagcccaaaatatctgagacaggtctcaatcagtttagaaagtgtattttgccaaagttaaggatgcacgtgtgacactgcctcaggtggtcctgaagacatgtgcccaaggtggtcaggctacagcttgtttttgtacattttaggaagaaataatacatcaatcaatacatgtaagatttacactggttctatctggaaagctggaaagcgggaaaactcaaagttgggggagggcttcgaggtcacaggtagatttcaacatattctgattagcaattggttgaaagagttattatcagtagaaaggaatgtctgggttaagataaaagttgtggagaccaaaggtttattaggcagatgaagcctccaggtagcaggcttccaagaaaagagatcctaaatgtttcttatcagacttaaggtctgtggtgatgttaatactggaggggtaaaataaggcatgtctgacttcctttgcggcctaaatcagtctttcaggttaaattttaaagtgccctggccaaggaggaagtccattcaggtgagggtgcaggcgtgcttcaaattttatttttagtttacaactgttagcgaaaagtacgtcctctcaatttccgttttccccctgtatttacttaagaactattttccagttccttctatatcttgctttgcatctccagcaaagagatactaaagttttctcttggtcttcttttcagaggtgcggtttgatgattacgcacaaagagacaaagataatgagtgggggtagacctgctagcttaactttttcttttagagaagcacctaaggggatctgtcacatggatgaatctacccttctttgaaggtctgatttgaaagcagattggactacattctgcacaaaggcattttaaacatgcaggtgtgaatgccccaaataacaatactttgaacttttacagaacctttcatccagtgataccaaaacaattcagtttattaaaggcctaggaagctggggacaaaacatccaattgatctatatatggaaatttattgcattaacttggttggtgattcctttcaagtctcccaacgctggggcatataagcagagaaaactgtacggtttctgcaagctacctctccaaattgtaatattttccatttccaactcctcaagaagagctaatcctcttcttttcacatttatgcttaattagagagttaccagttcacagacagttatttatgttcagaacctaataaattcttgtttctgccttaatttgaccaaggattgccttctatgtcatgttctaaagaagcccattgaacaaataaataaaaacagacttcacctgtagtgagggagaactattatctaatcaatttttcattttaaaaattaaatacttcaaaattggctgggtgtgatggcccacacctgtaatcccagcactttgggaggccaaggcaggagaatcacttgagcccaggagtgcaagactagcctgggcaacatcgtgagatcctgtctctaaaaaaaaaaaaaaaaattaaaaattagccaggtatggtggtgcagtgctatgtgcctgtagtcccaggtagacaggaggatgaggtgggaggattgcttgagcccaggaggtcgaggctgcagtgagctgtgattgtgccaccgcaatctagcctgagcaaaaagtgagaccctgcatcaaaaaaaaaaaaaattgtaattaaatcttatttttaatctgagagcatagatttaagttgccctgaatatacactctcacttatctaattgattttttttttttcttcgaggcagagtcttgctctgtcacccaggttggagtacagtggcatgatctcacctctgcctcccgggttcaagccattttcgtgcctcagcttcccaagtagctgggattacaggcatgtgccaccatgcctccatgcctggctacttttttttttttttttcagtagagacgggggtttcaccatgttgcccaggctgatcttgaactcctggcctcaatcgatccgcctgcctcggccacccaaagtgctgtgggattacaggtgtgagccaccgtgcctggccaatcgaattgatttttaaatgaacaatctttttttttttttttttgagacagtttcactttttgcctaggctgaagtgcaatggcgcgatctcagctcaccacaacctctgcctcccaggttcaagcgattctcctgcctcagtctcccgagtagccgggattacaggcatgtgccaccacgcctggctaattttgtatttttaatagagacggggtttctccatgttggccaggctggtctcgaactcctgacctcaggtgatccgcccctccttggcctcccaaaatgctggataacaggcgtgagccaccgctcctggtccttaaatgaacaatctatcgtacaaatctgttggatacctctactttttaccatatatctttcaaaaaacttacaaatttaatcttttcctcttttccaccttctgacttccttattatatacattgcagtgaactcaggacagctaagattcagagtggcaactggggtatattcctattttcccatattttaaatctgctgtaaaggaaatagttgttatgagcaaaatgtgtctgaggaatgtttatcagactatcgtttttatttggcattgtcccagcatattagtttttaatttttttgccccatttcaatggtgactttgatgttttgttttgaccagctgctgagctttttgtggctgtccatttacatcactttaaaaaatggtacataaatgaaatttgaacaaaatgaacagtactttaacattgtttcaaaatcaaatatcttcctaaggaatctgatttgtggcagatggagaacaaaaccttccagagggagggctgttaaatgagtcttaattgcttgcacatgaaaatattgtgactaagattgtgtgcacaattaggaatttaaacatgtagaaaagaactggccatagaaacaggcagacatttttgcagtcagagctagtttcttgtgaacacagacaataaagacaagtcagtaaaggaaaataatttcaagagaaattcagttgttttctttacttcattgttgcttacattgagcttccaattctaaagatgattcatttgccttggaaactcactgatggaagtatcacagtacagtcaagaaaaaaatgtttattcaagaactagtatttcttttttagttcctactatgcgtcagatgctaggtttcgtgcttaattcacttcatttaattcttacttaatgctctgagataggtttgctattattcccgtcttctaatgagaaatcaaggctcagagaataactttcccaaagtcaaatagctaacaaatagtgcagccaggattctctgtattgatttaatgaatccaccctctgacaatgcctcactgctcccctgggaaaaagcacatatcttttttttaaaaaaatgatttaataaacttattctaagagcgcctatactttgttctgagtcaataatgccttccttctgttggatggcatgatgtaggttgctaggctggacttgttaaacgttgggtaaggaaggcatgattgcacccaggcgaagtgaatggctacgcagagggcacagataatctgaataggggttgggctgagatgacagatttagagacagaggccaggacttcctacaggggccacacgtcacggcgtcttgtatagaaccaagcataaaagaggcatcaataaatgtgtgtggatcaaatgatgagatggtcaaattatttttgtgccttcagaggaactgagttctcaggatacattaatgacaggtaccatctggatctctaaaaaaaatgagtatcataaaaagaaattcagtgagaaataaattaataaaataaatagtgcattgaaaccaatcctactagcatttatttcccctatctaagagcaccctaatttctttcaggaatatactttgtatccctattagataatcttaataatagttaaccagcaatgatcaagtgcttactgtgagccatgcattttgcttcatttttcataaatatctttttttttcctaagacagagtcttcctctgttatccaggctggagtgcagtggcacgatctcagcttactgcaacctctgcctcccaggttcaagtgattctcctacctcagcctcccaaggagctgggattacaggtgtgcaacaccatgtctggctaatttttttgtgtttttagtagagacagggtttcaccatgttggccaggctggtctcaaactcctgacctcaggtgatctgcccgcctcagcctcccaaaatgctggaattacaggcgtgagcaaccatgcccagcctttcataaatatctcctcaaataattttcatgaactccctatgagataaatattattattgtgcttacttcaaaagtgaggaatttcaggctctggaaggttaaatgaattgtttgagcacaagcatctgtaagtcgtagtgctagaatatgaacccacaaaatctggtcccatcattcagctcttactaccacattttataacatagtttggtagaactgaagccacctgcctgttctcttttagccaaggcccaggacgcaaacaagacaaattagatcccttcactgctgtttgactcttgaaataatgacaaagaaactaagaacagttgtggggatctcactcgactactcctgccatgagactttccccttgatttgtagccttctagcactgtaaagatgcactgattccttcaaacctcgtcctccagcacccccaccaccacctgtcgccccactaattctcagggaattcagaattcttcctatattcttccactaagaattttgcattaatgagcagagttggtttttttgtattgcaagcaaaggatcattgctgagacaccattttctaaggggaggtgataagccagccaaggggagaattgtatggaatccccaaagaacaagatgcagacaacactgtttagtgtgccacaataatttaatagactcactgagaaataatagcatgacaaaaggccaggttaatttcctctgctgccctttctgtggaaatgatgaaggttcttgggctcctctctgatccactggtcttagatacattggccttctcctttatttccagtaccctcaacagtttccagtaaagagaaacagcaagggagggtctgtagaaagacagactgtcttgaggttggctgaggggtaaaagaaatttcccagaaattgctccttttccttcacaaactgcctagaattcagattttgtctccttcaaagttgcatctgggaaaatgtgtttatatgcttattccacacattgccatcattgtaatgattttagggctccctgtcttggaattgccttaaaagtccatgtgatacttcttaaaaaactctttaaaatcccttgagaatggtttcatttctggagttagccccatctaagctaatttgacattctgtctggtgaatagggttggtaatcatattggaaataatatttttggtcataagtgaagtgttactataaaccagtgagattgcttattgctttttggtatgtgtgtgtcttatatggtctgtaaatggtctctaaagccacttccaaaatgctttcagcaatggcatcagggctcaaataattgcacagtttccagagatggctgttttgaggatcaacagtaattgaataatataataatatttattggtagtttataatacttttcaacatattaagcactttccacatgcttttaaataagacctgacatttactatgtcccagacaccgtgctaatttttttacacagattatctcatgtaattcctcaaaattaggaaggtataattattacccaccacattttaacagaaaagatctaacacatcggcgtgacttttctaaggtcacacgtaaagtgggtgagcaggacagccagccacgaaaccccaattttctgacccctgagtcttgttcctcctccttcacatagattttgacttgtatgtcaaaacacaaaaacaaaacctaccaatgtttgagatttttttctatgggaggataaaacctaggtctgtctctgtagaagcaatattagtcaaataacagtcagtccactgtcagtgacttcagaggtatcttacttgtcattcaactctgaggtctcggtttcacgaccagttcttttctattttccttttggctattttgaaacatgtcttcttttaccaatctcagccctccactttctcatgctgtgaagtattccctaaatttctgaattattttcccaaaccattttcagtctctaagctaacactgtaggcagcttcttagctctttagaaaaacaatctcacctgcatctgctccattcttcctctctcccttcctttctctcttctttattttacttattcatttatccattcacttataagccctctgttttctattaacttaatgctttttgtcattcaacagaacacattttagctttttaagttccacaaacctctagagtaatggtcctgaagcttactggaggtattttattcatccttgggtccttggagcctaagcatagcctttcacatactagggactaaatgagtaaaagcaaagccaggaagaggcagaaatcaagttctctatgtggacagttctgtgttcaatatgcaaacatcagaaacatatccagaaaagaatgtcataaacacccatctgttttgtgtggcatatagaatacagtcaattagaaatacttccacaggaccaacagtgctgaaaaggaaccacaaaaaaacaaaacaaaacaaaacaaaaatacagaaggaagacggcacactagaaagcactggatatttaagcatcagaaatatctcaaggaagtgcattcaggacatggtgagctaggaaacttttgcctagcaatggtagctaagagatgataatggcatgaagagacttcacccaaagagaagattaatattcccagtagttggggcctgccctttcaggccttcgtggtaagtggtcccagaagcaaggtgagtgctaacgctgaagcactgcgttaccctggttcctccgaaacaccccatctgcctgacttctcacacacacctgggcctttccttgtcaatgctctgcccctgggcactctggtgacaacgggcacttcagaagagtcaggaagagaagtgtgggaattgaagaatcctataccccctggcaggaatcctttccttagcttatataactatagagagtttttagggtttcccaaagagtttctgtgcatccacagatcttatccctcctcttgtcctaccctccactcatatacattcaggaatagatggtatagatttgttttctgttctcaaaagaaaaaagaaaaagaaagagagagagagagggagggaaggagagagaaaaaaaagaagagagatgtccctagggaataacttttgaggaccagcacatccagcagcttgtgtatgtgtgtacatgccagtacattttaggagaggacttgacattctccctctgagtcaatccgtactttgtaattttctacctatgtatcttaatcaaattattcaacttgtctagcccagttttgcatctatgaagcaggaatagcaacggtgtctacctctttggatatcataaggtttaaaaagattactcatctagagtgtttggtacatttcaaatgtcagtaaatgttaacttttattaatattagtattaataatatatccaactgatttttaaagcattttttgagagaggctttttgatataacaaaagaaacgacgctgtgagtgcactccctatttatttagagttaaataattcagtgtaacatccaactagtaaaatttgggaaatgagcctcaaaggaattttcaacattttgccccaccacagtcactgtatttctgagtatgcctagaatattttttaaggctgaaatgggtgggaagcactttgtggagaaagggagtgactgaagaatgcagtttgtgtggttcttttattttttttttttcttttattagtttaaggagacttggtactgtgtccaagaagacaaaaagaatgcaattactaaacatttcccaaattccctccctcccacatccacaaaggtagatgtgatacttgattttcttctcagagacgagcaagctgctctacttaaaatcttgtatgtattttgagagataacagatgatgaccctgacgctgatgcccaggatgacgaagtcagcacagataataatatcaccttgtatcttctttcactaatcgtggagcactttgcacatatgatcgtgcttatcctgggctgcactgtttgttagatgagggtgtgggtgtcactatatatactttccagaaagacaggtattttccaacaagctatcatcaactcaatgacaacactgtacacaggcagccctctcacctgctttcttcagtattccattattctcccaaatttggccaatcaagcccattcacctgggagtatttgttaataatttagatcctgagccttatcctagacattcagttctggaaagtctgggaatcagtcattttgtggttgttctcaggaagcccttggggattcctttgatcagagacaggtttgggaagtattgctctttttaaactcagggcagcggggaagggatgctggcaggagtggactttggtgacactgagatcttttattcatgtggtagcttttcttactctgagacagagttttgctctgtagcccaggctagagtgcagtggcatgatcatggttcactgcagcatcaacttcctgggcataaatgatcctcctgaatagctgggattacaggtgtgcaccaccatgtctagctaatttttaaaattttttgtagagatggaggtctcactgtgtttcaggcttgcctcaaactcctggcctcaagccatcttcctcccttgcctcccaaagtgctggaattacaggtgtgagccactgcacccagccctaagggtagtttttctgatcatctgaaggataatacaacatttttgtcataggctcaataatccataaaatgctgccctatgtgagagatattattattttaaaatacagttaatgctggactgtggaaccataatattgaaatattgttagggcgggtctcaccagtgccctttctaggcaaggagaggcaaactaacaactgggacctgagaaataacatgtttgtcactagattcaatgtaaaatggtaaacctatctacctttgctaactactggtcaacaactaaaagtaacttaagttcaattcaatatacataattaaagtgcattaaatgtgtgcctattgcccacatggcactttattatgtattccttaaaatacaaacatttttccatattattaaaattttctcaaaaataaattatttaaaatcattttattatgggaattttttaacccctacctaaatagaattcacacattatttagaatttggattgtttttaaccctttatgcacattcacagtgctgtaatgaacatgtgtatatatactttcactttttttttttttttttgagatgaagtttctctcttgttgcccaggctagagtgcaatggtgccatctcggctcactgtaacctctgcctcctgggttcaagcaattctcctgcctcagcctccagagtagctgggattacaagcacgtgccaccacgcctggctaatttttgtatttttagtagagatggggtttcaccatgttggccaggctggtcttgaactcctgacctcaggtgatccacccgcctcagcctcccaaactgctgggattacaggcgtgagccaccacacctggctcatactttcactttaaaattgttcatcctcagtctctgctctaatcaacccccaagtcccttcaatcctatctctgaagagttgtgaacccattccctcatctccacagccccacttccaccccagttcagagctgcattatcttgatcctgtacaaggcctgtgacagccccctgaagagtatggggctgcccctagtctttcttcttttcaatctctttctacactgcttccaattactgtcattctgaaatgtgtatttgttcctacgattggaaatgctcaatgattttccactgtccataaaataaagtccactgttatttatgtaggcctcaaatattatttccttaatctacctctggagcatcctgttcagttgctcctatacacctttaactcaatttgtcctttactgttcccagtcccctgatatggacaggcattccatgcttccataccttattcttgctggtcttttgttgtgaggtaatcctcaatcctcccctaaccacatggaaagcattatgttcttcaaatttatcagggagcatttcctaggtagagccactggctctctctctctctatatatgaatacatattcatatatattatatattaaatatataatataattatttaatatatattttatatatttattttataataaacatatatatttatatgagaaatatatttattatataataagcatatatatgagaaatacattatataataaatattatatttatttatatgagaattatatttatatattatatatttatataataaatatatattatatatataataaatatatattatatatataataaatatatattatatatataatatatatatattatatatataataaatatatattatatatataataaatatatattatatatataataaatatatattatatatataataaatatataatattatatatatttatataatatatgtatataatatataatacatatataataaatatgtatataatatataataaatatataataaatatgtatataatatataataaatatatatttatacaatttataagaaatatatatttatataagaaatatatataattttataaaatatataatatataatatattatatattatatattttgtatatattatatataatatatatttatataaatatatatatttaaagaggtttcagtccaggctctgtggctcatgcctataatcccagcactttgggaggccaaggtgggcagattgcttgagcctaggagttccagatcagcctgggcaacacggcaaaacgccgcctctacaaaaaatacaaaaaataaaataaaaaattatgcacacgtggtggtgcatgcctgtagtcccagctactcaggaggctgaggtgggaggattgctggagactgggaggcggaggttgcaatgagacaagatcgtaccacttcactccagcctgggcaacagagtgaggccctatttctaaaaattaattaattaattaaaataaaaaatataaaggcttcaatcatggcatttagctagtacttaactatttataattccttctcccttactttgtaaatttcttgaaccagtagtcacattttacctccagagcgtatgcatgccatatataaggtgcatggaaaatactgttgaccaagcagataataataataataatattatagcaataatgataagtaacatttgttgaatacattctgagtaccaagtactatgttaagcactgaattagaatttactgataaagaatacccccaaaacttggagaatttaagtacattgaccaaaattagacaactactaagaggaaagctgggtttttaacatatatgctagctcatcacctttttgctaggctaaatgaacatgagccccatttaattatttcaattaaagttataacaaagcatccaaatcagatattcagacaagagagacacaattaaattatttcccctcataattaggacatagcccttgttttcactattcttaaaacaagtctaacttcaatcaattcctggtcaaaaagccacggtgtcagatctgatctttttatatattaataggtatggctctactcattaaataaaagcataaaaggccaaaacaaattcatttgtaagaaagagaactgacttttactgctctaaaagatcataagtttaactaataaatagtaatactccatgcatttatgcaaatctttcagttcaatgtttttaccggaagattctttttcaatgaggatttttgtaaaagtaaactccttcagcttaaaagatttaggaaatccgacagtcattagatgtattagatgctttatcagttttttattaaagctattaaacacaatgtatcatcagcatttttcgatcacatttcttaaaaagcttaatgaacacatatttctggcaattattaaagtgtggccacaatctttattctattaaaggaaaaaaagaactacagcatgaagctgctgcctgctggtggttgatgaggaagtagggcttctctggcaatggctgggtctcttgtcttccctatacactgacacaacacatgttttacttcagtatctcctgaggacttacatatttctctcatgtagatcccttttgccttctttatatggttcttgctcccatctattagatctctctatatttctttttaaaaaactatatatactacttgcttttatcacacacacacagatttaaaaggcagatctaagtaagtagccagcatccttattgtcaccatgaaatagttgcttagtttctttcattcgataagctcaaagcattaagtgattagcccagataacaaaaaaataattgtcccaattaaatatcattattgtttttcccccttattaattcttagaaactgcttgtgctttagaacaacaaacatataagattaaatttcttctcattgtgttttgacagactagcattatttggatagtttactttttaattttctacgtgccaattgactaaattctatttagaatgcacttactgtttttaatgaagccatgaatcttcagggtaaaaaaatacaaaaaggaatgaagacttagaccaatttacttatttatttattttctggactaaaaccacttctgtgctgttctatgcttgtcactgcatcatgtgtctccccctacaggtaaagagcaggcagctgtactagtttcaccgctcctgtagaagaatttgtattttccaaagtcaaaatccagaagtcttttgctttagggtgctggtctctatgcctctggggtataagcagtagatataatcaaaatagctataactacagagatatgtccagtgagaggttgggatgagaaattttcaagctcatatacaaataatacaatgccacatctattactcaggagttagtattaatacttcatttactttctctaaagcatatacttccacggtgggtataaaggccacccgaatctaatggtttattttactttataaaggtgtaagaaggaccatggactcgaaaaaggaaccacatgtttattcctggcattgtcactaagcagcaccctctctcactaggtctcagttttttcatctttaaaataaagatatttaaatacgttttctttagagttgtgtccttgcatgaaaatcctctaattgaggatgattaaataaacatattggaaatatggaaattcagaagcattgaaaatggtattgtgaagatgtaacatttaatgagatggctgcagaatgcttgccttgagctaaggttgttcgaaaatgaaatgcttacaaggaaggactgtgctccaagctacatggctgtacttcaaaaatgggatcactgtcccagtgcaggtatggcttgggcatctctgactctttgccaccctctcatgttccaatgcactctttacttctggtgtgcaccacacattaaggacgtatgtaggtgagccttactctaaatgataaaaggattactaaaaatgtcatgccatgactgtgtgaaaacaaaatcataaatgaaatgtaccaaagaagctgacataccaatattctctgttacctctattctaccagtttttaaattagctttaggaacaaaaaaatgtcaggcattgggacagggttataggaagaaacacttggtgagttcctcatcacattcggaactctatccatttttctttcttttttttttttttttttttttttttttgagacggtgtctcactctgtcacccaggccgaagagcagtggcctgatctcggctcactgcaacctccgccctcagagttcaagcgatttcctgtctcagcctcccgagtagctgggattacaggcacctgccaccacgcctggctaatttttgtattttaatagagacggggtttcaccatcttggccaggctggtcttgaactcctgacctggtgatccacccgccttggcctcccaaagtgctgggattacaggcatgagccaccatgcccggcctccatttttttttttttttttttttttttactttaggagacagggtctcattacattgcccaggctggtcttgaattcctgagctcaagcagtcctcccaccttggtctcctgagtagccgggattataggggtgtgccaccatgcccaacttgaactctatccttttatataacttatctccttgaattcttgcaacagtcctaagtgttaggtactcaaatctccaaaatgaggaaatgaagcaaaaaggagagactgggttcacattcaggctccaaatgccacacatcatctttgtcatatcacactaaagagcaaaagagctatttaagtctcttttataaatgcaaacttcaaagccttacttttaaggaattgttagatcattttagacctgtatgtttacctactatatattgaaataaaaactggccagtgacctacctttaaaacctagctttaaaaccctaatgctataaaatcaaactctcggccaggtgtggtggctcatgcctgtaatcccagcattttgggaggccaaggtgggtggatcacctgaggtcaggagttcaagaccatcctggctaacacagtgaaaccctgtctctactaaaaacacaaaaagttagccgggcgtggtggtgggcatctgtaatcccagctacttgggaggctgaggcaggagaattgcttgaacccaggaggcggaggttgcagtgagcctcagatcgcgccactgcactccagcctgggcgataagagcaaaactctatctcaagaaaaaaaaaaaaaaatcaaattctcctggctttaatacatgtcaaatgcaataaccttgaaaagaggaagagggtattgtaaattctatgtgacaactccttagaaagcatggtatgtgatatgtagactgctgaagttcttaactcttcttttttaaaaattagagttggtttacagaaaagtgatagagaattaatatttctccttcaaacaactatgactcaaaagtgagttcttagacttagaaattcatcctgaacaacagtgtatcatctctatcacaaagctaccagcgtctgtgaattgtgatgagaataaaggagacagtgctgggagcaggaggagaccccattttgatgggcacaaagcaagcgcatccattttggccaatttaaggacccacaagttttcctctcatgatcttgcaagcttgcctttctctcactgttccctttccttcgtttgtgtctttgtcctattctttccattacccccttgttacggaatgagtgcttgtgtgcccctaaaattcatttcaatatcctaacccaatatgtgttggtatttggaggccgggcctgtgggaggtgattaggtcgtgagggtggagcactcaacactcacaaatgagactagtgcctttacaaagggcactgatgcaacctagaagaagactctcaccagaccccaaccatgctggcatcctgatctcagacttccagcctccagaattgtgagaaataaatttgtgttgtctataagccacccagtctatggtactttgttatggcagcctgaattgatgaagaaacccctagttctatgtatacagtgggccctagaaacaaaaccaagtaataacaacaaaatggaatttaaaaagatgtattaagtgctggttctgtgaggcactatgctaagggcatcatgcgtgttcactcattcaagccagcaacaactgcaggaagcagtgtcactattttataggtagggaaactgagcagagaaagggtatgcaacctgcccagggccacaaagctctcatgatagagcatgatttgagtgctgggtaggcagagcaaccacgtggtataattctaggggcaccatgttgtgatgttctgtggagttgccctccggaggcacttggagctgtgtgctctagcagccttttggatcagccatgaacttaactgttaggctacactgttactctagaccttattcctatgttgagggatagacaggcatacatttgcgaacctgtacctggggcctctagtgagagaagccacatggaagctggtcctcatgctgctccaggcactaggtctgacccctatcaacagggacccattcatcttaagggtgcctcactgactctttttaatacttctttgcccttcccaggactactgccacagtacagccaggttccaacttcagggggagtgagcctagagggtggggcctgagtggtcagctgcagagggaggaaaggcacaagcactgccttttctgagtgtctcaaatcttactaatgtcaaaatctcaaccatcattattattactagcactgaggttttaagggcccactttttcaaaatgggctcagaaaggggaaccttcccctgctactgccctcatccctccatccctatgccatgttcccaccttggtttgctatgcttgggcaagaaaaacgacttcccagttttagtcagttcatttcctgttgtgctttgtgaggagcccagcagcactaagtggtaacaacagttaattagtttccctttctagataaggtatttctgtgtcccccttgtccctaggcctcaggtcaggagcttgtgggtacgaatgaggccatattcaccttaatttcttaatttctgtggctcataattccctctggtattgctccaggacccccttactatgtatacatttctaggagcttctatgaggtctgtcacatatgcttaagatcaagtgtgtgccctttgagtgtagctactctctcctgttaatctgtgcctggcatctgctgggatggctgggcagctgccctgaccactgagcacccaaccatctgttgtcagccacaacaatttccactggtacctgatgctgctcttctgggagaatgctgctccacctgtgaggccagctcatatgtgacctcaagctaaaaaagcttccagggaccaaaatagcactgcattctgcccaaatagcaatgtcagttcttgcttattgcaaaattgggggttgagggtagttcctcttgataggggtcagatttagtgcctggagcagcgtgaagaccagcttccatgtggcttctctcactagaggcctcaggtacaggttcataaatgtaggcctgtccattcctcaacttaggaaagtgcatagaaacagagggatccggttccacacctccaactcagtttagactcatttatgttgaatttgaattttggcagaagaaatcagttactcaaagtatttattttagcatataggaattgttattgttcatctctctttctctttattttttggagacagtcttactctgttgcccaggctggagtgcagtggcgcgatctcggctcactgcaacctctgcctcctgggttcaagcgattctcctgcctcagattcccgagtagcttggattacaggtgctcgccaccatgctaagttttgtatttttagtagagatggggtttcgccatgttggccaggctggtcttgaactcctggcctcaagtgatccacccaccttggcctcccaaagtgctgagattacaagcgtgagccaccactcctggccctattgttcatctcttgatcaatatcaagaacaaaactggttaaccatatatgtactataaaatgataattggaagtcatcaccaataatatgttgaaagagaaacatgaagaagagatcaataatttaacattcattgaaatacaagtttcacttgatgacattcagaaaagatgacattaacaatgattccagaatcaactctaatgtggtgaccacaaacacagacagacgtctggacatgataaagttaaatttcaagcaaagtgtactcactaataacttaataagagctcctcagcacattatgggttggagctcaaggaagacacttgaatccaatgacgaattgttttagtttggagaatatgctaattttcttctggtaataattttagaaaacataggttttcttttccaggcaattattttaatgaatcaattggggtttcaagaaatagtcaaaagagttcaatttggtttcaggttcagcaaaatgagatcatgcattctgtttttggttcagctggggtcaagtcctgtgcctaaaacagactaataggaattgagataattttatttttatgcacttggctcctctcatctttcctcctatttttctttcccaaacatctatagatcccaacgttttgatctcattgaactttttctgcattgtatattaacttctctcccctcccaaactgagtttattctcagctctctcagtcctttattggactactggtacaatgttgcttcctacacacaagtgggatattgatgaaccaacacgttactccttttatttatgccttcactcttattaaactaaatgatgacatattatatcatgctaataacacatgtgtggaaccagaatgggaagtgacttgaaagtaacatcatctctcaaaatacaaatgcccagagcaatgctcaaatgagtataagcacatagttaaatggttaaaaataatgtacatcagtaaaaaacgtaaatcggtaaaaatgttccaaataacagcttagacaatttgtgagatcaatgatagaaatgataatgtagagaagaaagaatttctttaacattttcaaattgcagcatgaaattggtgttggtgttatattgactcttggcagaaatggtttcttcctagacacatgaagaataagctccagatctttcttacctgttatggtggctttgttgatggatggttggttgcacatgggtgatcttctgacaaagacagaaaaacacaaagcagtaaatatgtggggcttattgatttgatcactctctgagtcatttcagatatagcattttactttaaagaattatttttaagtttggacacgcaaatgatttctttcagactagccagacaagtccctaggcgttctttgtattatggctcagatcacacatgtccaaaaagaaaactggtaaatctcacagtgattgatttggggtaaataaagctgatgtaagtgtcactgggacatgagagaagaggaaattcttacagactttattcgctgaagccagagcttatagactctgaatttgaaaaagcagtcaatttataattgtcttccctaatacagggttaagaaatttttattgttggcctaaattctcgtgattgcctgtacattatcagaagtgaatgatttgttgtaaactatcttataattagagaagctatttgaactttttcctttcttttcttatattgaaaaacacctctgatatatttgttagagaggtatattaatgacttgtccaaatagatactatagaagctttagaaatactctaagccaaaggtacttaaataaattatatcttgtgttctctaagttttcagatgtttgccaagttccacaaaatgactataaaccccttgaagtaaaaaaaaaaagcatgctgtctgattaacttatattccctacagagcctagcacaatgcatccagtattccgtcagtgcttaataaattatgttgaaaagaatatcatttataaagtatccatcaacatttttgaaatataactttataaagttattacttgtaactgacagcttttaaaatataatgattaaaaaacacttttagatacattcaaagatgtctgatatatatatatatatatatatatatattaggtatataataattatatatatattgcctctaccaagggtgaacacttaataaacacttcttgtggatcagacattgctaaataagtactttaaatgaattatctcattgaatccttacaataagccttaaggaagtaagtttcattgttctcattttaccaatgagaaaaacaaaactttgagaatttgaagaacttgttttaagtaacgaagctgagatttgaactaaacgaatgtgatcctagggtctatgctctgctttgctgccttagtttgagatgtttttgtggaacctgcatgcacagcctcacatatgtgccaatggcatcaatctcttcaaatatgccttgctgagatgatgaatttcttagcagggtgggggaaagttggggaaagcagcctgggattttgtaaattctcactggttccactcagcctctggctccctttcattgctcctaaggttattggtatcgatttgggattaaaattttgtgtttgattgaaaatgcaccaaattttacttctgaattattttagttttttttagttataaaataaaatggttgggggaaaaatggggagaatttaaactcgataaaccaaaatattaatattttaagcagctgctctgaaatagctctggtctatataccagtaattatcttcttcttcttaaatttttttttttttaaagttttgagatagggtctcactctgttgctcaggctggagtgcagtggtgtgatcatagctcactacagcctagaactcctgagctctagtgattccccccaccacctcagcctctcaagtagctgggactacaggtgcatgccaccatgcttggctaattaatttttttttttttagagatggggtcttgctgtgtgtaacagggtgttatctgttaccttctggctaagagtttatcattcaaataattgatatcctgattactcctttttagtccttgctctgtgaaaatttagaaaccattgattttgtctgggaatggtattaaataaatattttcacactcttctacagttttggaaaaccaaatggttgactcaattctaattatctccttttactatcaatcctacaattaactggtactcaggaacttgatatctgaacaagtaatggcaagcagaaaatattaatactttgatccatggttgcctcgatacctcctctaatgacagatgagccagaactcacttctggaataaaaaatctcaagggcaaaacaaaaacaaaaaacccaaggtgacaagaagcagtaatgtgttaacaagtcagcaatgtgcatctgaatacccacccaggggctgggtttggaatgcattcttcctagactccttttctgcagcaaataaaaagggtggcttgtgcaaaggagcacatgccttccataaaatccaaggatgagcttggaaatgttctagtggctctgtgagtgcccagcaggaaaggttctgattctcccagggtcatcatgtgatgaggcagagttacagcactttgttctcactgaacagaatcgagtttagccgtgaatagattgaatcctactattctgatacccaaagaagccgatttggtttgaatcagtaatggaggcacaaatttgcattgaccaaaaggaagaccacagtggcctttacttagagtctgccagataatactgtttggttagatgtcaccctgggcattgacaaggcagagaggaagttcaggctcaagctatgattttctgttttcttctagctcctcctttccatttcaatctgttccatccctgtatgtcagctgaaaacttctgtcttgcatagaaacaggcctcagatcgtctctggagcctgactgatcaactatttacctgccacagatttaaatgctggtacccaggtgaccacatgtaaaggaagcataaagggagtttcttgttcactttttaaagacaaaaatctcagtttcctgggtaaaattcgagactaaaaagtttgggagtgacaaccagttaacttcatttcttctgcagagctgagactttctaagggggaggtgattgaccttacaagctaccaaatccccaaagcccaagggggccgctgaggtcagtatgacattgcacggccacgttacatagaaaacgtgattggtaatgaacaggtacctcaaagcatgccctcagattttacatgctgagttactactttgccctttcagcgaacaggcctttgcagactgatagactctgcattatgctaggcacagggaatacaaatgtgaaccgactacattcctactcactgggaactgacagtgttcaggagcatcccaacagacaaacaggcaacaggagcacagagagctacgtgctaacataggaatcaagtacaaggtacaatcagacagagatggaaaggcacatcactttgattagggcttgtgggtgtgtgtctatgttgggtatcatcagggacaatgctccaagagaaattttatttaagctgcaaccaaaagaatgaatgacaattatcccagtagatgaggagaggaagaagaagatgagaagtattcaggctgagagaataggactgcaaaaattcattacctggaaaaacagaacctaatgggttccattccaatagcttgcattgttacatttatattgatttttaaaaacttttttctatcacaagaagtacttgaataacggccagagctatttttgataatgaaaaacgtgaatctgggaggtcaattttattactatgaaatgtaaagttcagatttctcattgtttttaagaagtagtaactactatgaaatgttatgcacttaggtaagttatagttcctaatacacttatatttactatcctcttaatatgatttaaatgttttttttccttctggaaaattatttgaagttggcattttaatattttatttcatattaatagcagattttttttaaaaaaatggacattgaaataacagcaaaccagttttccatttaatattgaaaaattacttttatctttttagatttttttgcctttatcaagaacctgaaatgataatcctttcccatctttcaaatgctttccctgttgtcatataaaccacaattctattaattgctccatgaatgctgctgatctgaaagtcagtaacagcaggagaatcaaagatctttgctatgatatggcgcttctccaaatcatcgttgtcttgagaggatgactttcagctgatcttaaggtgtgatgagattattcacccacggttaatttatgaagtaagccgaaactataaagttaccctgagtgtaaataactgggcggaggactgatcatgccaggtgatttctgacagatggaatcaccatatttatttgtcatactgcttcatttctgatattagaaccatcaccacgaagtatttatagaaaattaacaggacatcatatgacttagtatacacagacaacatggcaacaacacagagaagtctaacatattgccttgggctcaatcaagttgagaaaacttatttaaaagttcagcaaaaaagaggggggaaaaaaggatatcttacttgctaggtgctcgatcttgcaaattagttaatgcagcaaagttgtttcgtacagttcgcagactggccaagacctacaacaagaaaggattcttgaaacttcttgagctaaggccattttaaatacacttgaaaatggtttgttaagagaaaacttgatattgcttgcaacttagtttcatataccactaaagaatctcccaacacttagtgcagtttgtaggtatccacacgaaatccagagaggccagactgcagaaattttccagaaatccctccacattgtctatgcacatggtgacagtagcagcagtttccacagtatttctgggttccttagtcaccaagacaatattccaggcaatacacagataacatgattgcatttttgcacatttcaaatagtataatataaaatgctaataaagctcactttagggataaaaaattccctactcccaaatctcttcaaaaattgatgaagaatctcataataataagttggcaagtgaagtgaattttaaactgtttttctacctttgccacatggctactctagctagtaagcagacattgttttcttttgttaaggttatctgaattgtgcattgtaagaagctctcagggatgcgtttcttatgtaaaatgctacgccctgtacatgcacaatgcttggcacacagaagatactcaataaaaatttgttgactaaatgaatacatagacacaacatgcccacacacataacaaggcaggaccaataggtgtcactatctctaacagtcgctttttctaattccagttggaactagaaagtagccaacggactggaagtgagcctaggagaaggttcctagagccttatctccttcttccctcctctctttctcctgaaatgggcaagtttccccagggtcaaacccatattagatgggattataggtgatttgggtgacagctagagtgctaagtttatgtaaaacacagattccaaatgtctgagtaggtattacctaacaacccagactgtctggctctgttatgtagtaaatgtgtgaacttggactagatatgcaacctctttgtacctcagcttcctaacctggaaaactgggatagtgatacctacctcgtagaattgttgtgaggagtatatggaatgacaggtttggtgccaagaacagtgcctggcaaatagaaagcattcagccaatattagcccatgatggcagcgttacctttgacttaatgacttggcatgcacttgggaaatttacttaatgcctagcattggtaattcaagagtctccaaagttttaattgcttcaaagtttccagagttgttttcagaaatgtttcatctggcacagacctagactaaaatcagtctaattttttttctaagacaaaaatgtcccagactctgttttgttgttgctgtttatgaaattgacattcatttgtgtaagtcaatggagagctgtgtacgccttgggacagtgacttagagaattttcccctaaaggagttaatgctgcttcctaagaagccaaccgtgattaactcagtcactggaaaaacctggctcattatctcatataaacaacccacggctctgaaaggtcacgctgcctatgatggagtattcaaatggccgactgctgacatcagaccacgatgtctttcattaggcatgaaatcttgaatgatgcagaagtaaatcggataaatgatccactgtcgttaaatcatgcaggcttaatttatgttttaagaagtgaatatcaaacatactaatggaaactttaagataaaatcattgcaccagctaattgatccccttcctaggcaaaatttttaaccctagaattctgagatttttattccaatacataatagttaagttcattgcagttgacagctgggtaaatagacatagaaatgcaggcaacttattttctatgatcatttgaagggaaacatcagtcatgaaaagaaaaattagttcatcaaagaaaaaatttctgtagaggagtttttgcctctattataataaacttctaatttaataagtaatctaatttaatattattttgtctttgtttttagtttaaaatttatgtatttttgtataatttatatcttcacatgcttcagaatttaaacaaaagagtataaagcaaaaagtctccccttcaatgattaagataaaaatcaaaattattattacttctgaaaagacgcaatagaaacagattaacctggggagggacactcaggggacattaaaatactgataactgttctatttcttaaactgttcattttagtattattctttatattttacataattacaagctatattcccttatatatatgaaatacttcaaaataaaaagtgaaaaaaggaatctgtcttccggtctctccttcagacaatcagctgcctggccactagcaatcaacttttaggttttctatcttaaagttgtttttgtacaaacactgttgcaataaataatcttgtagagaaattatttcctaggcatgccagtattagattatttattgtgtgtgtgtgggtttttttttcttttgcagcaggacaaactattttataaattttatgtttggtgttaactattatcttctacagtatgacatgtatgctattggcagaagtgtaaataacatttctagacaaatcttataagggggtgttgtcttgggcctcgctgactgactcttggtgtcgtcatcactgttatcactgtgttagtcttttaagctttcactttgcattgcagggcacaaagagggagcatctgttactgcaggctgtggggagaactataaacagttttactgaagcccctaagttaaagttccattgttctttgcttttgttcagggcagccctcacttcccctgaattcgactctttaagaactgtagtcaaagctttaaggctccttttacagttgtccttactccttaatgcttgctaaccaaaaagatccctgacgtttcttccacagagctcaatggttagaaaattaaggtcatttctttctcttctgccccaccaagcagaagtatagccagtcaatgtcaaaattacattgggaatgatgagaaatatatattccttaggaaggaaatactggtagttttacagaaaaattttagacaaagatggttcatgtattagcccatggggaaggattcaatgttatttacgtacactactctcggatcttcttaggtgcttctaaacatttattaaacaataagaatcactgaaaatagcaggaaaatacggttatcatttaacacttaaacagctgaacatcatagcctaaaaaaaaagaggaaaataaatggtttcgaggattgtttttcataaccatatacacttgttaccactagatggcggtaaaacacagaccatgaggttgaggtgccactggcggcggaggaagcggcgacccgcactgggagagattcattacttcggttttacctccggaaaaagctggagtcaagttatgcttatttacaaaatagaaaggtcatttttatgaaaagaaaacctctttccaggttatgttttgtttaaaccctatgaaattgctggtttgtacaccagaaaaggttgatagacaattttatatggttcgctcttaaaaagaacttagatgtccagaagatagtagttgtaatttaaattaattaaggctaaagaaaagctaaaaatttagcaccgactgaaacgaggtgactatcttctttcatagcctggcagggagggcctagcacagtctgcaagcttgaggatggtgatgaggccacaagatcgttgctgctgggtgaagtggctgagggacaggcaggaatatgagaatattggttatattttattaccaactaaatggtaatattctatagtattaataactactgcatttttatcctagaagtatcccaggtgctgtattttggttagagtaaaggtaaagagatgtagttgttcctaccccgtttttttttttgttttttttgtttttttttttttgagacggagttttgctcttgttgcccaggatggagtgcaatggcgcgatctcggctcactgcaacctctgcctcctgggttcaagttattctcccgcctctgtattttcaaatcagggatatctccttagtctgaatgaagtgagggtttctccagggatccagcataatgcttgggttttcctgttttctctttctttcatcagagtctacttcatttaacattacacacttccacatgaaaattctagtcaacttagagttttactacagggtagttgtgtcacaaatcctgggatcactgagcccggaggcagctgacagcagagaagagtttcctacagtttatcagcattgtgcctccttagtgctccttggcccccaagaactctggccaagaaaaaaaggtcagttgccgcgtgcactccagtgggattcctctctagccttcgtgctaaggaaacacccacaccaaaagatttcaacacaaacacaagagaatactttaacaattgaaataagaaaaatatttaaagctgtcactttttctgaggaccaaagggattctgagcttacaggggaaagcataagaaatcagaggtggaaaagagtttaggttaaacaccagcaagaatttctagccctgacagtgttttagacaatgggataaactatggagagatactataggatcctttctgaaaattactatccaagatgtttcaggctttagcctggccaaaaaagtgcaatctatctttgcacggcttcctaaattctcctctaatttaggattttgctcttttcacgtcaaaggaaaccatgatttggaaaccatgattcgtgttttggagatggactcaggcataaagaaatgagttctcaagaagaggcagaagatgagatggatttgggaggggatctttgaacaccttagacaggggaaggccatttttaggagccatgggacagaaaatatgcacagaaaaataaatctgaagggatataaaataaaatgtcagtagcagttattttggggtttggaattttagaaaattttccttttctttttcttattatttttctaaacttttatgcaaaaagtttttgttttgttttgtctttttgagaagcatagctttttcactggaatttagtgtgaaattccaattttcaaagcatgctgagaaaagagggtaattctttggcctacttggctaaatatttttctgagtgacttttctaaaatccattgttttctgtcctttggtgaaagcaattatggtatatcaggacaaattagattggtatcacttcaagtgacataagtatcttatatttttagttttaaatagttaatgctaaaatagcacttaccattaagtggtaagtgctttactttgtattaaagaaaatttgagaagttagtgattgggtcagcaaaacatgccaatcatgtccaacagggtttaagagaaggccactcaaacatactcactgggacttctctcttaacccctccccacagatgctctatgaagagtggtgaaactcttcagggcttaacagttttttgttttgttttgtttttaattctagtggggctttccaggtcttatactccagtaaaaggccatttgtgaaaaccatgatgaagccccttaaaaaaaatcggcagcctctcaagtaatgaccactctctacaaggtgttatgagtcacttagctaatcataagcaaagacttaatatactatgggattatttttaggcatcagatatgcctataaattatacagctgatttatattccaagttctaatttcaagtatattaagtacacatcttttttatttaaatagcttactaacatggactaaattacatatatgtgtgtatttcccaatatcttgaaattccattagttttttttccttggagattataggtacactacagaaaatatctaatcaggtaaaagactagatttccttggaatttaagagcactgatggcagggttcaagtccaatttactaatctatttgttgcagcttaataaatattacttgatgtaaaagaccatatatcatacacagaccttttttcatttgttattaaatatttatatatattttttcttataataatacctagatcatttggttagaaacaagaatagctacttgaatgaactcaaattggaatgattggttctatgtttgatgatgttacttacattgttatgccatattttgtctgttcacctctctctgaggtcttagatatagaattataagttttctttctttcctttttttttcttgacagagtcttgctctgtcacccaggctggagtgcagtggcatgatcttggctcactgcaacctccacctcccgggttcaagcaattatcctgcctcagcctcccaagtagctgggattacaggcacccgtcaccatgcctggctaatttttttgtatttttagtagagacagggtttcatcaagttggccaggctggtctcgaactcctgacctcaggtgatccacccacctcagcttcccaaagtgctgggattacaggtacgagccaccgcacccggccataagttttcaatagtaatcaattaaaaaccctcagctttataagattttgctatcacatcatattattaaatcatacaagtgtaaattttttggacacagaaatacaggtactagaaagaattcataatctccagcaaaaccttcagcaaacaagatattaaccatctgaaaaggatggtgattgtattttatttttaattgcctgcattaatttaaaaagttactattatacattatgttacttatgaattgattatattataggtctaagttacagtaataaaagtttggaaagttttaaaaagtagaactatacataatcctactatctaaaccctattatccatttaaaaaataatacttatgacattttagaaatgaaagaacattttcagctctatacatttaaaccaatcacaaagtttttataatattatattttcaagcaattgtgcctagcattttataagcgtggtattatttcagtgtcttagcaatcttatgaggtgggtactcttggaactgttatttaacagaggaagagaccaggcttggaaaagttcagtgactcgctcaagtccattgagttggcaagaggcggtgaaagggttttaactagatctgactgtctttcatccagctcagtcccctaactctaccagttgaaaaaaaagaggacccagaaaatttaagtgagttgtccaaggtgcaagagcaccttgatgtatgatataggcctgattataatttttacaacctctcaggattacttgcattttaatatttaacatttcttactcatcagtgttggttttaaacctgcttcatgccccaggttaaatcagttttatctcattccgcccttagttgtctataccagagactctcaacttctcctgcacactagaaaaatactaaggcctttaacaaatacagatgcttgtaacagatctccaaatttttggatttaattgaccagggctgcagcctgggcactgggataagaggtctctaggttaatctaacgtgcaggtagggttgagaagtattggtctatacatagaacatctggtcatcaactctttcatatttatattcccaaacattttagatcatgttatcacctgcttgcacatatgtcatgtggttaaagtattttcatgatttgtatgcctagaaggaagaagtaaacatcaacacatcactcagctaaatctctgcacaaatggcatatgtaaaaaagagataaataaggtattgggttgaattggaatattgaatttcaagcactgatcatgtacctaattatactaaacataacttaagccatgatatagccttctgcttctagtgcttatgtcagtatgagcccaattaagtatatcccttagctaatttattatttgaagcaaagacactctttggtactatgggtttataggaaacagattaatatagccaaagtcactttctctagcattgcttttgaattgcttgaatgaaccaagaatttgtatttgtacttgtgcttgatttaaaattaaattaaattaataacccgaactaattccccaaattaaatttttacatctgtgagaaacctgcccattcaccaagctgtgcttacctgagcaaatggagtcacaatcaagtcatctccgtgtctgaaaaataaaccaaatcccgcattagaaatcatcaataactctgtgctcagtgtcgttcaatattaaacggcaagttccactttcatgagttcccatagagaattacagtgattccatccttatacttcagcacatgttcttcccagcaactgggttaaaaatatgtcttctgggatgttaacaattgtccaactccctgggtaaaaagaggggcttcttgatcatcagccagggtcactgttgctttttaggcacacaggatatgcaatagtagaaatggtgttccagcagtggggcctgagttttacttttggcctcttactgtagatattagtaaggggtgctgtggaaggaaccagcaatgcagtgacttcagtgagagaacccttgaccatctaatatttgaaggtgattagcatggagtgttccacatcatcccgtgtaagtcttggacaggctaggaactgtagatgacatgggactgcatcatacactaataaaaacccagtgaaatgttcaactgactcatcccagccactgtagtcactgggaaatgttactccttgtgtgctgttgctgcagcaaccccagctacaccgtgcctggggtatgggagcaaggtgtcagcatgacgtgtcttggagggacagggaagggcaaggaaagttgtgcaacattccagttagaggaaagtgagaaactggggcccagggttcttttgtggtatttcttagcatgaataatttgagacaaggatttccagagtcaccatcagctatttcttgatctagctagataaaattcttaaatcaaaagtgaatgctgttattcaacacagacagctccctggacatggccctgagaacagtgcaaataaacttttcgctcactcatgaacaatctgaaaacaacctgagtgacccaaaacaacacccatgaaacatgctggggcacagggagcatatggatgatgttactcaataaattgttaccaatagctagaataggtgctgtggtcgtcatcaaaccatgtggagatcttgaaaataaaaatgtgggaaataaaagcagaagaaggaaaaaacaatgtaaaggaagcatgtgttattttacacccccttagttccagaatcatgtttttcaaggggcacctgctctttgtagagattattcatagaactctagaactctaagaaggtaggacattgggttttatgatcattttatagaagaggcaactgaggttcagagagggcataaggtctaaaaactaataagtggtagaggcaggatgtcaattgaaaaaggtattttcccatgttgatgtttaattgccattgcaacagtattaagaggtgggggcctgtgagaagtaattaggtcaggagggcttcacactcatgaatgaattaatgctgttatggtgggagggggttagttatcataagagtgggttgttataaagtgagcccagcccctcatgttttctcttttgcatgtgctcacttgcccttccatttttccattgtttgggatgatgcatcccaaatatcctaatcagatgctgatgccatgtccttgaactacccagcctctagaactgtaagatataaacttcttttctatataaattaccctgtctatgctattctgttatagcaacagaaactggactaagatagtgttcttctgtcatcaataaataatttacataatttaccttgactctcaaaaaaaaaaggtcttctgaggtcaagcccagaaaggctctttcctagaacaatggcccagggtaggagcaggcctggtgcactgaagtggcaaggaggccattgagcccgtgggagccagcagagagggatgaagccaaggaggcagagcagctgcctagatgagaaagaagcagatacagagctgcaacgagaagctcggtgattctagagaatgccatggaaggcaggaaattcagaatcatgggtggtaacgagccaggcagcagatcacagagcccttgtatgaaatgtacaagaacttggattttactctctgatggaagtttgggttggaatttcagctctgccacatactaggtgtgtgaaattgtgcaagttattaaacttcactttcccttggcctcttcatctgtaaaatggagataacagcacatacatagagtgatgttttgggattcaataaattaataatgttaagtgctgaaaaatgtgcttaccacacagtaaatgttcaataaacatttctataataataattagcagcagtagtaaaaccttttaaatcataatgatttttgctttcctatgcagtcaggaaattgcaaagactcagaaaactgatacttcgctaagaaggactcttgagaccctgtgacaggtctataaaagattgagggctttaaaggggcaaaaatggaagcagggagaccagtgtagagaaaagaagagatgaggacctaaactaaatcagtggtagttgagagagagagagagagggacgatgacagcattaaaagctctgggggaaagaaaaagttctggggaaaaaaagatatgaaaatttcaagcatttacaaaagtaaaaagaatgttatcacagcaagtgtattttatatacaatcatcagctgttacaacaatgttgcaaggtaggtgacattactcccatttttcagatgagaaaattgtagctcaaattgattaagagatttaacacaaagacacgcaggtagtaagctgcacagccatacctggaatggtccccttttgtgatatgcattggctgattcctatggaacagcttaaaaagattaaaaataaagctctaggaaaatggcccaataaatgcaaattacaaagtgatgccagggttggccagctacatttcttccttggcccatcattctgactttcccttctggctgtgtcatataggtaaatatagggctgcaatttctcttatgtacttattttgaaacagtagcctaactctcacaaaacaactgagaaatatttacagatacaccagtgtttaaaaagcatgaagacaaaatccagagctaaacacttcagcatttgacaaatttctacacacataaaggcacctttagagttcatttgaagccaaacattcttgggagtggtggacaaatcagtaaactgtgtagtgtgttagaagtccgaagacaaaaaacattttcaataggtgtatatactacatatattgcattcaagatagttcaatggtttctgacattaaaaaatgttattaaaaattccataatgggaggtatattacacaaggagaaaagacatgccacctatgccgacttgatttgccagtctgataaactattcatctgcttcagtgcatggccaagctgaagacattgtattgtaaaatggatgagaggcagttcagataaccaaaattaaaataatatgacatcttcttattgtcccaagctatagtctcttctttcattttattctttataattgacctactataaagtttatttttttcaggactaagtcatcttgacaaggcacatcatcaatctgaaatgaatccatggaaatatgtctcctaattttttatatagattgcagtggatttgaatctttcaaaactcaaaagggttgcatatttattaaaacatttaattttctctttggttgtatctcctttataagtattataagtaatacactttacaatatttatgataatttaccagccttttttccctatgaaagcataaagacagttatcattttagtgaaggaaatatattactttttaataaattgcccagaaattgtttctgccaaatatctcaagatggtctcattttagtaacagtaaaatgatacctagcatttcagtggcagatgtcctcgataaacggcaggttatagcctatccatttattttcaaaagtatgtcatgcttaaattatctttgaatatatacctaacatataattttaaaatctttgtctaagtcctcaactcaatattaaaacagatcttttcagacatactgtcactaggagaataaggcaagtaaaacctatttttatttgtggttagaagaaaataaatataatacaaacatatctttgaattgtgtcttacactttgcttataatcatttaaaaacagatctggtagttaagatcaacagaagattcactttgtgaatatgatttggtttaaagtatgtgtgggttttaatgaactgaataatcacatatgctcaaaaaaatcctatgaaataaaataattctgaaatcttgcacctgaacaactttacccacagaagctttttaaagcgccttgccacgtaaagtggggctgggagggattacaatacaatgtaataaattggggcttcctaggcctacttggctaaatatttttctgagtctcttctgagatgggaagagactattagggtctctataaagtgactgaaaagctagattcaaagtcacacagtgaatatcgcctggacattttgaaattgtaccgcctggtaatgtgaattttgggtgaggatgatgcaatactgtctttcatttaaataaaaacaattataacaacaacaacccttaacaaaaaacagctgtgatctgttttaaggaaaatacagctcttttaaaaaaaagaactggagtgttcatggaggacaggcggagaatgaatgagggataggaaggctcagaaaaaaagtcattttgacactgcgtgtctatatgtatgtatgtatgcacacatgtatacatgtatgtatgtatgcacatatgtatgtatgtgagagatgagattggtaccaaggtaacagtcacagcagaatgcaagtgcagaaacttctagaacagccaggatgagccactgtaggtcactgtgggagtcagtgtcacattggttttaaatttcatgatgtccaaggaggtgccacatgctctgtcaccttccctggttaccaggaagtgaaccagagtcatcttcactagtcctggcgagccttgtctctcccaaagagaaagacttgctgagtcctgagccagcgctgttgaaagcaggagaatacagggctcaacagtatactattgtctttttttttctcacaagagaaatgacagtagagtcaggaacttctattctctattccccctcccatccttcttctacttctgtattatttatcacgttattttctaccctttttctttctgtaataaggaaacagaaacaagcaagaaactaaaagcaagaaatccaaatgcccacactcttatggtgactttgttgagatccatatatggttcaagtacttaaaaatgaaaaagcctgttgtcatcttaaaaaaataagttcaaccaacatcagcacctgaaaatataatttcctatagaagttcatttcatgattggttgaaatcttaaacacactaggtggcaatctttatctgttttactattacgaaatcataaggaaaaggagatacagttaattagaagaaagtttttactttatggagcaaagacccctaatcctactatatttaaagcattagtggccatgtaagacccactgcttttgaatatcacacattgcaaattttagcatgacaaatgaatgcatgaactagcactgtgaaggagtcacaggctggggcttacgtttgaatctaatcctttttttttttttttcaatggcatggaggtttgctatgttgcccagactggccttgaactcctgggctgaagtgatcttcctgtctcagtctatggggtgcctaggattacaggtgtgcaccaccgcgctggccgaatggaatcttgtgcaaacttttttcatcttctgtgcttcactcactcttactagaaagatattctcctctgaagtttgtcaataggattaggaaattgataaacatatagaaaattaaaataatatttttgaaatatattttaaagtccaagattttgataattttgaaatcttagtatctttctttcctcagcctaaaaactatcatccatctatcaattcacccttgacaacttcttttagaattatagagaaacaagtatgttctaattttaaaatgaatataaaaatatttctgggagcctagactatttgacaacacccaaggattagctataggaggaccacgtctactcacaactctctagacccatcttcatagaagtatggacatataaaacaaacatataatgtaacctacttgatctttatgtgtgtgtatgtgtatatgtatatatacatacatgtacatatatacatacatctatatacacatgtacatatatacatatatgcatgtatatatacacacaggcacatatatacatatatacatacatgtatacatacaggcacatacatacatatatacacatgcatacatgcatgcaacatacatacatgcacatatacatacatgcacacacacgtatgtacacacatgcatgtacacacacgtatgcacacatacatgtatgtagacatacatgtatgcacacacatacatgcatgtagacatacatgtatgtacacgtatatgtatatataagtatacacgtgtatgtatatatgtatacatacacgtgtatgtatagatacacgtgtatgtatacatacatatgtgtatgtacagctacacgtatacatacatatgtgtatgtacagctacaagtatacatacatatgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagctacacgtatacatacacgtgtatgtacagatacacgtatacatacacgtgtatgtacagatacacgtatacatacatatgtgtatgtatagatacacgtatacatacatatgtgtatgtatagatacacgtatacatacatatgtgtatgtatatatatacatacacacatatgaagtacatgcatacatatacatactttgggagatatagaacaacttaaagaaccattcaaagataactattgataacattttcccactgcatgtatgtgagcacatgtatgcaatatagtatgtgactattatggactacatacttccttatagaattagagtcatagtgtatattcaactgtatatcttgcttttagcattaaacattaatgaaccataaaaattatacatgcctttattcttttaaaatattgttaatgattccaatctatattcggtaatctctaaaatttttcaagttatgtgaatccaaatgtattaaaatgtaagcattgattctatttttaaataaattaaaaaataatcatatgggtttttcagacgaatttcagttcatttatcattcattcatttttaaaaagctacttattaaaggaaacatgcttattttaattaaatatacataagacaaaggtaaatattaaaatgctacatgagaaactgggctgcacaggtaattcatgggaatgttaagtattttatattgctacctgcttaaattaaaatcatgaaactctaatttcagacaacaaaaattctgtaaaatgtgactaccaagaaaattttgcaaaaccaaattattttttccatatagcgtttaaaagagatgatttgtttttccaaaaataatgttcactctgacaaattataaatttaagaatataatgaatgatttaaaattacttataaaggaggcattagatttttttataaactctaagtaatctatatagtaaataaaacaataccaaaaatacataaaaactgtttccttggtattagacatacttgaggatatggatcctctgtattgcttggccttttaatttgaaactagctccatttaagtcaaaataaattaagcagtacatctatttatgaaaccctagggaataaagttcctaatataataaagccaacttcagttacaagtgaatgtgcttttcctctttgaagctattgccacttagaattaaaataatctatttaacacaaaaacttgtattaaaaatcacaactaccaaaactttcaatttggcaagaatgtccagcaaccttttactgagaatcaaagaaaatgtaaattaatatatgagtaacattaaagctgtctagtattgtgtgaggtaacatcttccaaattgaaacttttcaacgccaaactcaggccacctgtttgtatatctgtgtatgcagcttttctggtgttttgatcatttttttttttttttttttttctgagatggagtctcactctgtcgcccaggctggaatgcagtggctgcaatctcggctcactgcaagctccgcctcccgggttcacgccattctcctgcctcagcctctggagtagctgggactacaggcgcctgccaccatgcccagctaatttttttgtatttttagtagagacaggatttcaccgtgttagccaggatggtctcgatctcctgacgtcgtgatccacctgcctcggcctcccaaagtgctgggattacaggcatgatccacagcgcctcgcccgttttgatcattttaaatattttgaaaaaattttaaagagatgtggggtctcactctgttgcccaggctagagtgcagtggcacaattcacagctgactgcagcctcaagctcctggactcaagtgatcctctcacttcagcctcccaagcagttggaattacaagtgcaaaccactatttttatttcttaaagcaggttagaattttttttttttgagatggggttctcatcttgaattttaactccgacaacttccacatgtcctgagaggagcctggtgggagatgactgaattagggggtctggtctttcctgcgttgttctcatagtagtgaatgagtcttatgagatctaattttttaaaaagaggaggtcccctgctcaagctctctctctttgcctgttgccatccacataagatgtgaattgctcctcctcgccttccaccatgattgtgaggcctccccagccacgtggaactctgagtccagttaaacctcttccttttgtaaattgcccagtctcagatatgtctttatcagcagcatgagaacagactagtacagtgaccttcaaagatatttagttttctgaaatttaaactgtttgctcacatcttattaatattttaagaattaagaaacaactcaatggcaaaaaaacaaataacctgattttaaaatgggcaaaaaacctgaataggtctttctcaaaacaatggcctgacacagtggcttacacctgtaatcccagcaccttaggaggctgaggtagcaggatagcttaagcccaggagtttgaaaccagcttgggcaacatcgtgagacaccttctctacaaaaaaattaaaatcaaaacaagacctacaaaaaaaggtcaacaggtatatgtaaaagtgctcaacatcactaatcttaagtgaaatgcaaattaaaaccatgatgagatatcacctgacacctataatagtttttttttaatcaaaaaaaggtaacaaatgttggtgaagacatggagaaaaggaagcctttttacactgttggtgggaatgtaaactagtacagtcactatggaaaacagtatgaagggtcttcaaaaaattaaggataaaactaccatatgatccagcaattctacttctgggtatatatccaaagaaaatgaaatcagtatgtcaaagagatacctgcactcccatgtttggtgcagcattaatcacaatagccaaaatatggaatcaacttaagtgtctaacaacagatgaataaagaaaatgttatatacacacacacacacacacactagaatcctactcaggcttaaaaaggggatatccttccatttatgacaatatggatgttcctagaatacattatgcttagtgaaataagccaggcaagaaagataaataccatgtgatctcacacatatgtggaatctaaaaacaaaatcaaacttatagaagcagagagtagaacagttgttcccagggactggagcagggcctgggggagaatgggaggatgtggaatgggagatgttggtgaaagggtacaaagtttcagttagaaggagaaacaatttcaagagatctactgtacaggctggtgactataattaataatcatgcatagtatacctgaaaattgctgagagtagattttaaatgtactcatcacaaaaaatgataaattgttaggtgatggacctgttaattgcttgatttaatcattccacaatgtatacatatatcaaaatattaccttgtatataataaatgcatataatttgttatttgttgatgaaaaataaatttaaaacaagaattagagcccggccccatctttgaccaaaaaaaaaaaaaaaatctttcaaccaaaaatccttaatttttggctcatgtgtgctcatatcacttgtggaggacaggcactgatgataaagcagatgggactgaagtttacgcaacataagcaaaaaataatctagtctaaaatggaatctctttatttgtcatgagaaaacaatttaggactcattagagaaaatacatgatgccaatgaatgccttcaaatttgttagttatatgatggcacaaagactatctctgttagaaatgatacaccaaaattttccaagttaaataattaaacaaatgtttagcacatgtgtgtagacatattcactaagcatattaggttattttgtttaataaaaaccaatacaatagagagacttttctaggacggctgatgtcccaaattatcaccagaaggtttgagtacaaagctgagagtctgacttccatggagggaagaaagacagcgaaagagttgagtacatgggcagggattcacaagtgctctcactttgtgttctaggaacgggatcttctttcacagtttatcttattggcaggcttgttcttaatgccagtggccctgcccttttggtttttcaccagaatgggatcctagggaaaagatttttggtcaactagtgcaacaattttaaaggtctgcatgtggtgaaaagattcaatagattaaaaggaagcccttgatcaaacagagaggagagcaatgtgttttatgaatgcctactaggcaccagacacggtgttctaccaacatgctgaatttaatcctgacaactctgcattaaatggatgctcatattcccattctaacataaggaactaggccctgacaacttaagttactcattggcagtcatgcccttgacaagctgacagaactcagtggtttccaaatgccactctaagatctggtacttgcccaacagaatgctcagtggtccttgtcaaagtcagagtgtacatggaccatgcagtgagattttttttttaaactatacgtattcctttggaaaattcttttattctgagattatgctctttctttttcactgaagtgaaaatgtctttaaaaaataaaattaacatatatattgatgggtaattccttgttaatgttctttacctggcaaaataaggagttagtaaccctaggtcagtgtcccagaaattttactgggtcataaaatcccaaggcatggaaatgttcagtgtagctggatttgagcccaggccttcaaatactgttttgtttttaccatgccgctttctgtatgctcaaatggatttagactattctgaaggcacatagaagtaaatgttttagactctagaacagcactgtccaatagaatatttctgcaacattctatttctgcaacagaatattctgcaagactctcggtgctgtctaatatgctatccactagctaaacacacacacacacacacacacacacacacacacacacacacacaccaatccacaaaaacaaaactgatcttggtggttataacaaattcaatttgaagttctgtaagcaccaaagaaaaaatgaattttgaaacatggaaatatgagatctgcatgtagctttgttctcccttgggagtgaaacaatgagttaaaaaattttggacttgggatcattcatgacatttattgggagacaacatcatttactgaactggtgaaatgatttcttgtcacatcacaaccttccacatttgttgaggggtgagcagttattctttttctttctgctctgaagttccctgcgtcttaaagagagggttgcaggaattgacacattatatatgtttagatacaactttccagtattcaatgtcagcaaatttttcttgacccaaggttaggaaaaaccataaagtctcaaggcaattaaccgtaggtggacacaaagcctaggagatgctgcagtaggcagacggaataattggggttgtttcctctgtgaacctggtgtgaatcataccacagattaccaggaatctgaaagcaaagcccagtggttgatattccttacttggttttctaaagaaaaaccatgggtctgcttgatgctttctttctgtttatttatagaagcacatctttagatgattcatattgcaagggcttagacagtatgatttagtaatactccctggaatatcttatctcaagaaacacatcacataaatgttccagcagtgtgactgtttttccttatatggctcagaaaacagtaaaggagacattgagaacaattcattaagaagctaagactgacaagcaaaagtaaatatttaaaatgattgatgtgtaagtgaaaacaagtattcatatgggaatctcagtgttggctggaaacatctccttttgtatcaagaatttttaaaaattaaataaagacaagaatgcatgctccaaacaatttttttgtcttactttcatggatctatggtgtcttcaaatgataccctggcatggagtaggtgctactgttattttccaaacgagtaaaacagtgatactcattcaaaaatgcacatcaattaatacacacctttatttagaatgtggtggaaaacacgtattggtcatctccaatagaagtcaactttcttcttcttcccagcctgccaccatatgccccaccgtcaagacttaaagttcaggctgtgcatagtggctcttgcctgtaatttcagcactttgggaagccaaagcaggagtattgcttgagctcaggaattcgagaccaacctgggcaacatagcaagacctcatttctgctaaaaattaaaaaaaattagccgggtgtggtagcatacccctgtgtttgggctactagggagactgaggtgggagaatcacttgagcccaagagctcaaggctgcagtgagctgtgattacactgctgcactccagcctgggcaataatagagtgagactctgtctcaaaagaaaagaaaaaaaaattaaagttcaaaatatttctattttacaatacactggagcatggttttgattttagtcttctttaatatacagagggaagagggttgagataaagtgagagtacactagtgtacctctaggtacaatatccacaactgggtgaaccaatatctctcctgtaatggccatttgcctcttggaatttcaagaggcaggaagaatcagtaattttcaactatgggtccttcatctaggggccgtgtttcattgagagcactatccaggttactggactagtttttttctttcaaaatgttcttcaaactttccttattttagtttatttcacacataatgtgctcttagagattgcattcttttggtatgcactgaaaaataggctaatcttccttgactgaggccaattctgagtttactttcttctggcaggaattcagtgtctcataggattgtggaataattgctcttgttattaaactaccacttctccctgcatttttttttaaagaaagtagatattatcctttgaaatgtattaaatctgatgtataagcataattatataatcattatttataagtttaaataattcaccttcacactctttctcttttatacaggagtgagaaaaactcacatgatttttagagttttttttttcacatttaaaagatttaaaagtgagttcagtctgtaatcccagcactttgggaggccaaggtgggaggatcacttgaggtcaggagttcgagcccagcctggtcaacatggtgaaaccccatctctactaaaagtaaaaaaaaaaacacaatcagccaggcacggtggcaggtacctgtaatcccagctactcaggaggctgaggcaggagaatcgcttgaacctgggaggcggaggatgcagtgagctgagattgtgccactgcactccaacctgcgcaacagagtgagactctatctcaaaacaaacaaacaaaagaagtgagtgcaaatactgaggaacatagtgagtataaaggaaatctagaaaataaaatggtatgctaaatattagcacaaagtcctagagttcgaattgcagcaggcttgtcatagaaacaatgaattacgtatatgtttggtcagttttcacttctttttccctctgctttaacaactttttataactaacatttatccctctatctctcctaagacttcagtatatatctattactttggcagtaatagccaagatatattactacatataactcaattaattcgttattttaaaggttagagcactggcaatgatacttagaggtgctggcaccatctcactgtagcagtgcattaaaatcaatgctttatttttatactgtggcattaaaaacattaccatttaaaatgtctaaacatcaggatttcatttttatgatttttttgaaagtatgagattaggaatataaaatgcctattcagctaatattttaaatcccccagttcaaggattgaagaaacttgtttagctaatttataagacttattttacaattcatgaaactcccatttttttaaatcagaaataaaatgacttaagtgattgaataaatggcaccaaataaagcagaatttttaaacaaaaagatagtaaaaaggtattctagtagcagatgaccttagcatattttgccaataaacttcttgagatttaatagctagtattaatgcctgcatcaacactccgaataatactagtaacagtggccagcacacagcaatggaagaaaaagcctggtctatctaggtcattaccaaaataatatcacattttataaaaaaagattttggctacctgggatcctaacagaattaagaaaaagataaattctctactctagagcacatcagatacttcacagcttggaaactgttatttttttaactcctaacaaaattctctcaaatagtctcacatagagatctgatttatctttaatcatttttttttgtcttgaggcagggtctcactctgtcatccaggctggagtgcagtggctcaatcgtggctcactacaacctcaacatcctgggttcaagtgatcctcctgcttcagcctcccaagtagctgagactacaggcgcccaccaccatgcccagcaaatttttgtattttttgtagagacagggtttcaccatgttgcccaagttggtctcaaactcctcagctcaagccatctgcctgccttggcctcccaaattgccaggattacagatgtgagccaccatgcctagcctgatttagctctaattcttcagatatgaataaacaactaatccaaatattttcagactttctcagtacatggtgcccttaatatctcaattttttaataacagcaacacattggccaaaataaataatagttccaattattaaatagttaagtccaaataacttaataaggttttgttctaacaatttagcacccactgagcactatgtcaatttctcattttggaatgagattggacattgcctcccttattttttgttgcacattgatttctgctcagcacttcatttttatccagcaactgctgaaaacccaattttgcaaagatatggtgtcacagaaaggaatatcatggtcttaattggaaactgggaactattccaagctattagttttccaggtggttgacagatgttttcgtgtttttcttgaacatttaaaataacgcttgcacccatgtacattccctctgttgcctcaggacacattttgagaactctggccctagtcccatcactcctacaccacagggtgaggggtgaggatacctccccagctgggaaaaacccagaactggggaagagatgatttggccatggtagctttctttctgtggttaatggaagaaagctttcaagataacaaattgatatgcttttgaaatgttcattagtgtaatattatcttgcaatctaggtaagagatgactacaaacttttcatgtagatccagtgagaattagaacctttgtaatgcaacgtgtctttttatttatattcttcctagtgagaccagggaagattaataatctggaataaaagatacaaattgacataaagggaattcttcttcctttttcaaactcaggactggaagcaatactactcttatacttagcaggcaaaagtagtagagaggagtggctgtgactgaaaacacacattagaggcccaagaagtggtgagggacttgttaattgctaaagaaaggacagtagtttgacatgggaggtagggagagtattatctactagctgagaaaatgccccaatggggcaccccgaaggcctgatcagtgaggtctgagatatctgtatagtgcctggggataacttagctagattcccaaatatgccccagctttttatggtatatcaaatctactcacttcctcgtcactggccctctgaatgcattcaccccaccccatattctgtgtgtagaagcaatgtatatgaatgtgagtgaagagccgattggatcatctttgcattctatgtgttggtgttaatttaacagaggatggggaatagaggattagttatccaggtgaattgagtatttcttaaaacttaagtagtttgacaggtaacttatacttaataaattcatagttttgtgacttaattctacttatcttgtcattgctaattctcctcttaatctttgcaatgtatcataactttatgtgtttccaaatacagatactatattactggatgatgtgaaaacacagaagtgattgttattcagatgctgaaatattaagatgacaaaaatattgtctatttacgctgtaattttcttcatgttacttcatgacaccacttgggcaaccagccttttgttatctagttgtttctactgttataaaaaatttttactattaatggtaatgcaagtttattttcatgtatttatttactagactcatgctaatacttaacatttttctttttcttacttttcttaagaattaagttgctactgcatcatctatatttaacaaattgtgtgacggtctctgagcagaagtggtcaggaacttctcttctgccttatatgagctaattttttagattctgaatttagcctagtgctatatacttgtatacattctctaagagttggctgcatatttactttgtacctccttgagcttttattttattcttaatcaaattttgatactgctatgtatttcattggtttaatgaatttggtcaacaattacttctgtttctcagcagtttttgctgtagtagtataaagtactttgtttacaatggcattatcaaattatgtgctcctagaaataatcaaaatgcttgcttttttttcaaaagattaagctcattggactttggctttctaacctgtaaaatggcataacaatgtccctatcaaaaggactgtgagtatatcaaataagatagctggtgtgaaaatacttgggaaagttgatgatatacacacaccatgtatgttatgattattattactaccatctttatctgttttgttcttcagctatttcattggtttctatttatagaggataagatgacgatatcctatctactaggaagggattatcttccttcttctcactttcccaatagagtaaatagttatatttaaacttaaagagtatttaaaggttttccaaaacagttcaattaaatagataaccacaaaccttcattttaaatacccttcattaggtacctatcctcattaggtactgtttgtatttgaaatttctaagaaaatttctcaataggaaagcttaactagaactattaataagaaatcatcaagtaattaaatatataacatcattctctataaagcgcagttgaattatacacatcagacagtcttcatagcattattgtgaactaggtaaggtgagaaaattaaagtttacacatggccatatgagaattcaaattaagagaaggcacagtcctttatggtggaagatatgtgtcgtgtcagattaaatgttgaaatagttattatttattctatttccttttccttccacagaaacttaatctccttggtagaaagaatgctttctaggagttggtatcaaaggaatatcttactgctccaatgtaaatatccaaggagaatggaaagctaaacatatcaacacattacttttcagcaaaatatagtgttgactcatggtctgattaaactcatcattcctacctgagtctgatcagataaagaactcttgaggcacacagcaaaatgaggtatccttgcaagtttgattttgaaataaaagcatttcatatttaaatatgaaatgctataagcttttcataaaatatatgtatatatttaatatttactaactggagtagaatgtatgaaagaaacaatctatcccaaactcagtttactacaatttaaaaaggtagaacacataactacataaatggactccactaactcactgtgagttttcctctttcttttgtcaataccaagcctgactcacctttgatgaagttgcattagatgactttcaattctgtcattcgcctatttaacattgtttattgttatctatggggctggtcagtattctactcacctttaccctgttcccttttttgatctgcatagtggcttttttaagcctttccctttcttctcaagctgccccatccctctctcctctggctattgatggctgtaccttctacttttacattcattcatctggagatggaggagtaaaatgtttagagaactcatggctaatatctcttaacattttactcctccatctctaaatttacatttcccttcttttactcttcttctccttctccttcttctcttctctcttattcttctccttctcctccttcttctttttttctttttttccagacacagtcttgtcttcctctgtcacccaggctggactgcagtggcatgatcgtagctcactgcaaccctgaactcccaggctcaaccaatcctcctacctctccagagtagctgggactaaaggcatgtgccaccatgcccagctatttttttggatttttagtaaggacaaggtctcactatgttgccaaggcaggtcttctttgtccttcctaaagaatacagttctggtatttactacttttccaaggatagcctccttactttggctcatgatcatgtttttgtcagcaactacagctccatctttaaaccctctttccccttgaatttttagtctctttctatctcctggagccttccctcagctcaagtaacctgaattcaaaaaaattccgcttgaacctaattctctgtcaggcagccttagttctttcttcctactccacccatcagccttttaaagagatgcctgcatttgctcacatttccactttcaattcactccttaacccaggggctcctaatgctattacctgaatacaacgcaccactcaactgtcattcaaaaacctagtaattatagaaggtaactgttctatttctcctggtcctctggactgttatttctgtttgctgtcccagtactttaactgttgtcttgtttcccctagccttatcatgtacaaaccaattcatcacctgttatctgtcatgttttctactctctgccctttgttcctcatcaccatgtacgtacatcaccatgtacgtactcattcatggacaaaaatcagcactctctttgattctccttctccactggctgtcccccaacatacatacatacttcacacacacacacacacacacacacacacacacacacacacacacaaccattctataagcctcttgcatctaaaccagctctttgctccactgccatcactcccttgacttaggtcttcatcatatttagcctgccttacttctgtgaatttcgacatgaaatacttccctgtagtgacttcgctatgcaatcattcaacaatagagtaatcaagatgcaataaaaacaagaatatgatcatgccaaaactcagctaaaaacctctgtggctctcaggtcccatagactgtatttgaaattttcttctctcttgccaggtttcgctattcacatcaagcagattgtcattccttagttcagccataattttccatgcctcacatttagtaaatgttgttcccttagcccggtattttctgtatctttcccttgggtggaaaactctccatctcctctctctgttcctgcagtacatgataaatgcctcaaggattgtgctcaccatattttattacaatggtctaaaatgccagacctcactgctccacagattcagagctttaaatacaccatatttgctcaagaagcattctcattatgtgtgaatgaataagtaagtgtcatgaatttcaaatctaaggaagtgagataaaaataatgtaaaaatagggccactaggaatagaaagttgtttagagatgaagaagggtagacgtcaataatacaactgctaaaatagcaaccatagtttgtaaaaatgagtgaaatataatttcatttctagaaccccatgtagacctattgcaatacaactgatgctctgttagaatggcaagaataacactagacactcaggggttccatacagactaattcttataagataaattgcagcctgttatgagtttttgagatgggtgtcatgaaaagatggtgaatgttattggacaaatgtatagaccaagagagaaagatgaagatcgattctatacagaggcagatgtgccacgaatgatagtataggtattgagtgagaataaagacctatgtagaaaaacatgcacactaccacaagaatgaaatgcactgagaaaatgagctagtgatggtacaggatctgcaaacctgcttgtcagttttcattgtttttcaagctgtactatatcttaaatgatattcaagtctgtctaatgttttctgtgcttgcctctcatgatccttaaaagttggtttaattttggcaaagtcccacaaagatttcttaaatgatctggcaaaccagtgctaacatctgtacatacattaattgaaatatattcaaaatgctatacagtctattatcacaggacttttcaatggagttgaaagcttttcaaaatattagaaaatatccatgtagttaggtagctaaaactcaggctctacataaatataagctaatgatttaagtgttagtttccattaaaaatttaattctcagttttcctataaagtattttctgggaaaataaatacatgcgtgtgtgtgtgtgtgtgtgtgtgtgtgtgtgtgtgttaatcaagagtgacagtgcactcaggttaaatctaccattcatttctagcttgtataattttattcatattctttctacattggaggagagtgatacagttgaacaaaagtcattagttttattatgtcatcagctctagatataaatttactcggttttctctctctttgcctgcccttgtacttacatatcactggcaatggaggagttccgggacatagactttggagagaggtcataatcgctgtcggatcgatacaggaaggactcccgtcgttgactgtggacaaaatttgcttggagaattagcccggatcctgggctggtcatgggatccaagggactccgtcccgcagatgtgccattgtccacatcaaaactgtaaaggaaggagaaggaattatgttgctgtgaacattcacatgttcatattttcaaaaagcatttagcgtcagctgaggaactgacagtggaattagcaggaatgaaaattacagctaatttctgccataaaaatatgataatattgaaatacataaaagaaaaacacattgacttcacattcttgttctcctggatactgttgttaactgaccagatacaagatacaggtttttccaaactctacttcagttaaaagggaaacactctgcaaaacataatcttctaagtacaaaattcctttcggaaaataacaaatacacagtaattcatcaaatatttgaattcgattcaacaaatacccattttgtgcctaatgctgttctcccaaacctgggcttctccctccacactcctaccctataacatccatccaagcattaatttctattgtacccacttccttccatccctactaccaatattttaaattcaggtctccatcaaatttcacctatattattataacaacctttatattagtgtcttgaatccattttccagtgtcattcttcagtttaaaacccttcagtaacttaccattgctctcaggatgaagtcaaaatttctttgccagactgccagtctaaccatctgctctcaattgcaattagttgcccccagcctcaacttgccatcctcagctattgggtacttcttgctcaactcatattgaggcactatctccttctcacaggccatcaccacctcacctcctgctcccctaaataatcaaatcccctttcccctgcctaactgtcactcatccttgagacttagcctgcacctgaaaggctaccctggtacatcagagctttatgaaaggccctttctctacgctcccaagacactttcccactccctaatgacagaatttacaatgaattgaaaatgtttttcacccggtctccattcctagattgtgagctctctacaaatggagactcagcgtattcttggcacattgaaaactgtgcccaagtgtcttgagtaaatgattaaatgaataaaaggcactgtgctcagcaatacatattttagagctgggaaaaaatctacacacacagttcttaacgtcatagtccttataatctagataaactttccacaaagaacctttctagtgaaacatcaaccagtattaaaataaagtcaactttcatgtgttcttaggagaggagggtgatagcttatgatagcccagcaggtgtgtggttttaaagaaaaacttgttgaaagaataaataaacatgtgaattcaagttttgctgtcattaatattttccccattagaatctttattcaaactattaactagctcattttaaaacattcctttattttctttatcggagtcattaataaatagagttatgactctaagattggaagatgtttcatggatcacttttgaatctgtgatcaaataacagtggctccgaaataatccatcaaataaacagaagagggaaaactcattatcttgagcagctgtaaatatgtttttccaacttaaaattttcttagaattgtgtctctttatagatatatttatttggttcaggaaggacaatgagagattgtcaagtcgaacagactcactttacagacgaggataccaggtcctagaaaagttaattgaccagtcactgagctaactgcattgaatcatcgattgttcctaaagtccttccagctctactgcatgattatataaaccacaaatatatgtggcacccaaacaggggacatctgtttcaccagaataggataggcacatatgtatgtgaaaccttgtcaattcccaggaaggctggaaggggaggatggtctctaatcattcaatagacatacattagggatctttggcaaactctccttggatatgcttaaataggcatttattaagcacttaatatgagtgcattaagatacaaaaataaaggatgaatgactaactcaggctgggatatctgagaagttttcatgaagagtagtatttaagaaggtttttgaaggtatttagtacacaactggaagacattaaaaacttctaaatagtgggggtttggcaaagtagatttctcttctaagaagatagtcatggcagcttttcagcatgaggaggacctagtaatgtgaatgcctgtagaaatgtttatgtttatttccctttaatatcaagatattcttattgctacactttaaaaaagaaaataccccctccttcctgtgcatgaacagaaatgtaagagatacagaagtgtgagttttggtttagtttttttcagttcaactgagtaaacaccaaatttgtataaatcagtaattttttctttaattataatttttccaattaaatcaagcaagtcttaacactccactataagttttgaaacaaatattgctaaataccttaagtcatttagatagttatgatatttttaaatcttacaacttttaagccataatattagcactaaaaccaaaacatttattaataggtcaggaagtgcttgatatgagatattctaggggctttaatatttttctttgtatactgtaatataaaaatttgtccactagatggagatcattttcttaaacaaggaaactattttctactgaagggttaaataaccttaaaggcctaaattatttcttaggaactcatgaaaataaccctttaaatgacatccaaaaaacaaagttcacaatgtatactaagtaattatcaatattgataaaattacattaatctaatattagtattagctttacaaacattgagaatgaagatctaaaaatagtgactgatattttattggactttttcttaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcactgggagatatacctaatgctagatgacgagttagtgggtgcagtgcaccagcatggcacatgtatacatatgtatctaacctgcacaatgtgcacatgtaccctaaaacttaaagtataattaaaaaaaaaaaagaaaagaaaaaaaatacttgagaagacttaattgaatttccgtaacaaatcactgagtacttattgtgttggagtaaagtaacttgagcatcattaatagtctggggtttcactctaaattttggcaccacaagtattctcagaatacggtttgttctgggaagtgaacctagggtctgagttcatttgcataatttatttccatgatattaaatcctcttataatcaaaattaattatcaagaaaaagtaatattaccgagaatctccagtctgaagtatcagccaatgtcagtattagtgaatgactttatacaaagagagactttgtattttgaaatagtcattgaataaacttttacattacatcctatgtccttagatcagcacttgaataagtacagatatactacacattgtccttttctagaaagcactaaagtctagttaaggtaatagaacatcaagcaaccagagaaaataaaagcagcaaaacaggtggcatctgtattaaatagcatataaatactaaaacacgaaattgtattatataggcaatcagactatgtgatgtagacaatgaatgtaaagggaatttaagaagttgcaggatgtacacctttgaaggagagttaaaaaatgtccagccagagtagagctggggttgggggtggaggccatccagcaaaagtgaagccacaaaaacaaaaccaagaaggaatgaataaggcgtgtatataaaacaggacatttagtgtctggctaaatttgaggcttggtattaaagaatagtggggacctataaaaatggcaattttgtacagttcaacctaataggtagggatggatgtgtttatggaaagctgggccaaggagtgtcagcagaagcttgttataaagacttacgtggaaacacacaaatcaacttttaacattgaaatctcaggggagtaagatgaggaagaccagtatttgttaaaataaacatgttgcttttgcaacaaataaaaggtagaaaacagagtagaggctgagcacagtagctcatgcctgtaatcccgacactttagaggcacacgtgggaggatcgcttcagaccaggagttcaaggttacagtgactgatcgtgtcactgcactccaatctaggcgacagagcatgactctgtctcaaaaaaaaaaaaaaaaaaaaaaaaagaaagacaaaaaacagagttaaaaaaaaaaaggagaaaaataaatgttttaactacaagaggacccccaaaaaggcttgttcattaaatacttcaaatattagaactagggggtttgccttgagtagggaggttagttgtggattttaaaaggcagcacatttttactcagtaggtagtaagttaactgagaattagacacttacttaactttctgaaagttagcctaattagtcagtttgggctgaaattatagatggcttcaaataagctagttatctttgaaacataattttatcaatagtccacatcgtggtgttatgaataaaacaagaaggtgatgaaggataaggtagccctaaccttagatgctggtatcaaaatgatcagttgtgaattttccaaagacattctttagaaaacacttggatgtggtgaattctcttttgactcacagccaattagatggagcccaagcaaaaaactagaagtttgaaaaagtaactaaaggattggggagagtaaaaattaccaagtttaatgatgatggtggcaataataataatgttaataacaataaaacttctggagcactttccatgttccaggcgctgtgctttgcatatattatctcatttaatcctcacaataacactttgaagtaggcactgtattttccattcgaccatggggactctgaggcatagacaagtgactctatgttcagtagtatgctcaagctcataagtgggttttaaactcaagctgtctgattctaaggctggggagaatggactctgtttacacctctattatgaagtttcatttaaaaaaatacaagaataccttttagcttcctcacctgcagggaacttttgaaagtaacattctgattaacttacaggtgacgcatgcaaaggctaattctgagactaaattttcgtatggggctgggtgtggtggctcatgcctataatcccagcactttaggaagccaaggctggtgaactgcttgagcccaggagttcagggccagcctgggcaacatggtgaaacaccatctttacaaaaaattttaaaattacctgggtgtggtggtgcttatctgtagtcccagctaccccagaggtggaggcaggaggatcacctgaactaaggaggtcgaggctgaagtgagccatgattacgtcactgcactccagcttgggcgacagagcgagactctgtctcaaaaaaaaaagttttcatatgacccaacattttggaatttgccaaatccccagctttttccaattctgaacataacagtagggtgtaaaaaagtctttgctgtaacccatttggcgggtttctttatagcatttgagatttcatttggaattaaggaagggtcagtgggtctgcaaaagggcttagcaaatggaactaagtgaggtgctttcttgttccatatgtttgcttcccttaatgcaatttaagaatgcacacaattcttaaaagagataacttttgccagaaggcagttttggaggaggaatgatatagctatatttggtctcccatgagggggcagtaacagtaatgaccagctggcctgctgcattcagaagtgttaaagaatgtgtgtggctagcactactcatgaccatttactccacagacccatccttttctatggaaccagccccctacaagaaacaaagagaagtcggacaaactgacgaatgaactaattactcccagttctccacactgttccatttcagtggaattactggatggtaatacagttccaatctacctttcatccacgctctcaactgctcgcatactttgtgtctactgaccttgtaattgtttgtctgctgaaggtcatttctcatctttttggccttttgctagacactgcttccctagtttaaacttttcccaatttatttttgaccatgatatgggccctctcctgagccagagtcctgctactgtgctgagtaaatagctttcctcatctatcctagccatcaggaccttatacttagcactgacccccagtatgaagcccaaagtgggtggggcaatgagggcctcagtggagcagctgctaaggaacctctatcaatagcagcctccattaccgaagcatctatgaaggccactcacagggaagatcttgctgaatgtcgctgggaatcctgggagccatcactgaagccaggaccatctgaaagctgcctttttcactacatagtaagaacaatggcacatagaaaatattgacctaccaaaaatgttcctgttaagatgtttatttaagagttagaaaacacaggttaaatttgaaatcttggttcagccacttcctatttgggtgctctagggcaagttgctgtattttctaggctttcactgctgataaagataattacaatacctagctctagggccattataaggattagaagagaaaatgtttggaaagcattcaccacattgcctggcagctagtacactcccattatttagcagctattgtttttcatttttattactctttttctcccagggagatcttcatctaggtcattctctttaactttatttgaacacatggctttgggaagaacctaaagggagagatgaaagaggaagagaactgagggccaaatcacctgaatcagcccttgcaatcaatgaggtgacagatgctggagccagattgctctaaaagtttcagctgcttttatgtctccacccaactccataattccagtgtgataacatctggggagggtggagactgctgatttttttctagatattactcactgaggagaaagaataatttcctaccaggaagtgtggaaggcttggaggtcccaacaacctaggtggggctccagctgaatataatgagcagaaacagtccttcagacctcaggtctccagacacagggtgtagcttggggacctcaggtcacaattatactgatgtttatattcctgtactccactctcccctgtgtattgtagctcatgctgttagccaacacattggaactcattttgatgctttgccctcaaggggaggggaggcttacccttgagcttaaggggagagtaactgtaactggatgactacatacatttttccctctttataatactaaatattttacccattgttatcaatatcacaaggttatgaagctcgtttctaatcaatgccactgatacttctctattgaaaatttccctgcaggtcaaatagcttctctgaagtaaacaaaataatgatttgcaaaattcaccattttaatatttacttttctctgattatctatggagatgagactgtagaaactagcattttacagtgatatgcacagatggcaatctttcccaatcaatcataaaactgcatattaaatttaagtaggatacccggagaaggcatgatatttagctactttacaagattacacagctaaattatactacacatgttagcttgtataatatatatatttgcacagagttaagatatttaacagacacgttttaccctttgttttcacagatgatttttataaacaaaagcccagggctgggcatggtggctcacacttgtaatcccagaactttgggaggctaaggggagtggattgcttgagctcaggagttcaagaccagcctgggcaacatgatgaaaccctgtttctacaaaaaaaaaaaaaaaaaaaaaaaaaagtcaggcacgatgatggcacaagcctgtggtgctgaggcaggagaatcacttgagcccaggaggctgaggcttcagtgagtctaaatcatgccactgcgctccagtctgggtaacacagtgagatcctgtcatacacacacacatacacacacacacacacacacacacacacacacacactggtacaaagatgaagggtatatgcttacttatgagtaaaacattaggtggtactggaaatatacaacatatgtttctggcttgtcagtgacactcccaagtaacacagggcaataaagagattcaagatggaaatgatagcatgagtttgatgtctggactataaatgaaagaggataagctggacttgcttagcacacttttgacacaatgatatgataaaaggccaatttttctgaaaagtatttattaggccagtgttatggactgaatcttgtttcccctataattcatatgttgaagccttaatcaccaatggttacatgaggttgaggttgaggttaaatctatcttgtttcccctagaattcatatgttaaacgaggccatatggatgaggccctaatccaatagtgctggtgttcttataagaacagagagagacacaagagcattctctcttcaccatgtgaggacagagtgagaaagcagccatctgtatgtaggaagagagccctcaacaggaaccaaatcagccaatcttggtcttggacttctcagcatccagaattgtgagaacatttctgtttaggccaccagtctagggtactttgttatgcggcctgagttgactaaggcaaccagaaagccccaaccaaaaattgttttacttgaagtttatacattactttttaatgactgttaagaaaaattttcttaactgaaactctctctaagaaagcatctcaaattattgccaagaccaatgccatgaaattttccccctaaattttcttctaggtttacagcttcaggtgttataattaagtcttgagtggattttttgtgtatgatttaagataaaggtttagtttcattcttttgcatgtgaatatctagtttccccaataccattttccaataccattcaagacttttcttcattgtatattctggacatccttgtcaaagatcagttgactgtgtatgtgtgagtttatttcttggctctattctgttctattggttttatgtctgtctttatgccagtaccacattgttttgattactgtcacttagtaatatgttttgaaatcaggaagtgtgagatctccagatattttgttctttttcaagattgttttgactattcagccttttgtggtttcttatgaagactgcttttctatttctataaaaaataccattgggattttgatggagattacattggacattgtggacattttaacaatattaagtttcctaatccacagcagcatcaaagcataagcaaaaaaagcaaaaataggcaagtgggactacatcaaaataaaatgtttctgcacagcaagggagaaaacacagtgaaaatacaacctacagattaggagaaaacatttgcaaaccatatatctgatatggtattaatatctacaatacataggagctcctacaactcaatagcaaaacccccccaaaacccaattgaaacccctcaaaattaaaaaaacccaatgaaagaaatggacgtttctccaaagaagacaaaaaatggcaaacagggatatgaaaagatgctcaacctcactaatcattaaggaaatgcaaaggaaaaccacaatgagatattgcttcactcctgttaggatggccattattaaaaaaaaaaacctgttggcaaggacatacagaaattggaatccttatgtactgatggtgggactgtaaagtgatgccactactataaaaaacagtatggaagttcctcaaaaaattaaaaacagaactaccatatgatctaccaattcaacttctgggtatttatccaaaaaattgagatcagcatgtcaaagagatatttatattcccatattcatttatgtatattcacaataccaagatgtggaaacaatctaaatatccatcaatgaacgaatggattaaaaaatgtggtatatacatacaatggaatattatttagccttaaaagaaggatatcctgtcatatgctacaacatggatgaattttgaggacattatgccaagtgaaataagtcagtcacagaaagataaatattgcatgatccctcttatatgagggatttaaagtagttgaactcatagaagcaggaagtagcatggtggttgctgggcctgggtggagggagaaatggagagttgttgttcaatgtgtatcatttaatcatgcaagatgaataaattctagagatatgctgtacaacattgtgctaacagctaataataatgtactatacacttaaaatgtaagagggtagatctcatattatgtgtctttgtttttagcacaataaagcaactttttcaaaaaggatctcaaatggccctaacatgaggccatggtatttggactcttgaggcaaagcctgcagtagcagtatgaggtccatatttgcagtaattacctagaaatcatgagaacttcaagtagtaaacatatacattcaatcagaatacgtgctgacaatgggaagcggaaagtgtctttttttttggtagtcattgggaggccttaatttctctggcaatttcatgcaggtgtcactgtgattgagaataaaacaagtagagatttatttcttcccttacatcctattatcatgtgctgaccactaactaagagtatggagggaagagcagaaaagcacatgctctccaggccaggctggacctgagagtcagctgtagtcccacaggaataactcagttttattttccttgtactgctcacagcaggttactaccaatctttcactttctaagatcacttctaagatgctatatttccaaaatgcactctttctcaaaatgtggcttcatcaagctaaagtccaaagaggaatagcgtcttgttaacaaagtggggctcaagatggattaaagacctaaatgtaaaagctaaaggtataaaaaccctggaagataaccaaataaataccactttgaacataggaactggcaaagatttcatgataaaaatgccaaaagcaattgcaacaaaagcaaaaattgacaaatggaacttaattaaactaaagagcttctgcacaggaaaaaaaaacacaactattaacagagagtaaacagataacctacagaatgggagaaaatgtttgtaaattgtattacctgacaaaagtctaatacccagaatctacaacgaaattaaacgaacattcaagcaaaaaccaaaccgccccattaaaaagtgggcaaaggacatgaacatttttcaaaagaaggcatacatatggccaataagtgtatgaaaaaatgctcaatatcactaatcattaaagaaatacaaatcaaaaccacagtgagataccatttcataccagtcagaatggctattactaaaaagtcaaaaaataacagatgctggcaaggttgcagagaaaaggaaacgcttatatactactggttagaatgtaaattattaatagttcaaccattgtggaaagcagtgtggtgattcctgaaagaactaaaaacagaactaccattcaactcagcaatcaaactacagggtatataccaaaaggaatataaatcattctaccataaagatacgtgcatgcatgtgttaattacagccctattcacaatcacaaagacatggaatcaaactaaatgtccatgaatgatagattggataaagaaaaatctggtacatatataccatggaaaactatgcagccataaaaaggaatgagatcatgttctttgtaggaacatggatggagctacaggctattatttttagcaaactaatgcaggaaaagaaaaccaaatactgcatgttttcacttataagtggtaaccaaataatgagaacacacagacagaaagagaggaacaatagacactggggccaacttgaggatggagggtgggaggagagaagaggatcagaaaaaaaatactaactgtcaggtactatgcttagcacctgggtgacaaaataatatgtataccaaacccccggggtcacaagtttacctatataacaaacctgcacatgtaaccctaaacctaaaataaaagttaaaatattaacaacaacaacaaaaaaaaaaaacaagcaagcaaagaaaaatacccaaggtagtgttgcggggtgtttctgtctttatttattgtttctatgacatagagcaagtaaaattgatttaataagccgactttgaaacattgatattttaatgatgtgccctgctacttctccagccacccacccacatttattctttatattgcagacagagcgatcctcctaaaatgtaagcccattctcggcaagttcctactcattatcccataatggtgtcctattttattcagagaaaatactacgttctcccaatggtttaaggccctcagtgacctggtccctggtgcctctctaatctcatctttacctacatctctccctcttgttcactctgctcagcctcttggtccctagctgtccttgaagcactgtgcatactccctccccagggcctttggatttgcagttctctttgcctggcatattctttctagagatatcagctcaatgttaccttcatgagatattcccatactggcctatttaaaactggcacccctaacctcctaaccttttttttttttgaacaaacaaacaaaaaaccttccttactcttaatttttctccatcgcatttaacagcttctgatgaactttgttttttacttattttatcatcttactcaccccattagaatataagctccacaagtgcagagatttttttttaaaaatctactttgttcgttaatgtgtcccccagcaggtacaacagtgcctcacacgtacgagttgctcaataaatatttgtatcgtgaatacatgggtatctttagacgcagcggtactttttctataccggttatcatttaccatggttatctgtgtagttctactttaaataaacttcataactattttttaatttagctaggagttggtcacttatttaaagaaataggttaatgagattgattagcacatttgaagaaataatctggaacatctctaagaaggcattttaacgggggttattttgaatatccttctgtttgaacagcagtcagccatgcaatcaggggtgggatcaaggttttgtggtacacgaagattatacaattataagggtctgctttcagaaaaataatacaaaaaaatcttagttttttgaattttacaaaacctaaaactacgtgcagctgctagtaccacttcttacaacttgaaagggaaccaggccagtgagaagctcttagcttgatcttcattagtttcacctcagatctgcatctgaggtaattacatatcaggaaagaataagaaaagaaactggatgggtgaaaataaaaatttagcaccttatatcattacttaattaattatgtgttttctgagatggagttttgctcttgttgtgcaggctggagtgcaatggtgcgatctcggctcactgcaacctccgcctcccgcgttcaagtgattctcctgcctcaggcccccgagtagctgggattacaggcaggcgccaccatgcctggctaattttgtatttggggtttctccatgttggtcaggctggtctcgaactcccgacctcaggcgatccgcctgcctcggcctcccaaagtgctgggattataggcgtgagccaccgtacccagctgcaccttctattttcttaagagataaattgttattagttttttcttcattcctttttattctttccctccctccctatcacctccctctctccctccctctctattttcagtacccaaattttcaaagcttactcataattctcaaaatttctcttgttagttgcacgtgtttatttttcccagatcagtgagtgtcacctagtcctggggaatggggagtgattccattaggtcagatattgaactcactttgaagaggggtgatcttcaaaccatacctgtctctcaagatattacaattttctttttgagggatgggttttaaaaatgtgatcctcaatcacattcctggctatttgggtatttaggcttactaaaaattaatctccaaaagattttattgactaaataagaatgattgaatgataaatcctttgtagaaatacttagccttaaaatattatgtgttaagtatgttaaataagtctaggtaagattataacagaaaacaaaaaagtaatagttctactataattgcctttaaaatataaccgaattctgattcttttagactaatggatacgaaaactcatataccatgtttttcctctgggtttgcactctgcatcaaacaggtcaggaaaccattcaccagccctactattaaatctattttggagaagtgatattattcagtttccaacctcaacaatccaaacagatgggttttctgccttaatggggcttgaatgaatggcgaagggcttcagagggttgtgtggcctgaattacagacaattttttcaatcttactgggcaaagcaatgataagaatattatcttacgatggccataaacaatcacttgcctcttcaattcttttaaaatatatagtggagaataaaaaaagatatgtctcattatgtgtctcattgtataataagtacactgagattagctttctctcatgatttcttatattgggtgaattatgtatggttacaaattatcttttaaaagttttaagatgttggatgggctaccacagaggtagcaggatctacttcaacaatgattttatagagtgaagaaacattttcatgtttccttgaaatggaatctggctgaagacaaaatgaccttgggaaagcatagaagtcaataatcaggactgtgagtataggaaattctgcttgttgtctgccatattccattctctgcctgttcctgggcataaaagaagttctcgttcccttgcaattagatttggccaagtgactagatgtgagcagaaatattgcatgccactttcaggactggctcatagctcctcccacatgcctatcttgatgttctttttctgccagctggatgctaaagatgctgatgcgtgaaggatggtagaaacagaaggtgggagaatcctggtccgtgactgagagcaaggagagctgccacatcctcctaaacaccatcctagaacgctacttgatgaagaatgagtttattttttaagtcatttaatttgggggcttatttgtcagcacaataacattcaacacagtgcgttccatcaaagtaaactggaaagtacgtactgaaagtacattagactttcaaatgtctcacattcaatctatctctggcccaagtgaaaccatctatgtctttacttctaccaccttcacacttcatttaggttttttgttttgttcccttgatcttcctcggttaacagatattttcattatgacatttctcattacctaagtgcttaagagatgttagagaataagtctataatcattacacacagttgtgattgttgtgtaaagtgaaagccagtctggttctgttctgtcttaacaacaatcagcaaagttacagaggatcagctcaagtgtgaacctgacacatgaatttgtctctggattacagaagacacacagaaccgagattaacaaacactcaggatttacacccgtgcttcacttgagccaatgagatttcagaagtaccagatcgaaataggcttcccttaagacgtcaaagcattgcaacaaaaacaaaaacaggcaaatgggactatattaaaaccaaaaatctctacatagcaaagaaaataatcaacagagtgaaaagacaacatgttaaatgggagaaaatatttgcaaaatatatatctgacaacggactaatatccagaatatgccaagaactcaagttaacagcaaaaacaaaaccaaaccaaacccaaataatcccatcaaaaagtggacaaaggacatgaagacatttctcaaaagaagatgtaaaatgaccaacaggtatgtaaaaagtactcaacattactaatcatcagggaactataaatcaaaaccacagtgaggtatcttaccttagaatggctattattaaaagaccaaaaaaaaaaaaaatagatgctggtgaggaagtggagaaaagggaattcttagttggtgggaatataaattaatatggccattatggaaaacagcatagagatttcccagaaaactaaaagtagaactattatacaatccagcaatccccctactgggtgtttatctaaaggaaaggaaaggaaatctgtatatcaaagggatacctgaacccctatgtttattgcagtactatctacaatagctaagatatggaatcaaccaaagtatccaccaacaaacaaaccgatagagaaaatacatatatatatatatatacacacacacatacacatacaatggaatactatgcagtcataaaaagagcaaaatcctgccatttgcagcaacatgaattgacctgaatgttaagtgaaataagccaggcatagaaacacaaatatggcatgttctcactcataagtgggtgctaaaaaaagttgatatcatgaaggtaatagaatgatagctaccaggaggaggggaatgaagagaggttggctaacgtatgcaaacatacagctggatagaagaaataagttacaatgtgtgatagcagaatagggagattatagttaagaataatgtatcatatatttcaaaatagccagaagaaagaaattgaaattattccactacatagaaatgataaatgcccaaggtgctggataccctaaataatttgtctcggtcattatacatcctatttatgtaacaaaatatcccattatcctatgtacaaatattgtgaattaattattttaaaattctgttaaaaaacaaaaattaggcttgccttattcaaaatgttattctgaagcaaaatgacattttgaatgtgcacacttctggggaaatggttcagagtctatagaaaaattctagaaatatttcacaatttatccaaacccagactagaaccactcttcactgttgcctagctcatttgcagtgggatcaggatgagttggttcagactggcaatgtcgtaggttgaatcagatgcctaagaccattcctgttctgaactcataggctaaatgcctttctagagccaaatgttcctctctagaagaaggaaaggatattacctggggcatcctcttgccagtatagcactctcctcaaatttgagccctctttctctgagtttcagtgtatttctggtgtaagaaatatttcattgccaccttagagatcaaactcaaaggattaatagatcctgagggtgatagagtaggtcatagaaaagagatacctatccattccacaaatgctcatcaactacctactctagccactctgggaggaataatgaagctcattgagaagacgtaaggatggtagtagttacactgatcttctgctccaaaattaatttggggttttccttcccctcaggatgaccaaattcatggtgaggctattcataaatcctgttgacttgccaggtccacagccaagataaatgcacagctgttttctaaaggcatttgacctcttctctaatcacctcaagttgagaagcaatgttcattgctgactttctttgttttgacattaactatgttctcaaataaaaaatcaagttttacttctccagccattaaaatttctctcatttttatgaagtaatatttctcaaacatttgaatatattcatccatttttgtgccacttcatctattttctagatagattatgatattcaattatgtgtattttgtctttcttttttctttttttgtagaatttattcgatataatcttggctcccattttatttcccacttatcctcttttaaaaaatgacttatgcttttttaatgaggagtccaaaatggcacacagaactctaagtacagtgtaaacaaggccatctgtaatgagaaagccattcaattcagcaaagatttttctaaccagctatacatagtcatgacagaatcctcagatttagtgtttcctagtagcaattgtaattcttttgattgctggcctgtaaaatacttagtactatactgtaccatgacagtggaaatatgtaaatagaacctccatctccagcctgcttatataaaatgaataccactggtaaataatttaatgttaaatgtagttacttttacagaaaaatatatgctgtaaaataacttctactcttttttcatacattcagatagcctaaaaaaaggatagatgtcagttttttaaacttgggggaaaaaagaacccaaacatgattatatactttgctgacctttgaaatttaatttgaccaaattttgaaaatagtctttgagaattacagagtgagcaaatgccagtacttcatgaaactcaaatcgagtttttttttaaataagcagtgtaggtatcgtctttgctttttccatgtctttaagacttttaaaaatcttaaaatatgactgtttcaccactctttttctttttttatagaattcagaacttaagttaaatttgacaagaggaaaaataaaatccaaaccacatctatgcttattctgctcttggcttcttcctacagagctgtcctttaaatttgcaatgtaattatgagtttccataccacatatgccactaatcccacgaaagtatgtggcccttcagaccacatgaaaaaaatctctcagggcaccttgggtgctttacccacttgccatgtccaaaaagagttccatctgtgcccctgatggtcagataacctgtcctgggtgagacaaaagaattattcccaaaggccttttcctcctgtgcttcttatgccctcacaagcaggttgtttctgagcaccttcacaggcattgttcagtggaattcacacagtgaccctgggcaataagtgatgggattgggagtgtagatttttatccttatttgctgaagaaaaatctgaggctcaggaaggagggcaatgatgtgcctagagtctcatagatttaaatggctggattacgactcaatcccaaatcttctgttctttggactaaagatttaaatgaaggattgaacaattggattacttttaatccttcataaagcttgaatgaaagacaaatgcttattttaatgtctcttatgagcactcactagaaatattctctagccgagcacaatgttcaaaacctttgtgtggaatgttacattttgctgaaatgaatggatgtgcttacatgtctgtaaatagtagaatgaaaaagctggaaaaggattttagcaagagtccttcattttggtactcttgttaatcatcctaacaatattgtaatgctttatagtgtatggtaaatgtttgttaatacttagagggagatacagaaaacaactatctggttaaatttacttaaacatatcagaccagctttgcaaaacaaagggattcccacttgatattctgaagaatatttcagaaaaatatgaatgtatttcttttgtattatttattgatttttaaattttagatccaggggtccatgcacagttttgttacatggctatattgcaggaagctgaggtttgggcttctaattatcttgtcacccaagtagagaacataggacctgatagctattttttgacccttgccaccctctcttcctccctgcttttgcaatccactgttgatgggcaggaatgtatttataacgcaaagataagaactgatgctgggcaatactactgggttgagaattgggagccttgagtttgagttctgaccccgctactacctcgttgtgattttggcaagcctcttgacttctctgggacttagctatttcatcaatgaagtaaagagattgtccttttcaattactgctacatatcactttggagaggcttttaaaaatacagattcttaggcctccttttggatactctgagtcggtaaagctgaagctggatccaggaatctctattttcaaaaggctgtcatagctatttgatgtgttgtcaggttgagaacaccggacttgctgaccttctagctttaacattcccaattccaactggacagcactgaactcagctcatattcctctatgctgtgcttactcgggagcgggagtggtgagaagagccaaagctgtcgtcaccaggctatattacaccaccttccttggtggtgtccctgcccacatgcccagctcttcaacaccactttctacgctgctgttgggattttgtgtgtggttaaacgggatggagaaagaagggaaaaaaggagagagggagagaaggaaggaaggaaagaaaggcaggaagaaaggaagaaggaatgaaggaagaaaaggaaggaaaaagagatagcttgcagtggctagaaaatgtaattattttacttccttgaataactacttttgcctataaaagtggattctttatcacggcacttaggttactttaaaatcttgtcctaattcccttcaaatcttgtctctagcccctccaaagatacttctggtcatactgttctcactctctggagtatgtgttacagataatgaagttttagacccaaccaatttctgcctcatgaaatcattctcacttttcaaagctcaacatgtagtaagaaatgtgtaatatgacctccagttcttccttccacaattccaaacatcttattcacactgtcaataaagcattatctcagggttaaaataataaagcaactggctttaaacacatttctccccttatcaactaccccttcccagctatttgaggttgggggtctccataccatttactttaatcatcataaaattaacattcatgttttgcttgaccatttgccaatttctttacatccattattttatttgcatttcataacatttctgttaaataaattttttgtcaacccattttattgataatgaaactgcaaacagggaggtttactggtttgctggttaatgatgaagctgagatatgaacctagatgctgtgatttcaaatcttatgattttcctgcactgatttacaagacatcgacaggtgctcagcaaatgcatattaagtgattaatattaagtgaatgaataactggtgagaaaaggcctcatggtctcaaataatggtctctggtctatgcttgcatcttgaatctgcttcttgctatctgaacaatgtcagacaatatatctaatctgtctgagcttccctttccttctttatcacatggggaaatcatactgccctcatataggtgtgtgtgtgtgtgtgtgtgtgtgtgtgtgtgtgtgtgaactcagtgatatgaaatgtgtaacgtgtcctcaccagtgtgtgcacagagtaagtcctcattatatgtttgcttcttaattttgtgggaggcagtcattttgttattcattgcatctgaattttatgcataagcctacctgtggaggttacatttattcctgagattttaatcctctctcatcttcagtgagaaacagtaagagagacactatatgatgatagttaagaacacagggtctaggcagccctgagttcaaaacctgattctctgcctttgtagccttgtgagtttggccaagttactcactctctccatgcctcagtctcttcttccataacatggagaacatgccatttagaattatgcctggtgtgtgataagtgccatgtatttggggctattacttatgttatgggggcacaaaactaataataggcatggttagcacaataatgagatatttgtcctttgtgtttctcaaccaaaattgatgactcttgtaatataggatcaacagtaaactgggaccttgtcatttgcatttggaatagtaggtaacagtaattagatgagcatttgaagaatacatgagaactcacatataggaaaacaaagtaggagtgtgcattttgtatttaaacataatgaagcatcagctcttatgtatttatgaatggagaaggaaaaaaggtcattcgacttttgttgagcaccgtggattactatctttgatgctgtcatttgaaataacaaaaactgcctctgcctttccccagccctactattgaacagaaagaactggaaggagaaagagtgccatcttttagaaatggttcctctgagtcatagttatcccttttgagtaccacatcaaaggctctatttcacctgagaaatctcatacgcatttcaaaagtcaaactgtaataacaaaacctacactacctataatgtcaaaacatcaagcaagatgtaacaatctctctcatatcctagtctcatacatattggtgtgagttaaggacaaaggtacttttgactttaagacagtaagaaatgtgaggtcagtgtccttgggaataactagaaaccagagatatttattgcctagagacaacgttaagatgatctcagaaaggttttctttggaatggtggagattaagtggcaaggccaggtattcttgttaccaaaataaatactgcttaagcaacagcaaacatgggagagggatgacagaagaagggtttctctatccctttgctggagctaaagtaaaacaggcaaatgattttgaaggctcagcatttaaatctaccatatagggtttaactattggtgctgtactgctgtctgttgatagaactatgccttctcctgaagcttcaaactttagttgatatctcaggtagaaagtgtgttcttcaacatctttcatagctttggcaacactgatcacgttgctgaaatgcctcctcaccggagatcttaccacctgtgaaattctcctcaaccctgctctctgcctctgaattcctggacagaattagagctgatatacaagaactcccaaaggcaagcctgcccagacagtttttaggttggtagttcactgtccaggggacccagctgccactattctacaggcctttttccaagggtaacacaataatcacaatagataataacaacagagaatgtactatttttagcatttcatatccattgtctcatttgatttttattactatgccggataaagcaatggtgctaagagaagtaacttgcctgaaatttgtatttttatccattataattcgttgcctctctaggatccaatggccccttagtaaaaaatactgatgctttaactctaggttcccaaatgccatttagctccccaagcatcgtactgtggcaaaaactacatgcactttgaaatcagatctgaatttgaataggttctgttacttgccagctaggggaccttaagcaaagcttcttaccctctctgagcctgcaacactcaaaaaggattacaaagcactcacatattaaaatgagttaatgaatgtgaaagcacctagaacagagttttgaaaatagtacatgctccgtaaatatgaaattcctttttcttctttcccctttgaatacatgggagtttcctatacaatgctttggtattttaataagatggtcttaattttactcattgcatgcatcttgaggccagtgaagcactaacgcaattatctctgtcaagccttccagttattaaaactaacagccatgacacaaccttctcagttcaggcagcccacctatatttttaatgggagtattggtatatttacagtctccatcagaacaaagttctgttattattttgactctaggaccattattttatgtgacagtgactttgtcagaggagagaaaggatgtgactttaaccctggtttttaaaaaagagcaattttcctattataaactagttaaaaactcttgttgaatagcatattgcaattgatgtttggggtaatatgccagttttagcaagaaataacacgaaatagaatgctccaaatttattatttatttgcacctgtgctcacccacttattttccttcagccttcatagttcttcagatatttgatgagtggtgtaggtgatgaatgaatggcacatgtctgtaaaacactaagctcagctcaagacctgcagatcttcctagtgaactaaccaagtggttcagttgataacacaagtatagtatcccaataggtttagaccctgctctggactctggagaacattgtatctgtttatgtcattctaaaacatagccaccctgttgcaaagagtttcaaattttggagaccagagacccctttgagaacgacatgacttataaatctttggaaatgtgagtcttcggaaaaattcacaaacacacacacacacacacacacacacacatcccttttggatgtaattccataaagttcagtatagcctagtgattaagctaagggctttggagttagataacctggcctaaaataatgaccctactgctatttagttttgtgaccttcttcaagtcatttagtctctttaaatttcattttaaaaatgggaatgaaaacagtacctatgtgatgagtctttatgagatttaaaggagataaagcatgtgaagtgctcagcacactgtatgacacttactaaatgctttgtacatttttgttattttaagggagttacagatctccaaagcttatttgtgggcagcagattaagaatttctgctatgaaaagaggacaaagttcaaaccaattaaggaccatctgcctaccataaaaacaagatcctattgaagttaaataactatcaataaaagggcattcaacaactaggtctgctaccctgcctggccctgagcaagtaggacaatgggtccagccatgtccctgttctttctgaggagtggcaactgtgcctcctactgcacccgcctgtaccagccatggctgagaacttggcagtcatggatgctctctacacttgactgaaaaagaaaacagcttcttggctgtctgagccttaaaaggtgattgtcctattcctgacatattctttacaaagttctaggtgtaagaaaaggctgtttcaggttttaatgagagaatatttgttagagagaatatttgttaagcgcccagcttaaggacacacacaaaactatcaacaaatgccatctctttccaaaggtcaagagagagggtaactttacttgacgaagtcacagctctgggagaaattccactgacactcaggggactaagttatgtagtttaactaaatttgacttgaaataagtaggcatttaagagggcttttctctggggattttacacatattttgctgatgttgtattttaaggtatcctattttggtcaaagtagattctttagccaaatcagtacattttgaaatgactaaaatatctagcagccagcaagttcagatacactgatctttaggaggaaatagccacaaattgaatagtacttaaagaattctgtatcattttgctttgtttcagaaagattatcacagggaaaagcttagttaagtgactttaatattaatatattcatttctgtatttccaatatctagcataattctcacaccaggtataggaaagtgataactatttattgaatgaattttctatatatgtatgtcaatatccatttttaagaactccatggtcaggcatggtggcccacacatgtagtcccagctactcaagaagctgacattggaggatcacttgagcccaggagtttgagtctgtagtgtgctatgatcagacctatgaataaactaggtgaggggaaatttactgtgcaaatacctgctatggctgatacaaggtgcagattatagctctatggtggcctggagaacctcacacttcttaatgggttctctaagcaggtgaccaggagaatcactattctatttttgataaagtttcactgatcttttttcaactagtcttaccaaattctctgagcaacacctgctgcatttgatctcaactcaatttcaactccactggggtgcatgggtgggaacaagagaaaaataagggaaatatttaagtaaatgaaatttagcaatgtcagaagagacagcaggacaaattgcaatcaataatccaccagcaatgctaatcacttaaaattgtacatttacattttccaatgcaggaataatgatatcaatatgaataccaatgacaacagtaacgataatgagttcacatttattgagtatttactgtgtgctgtagactgtgttaaatcatttgcatggcttatttcatttaatctcacaagaatcccaggtggaagagactggcatttcctttcctcctttatagataaggaaactgaggcagagaggagttaaataaattatggacagatgtagagccagtgtcagagcatcaacataagaattctccatcgttatactggcttttctcacaatatggccttagaattacctgggatgcttgctaaaaatgattagctctcagtgttatctaaagcaaatgaatcagggtcttagggatgaagatcaggactctacatttaagagacagcaggcacagtatttcttacgtacatcacagttggagaaccagtgtctgagcagtatgaatttcacagcctgatactgctacatgaaccagattgagtaaaatgattctcgtttttactatagagtcgtataagagagaaaatatatcacaacattaaagagaaacagtaaaatcacctcaactattgaaatcatttcaacagaggactcaacttctgaattgatcatagagatataactgcttttgaccagctttagaaggcagatttttgtatttgtctctcatatggaactggggcctcaatttcccatttgtaaaacaagagtgtcggactagacaaaattttataaaactgcaggtttaaatattaataaatatataaatgttttcccttttttaaaaaagagaattcactatacaatttcttaaaataaccttttttttttttttttttttttttttttgagacggagtttctctcttgttgcccaggctggagtgcagtggagtgatcttggctcactgcaacctctgcttcccaggttcaagtgattctcctgcctcagtctcctgagtagctgggattacaggtgcccaccgccatgcccagctgatttttgtatttttagtagagatggggtttctccatattggccaggctggtctcgaactcctgacctcaggtgatctgcctgcctcagcctcccaaagtgctggaattacaggcgtgagccaccggaactgtttttttatatgtaggcttaaaatttgttgtaaaaactatctggaagtatatttagtatgtcttgacaagtttagacaccatttaaactctttgacccagtaatagcatttccaaaaattttgccaaagtaattaaccagagatacagattaacatttcttctacaaagatgcttagtgaaccactacaataaagaaaaaagaggaaaatttaaaatgcccaacaatgaaagaatggctaaatattgaataaatcattttattacatgtaaaatggattcctatgtcaccattagaatatcagatttttctagaatcctaaatgacacgagaaaatacttcttaaaaatgtcaagcgaagaatgcagaataaaaaattatatatatatacaggctgggcatgttggctcatgcttgtaatcccagcacttcaggagttcaagaccaccctgggcaacatggtgacaccctgtctccactaaaaattcaaaaattagttgggtgtggtggggcaaaactaaaatcccagctactcaggaggctgaggtacaagaatcacttgaacccaggagacgtaggtttcagtgagccaagattgtgccactgcactccagcctgggcgatagggcgacttcatctcaaaaaataataaataaaaattttcaaaatttggaaataatatatgtatacacacacatatatatatatacatatacatacattttaatggtcatatatatcctattatgtgccagatgaatatcaggtaggtctctctctctatatacacacatatatgtatacgtgtacacacatatgtatacacatatatatatacatatatacacatatatacacatacatgtatgtacatttacatatatacatatatatgtatagatatatgtatgtatgtgtgtgtgtctgtgtgtgtgtgtgtgtgtgtgtgtgtgtgtgtgtgtgtgtgtatagagagaccgacctgatttcatctggcacataataggatatatatgaccataaaaatgtatatatatatatatatgtgtgtgtgtgagcatgtttgtggggtatgtgtgtatatgctttaaaggtttattcaggaaataaaccaacacgttttaatgatggctatccctggaagctgcaatgacaggttatgtgtattttataaaatattaataaatattggaatatttattgggaattttctgaagttcccaatttgtccacaatgaacatgtgtttattttgtagttagaaaaacatgttattacaaaataattcaataggaaactacttttagaaatgcatttatgatgcaaggtgaagcatatctgcaacatgcttcttgctgacaaagaggcctctgaagcaggcctcaccaatgttcccaacgatggtaaatttggcaataattgtgttgttaggggagctccaagcttaaatgctgcaattatgagctagggtacacaaggacatgttggaagtgacaggcaatatcagcttcctccaaaataatggtcaagcgaatatgtgcttttgcccaaaaaggaaagtagcacagctgtaactggatattgtaaataagtggtcaaaggttccctaaataagcaatatcatataagcctccttgaggcatattttttccttctgggagccgtgttaggctcacagacatgaaggcagccaggaaactgttatctgtttacttctaatttatttttataactgtccatgccagcaacaacaacaacaaaaatgtttctaggagaaaaataaatttggcaataaactctctgagttttcgaaaaatcttaccaaatcaaaaacttctacttatcatgttgctgtcaaacccagcctcataaaaactttacttataattgagtgtatgtatgtctatctgtactgtaaccttgatacttggcctcaaatcctggttctgccaggagcttcgtgcctttgggaagatttcctagcctctccacatcttgcttttctcatcttaaatgtagacaatattataccatgcagggctctgtgaggttgaatcagaaaatgccactaaactgcaaagcacaatcccaggcacattgtaaaaatggaaaaatcagcttgattccattcccctcttgccatacaaggatatttcaggtctctcaaaagcgtttcaaggaatagaggaagtagtcaaacaagtgtgtgtgtgtgtctgtggatgttggtgtgtgatgaaatatacatataaatattatatataaatgtatatattatatataaaatatttgtaaggatggaataactagtatctgcttaaacaacaactacacttcgaaaatcctttatttttcctgatgagttttgttcaggtgaagatgttcactggtaaaaagacaaggcaatccatttcttttctacagtgtcagctttgtttgaaggacacaatgacatctattcagaaaggtaccaaccattttgcttttaaaatactgaggcaaacctctctgaggtttcttcaaagccaatggcaacaaacatatttcagcatctgttttgcttcactgtaggtctgtgtgtgggtaggttataaaataaaaatgagcttgccattacagatactacttaaaaaccaaaaaaactatgatcatgatgttgataattctgtattcattatcctaataaaaacacataaatgtctagaaagaaatagacaattatgtattaggccttccgtctcttatttaataatagcagtgtcattgctctagttaaaacccgctctgatcttaataaatctgatgtaaaaacatatcaccagatggggactctgttaatcttatgcgatactttcaactatgatgactaatagttctataatttttatatggttgctcttattgaggaaagagtaaccatttaagggaatcttccaccactgttctttgttgaaaggaaggctggatctacatgcatgccaacatactactgaaaagtaaatatgcaatccaactattcaacaatttggaatcattgcaatttttatagttccagatggtgatctttatccagatgaagtgagactattttactactttgtcagaactctacaactaaatatttataaccctcaaatacacagatacattatcacagtgtgtgtgtgtatatgcacatgtgtgtacacacttttatagaatgagaatgaactaggttttgtaaaagtttcagttacaagccacatgcctatgttacacattctgtctgtaaactacctacacccacacacatatacattcatgcaccaatataatatggttttcaaaatcatgtcacatagttgatctcattttatctcaacaggaaccacagtctaattgaaataaatgcctctgccatgaaactaagtcagttagtaactgtaaaggagttgatttacaggaatatctattccatggcctagctaactgaactcattaatgacacatgttatgtaatgcttgttaaattagtgaatgctcttacattgaaagacacatagtaaagtgctgaatttcaggaggtgagctagtagtttcaatgtttgtgggcaccatttaatgcataggaagcctgcatttattgagtaaaatttagagaaaaaaagaggccctgcccattgtaactcaagattaagggcaacttcaatttcccagagcctccgtaatgggcactttaggagaggtgaatatggtttgactggatagagtacaatggctttttacattgataaaatttgctgtacaattgtttactggtgaactttttaaaaatggaaatagaatgtaggcttcatatgttactaaggatacccttgattatgtaataggcacttgcattacaaaaaatgaaaatggctgaataggtagcctgagccatagtttctgcaacctgttctcctttccagtgttattaatcacttgaacctcacctgctgctctggctcctcctccttgatctttacagatatgactttaggcagaaacagattcaggagcccagcaccacaccatcctgctgcagttaacttgaacatacgtcttatctctgattactactggcttctgctttaattccctgtgcttatcttccgtccctgagactccagtccacctggccttccaacataggcttaagatactctcttcctgtcccatccatgaactgcaagctggtgtatagagcttcctgaagtcacatgatccagacaagtgattaccaattttattggataccgtatctattagtaaaaaaaaaaaaaaaaaaaaaaaaaaaagtgcaagcacctccattacgtatatttattttcaataagttatgttcttgcactattatgtcaaaatattatctattttacaaaatacaagaaaaagaaaatttgtgagcggataagaaaaaatataagattttatttccatacctcaataagttgtcctgttcacgcctgggcatatgtctaggaattacctgttctgagccactttttaggagactgttatgttttgcccccaaagactagtcagggcacactattgccaatatgcctggctagatggagcttttcctagtgcctggtgagtggttcctgctcttgcatctatctgccaccttacccacctaccacccagtcccatcagcctctgcttcatcccagtgaaagggctcattgcggattccaatccttatcattttgtcttatgctactgtaattaaataatcaactccctgggacaagaaaaggtaaaagtttcttcaggagttagcaaatggctacaagcaataaaaaggtttagaaggcaaatagaaatttagttacatcattgttatagttgtaatgtagtatgtttctctcaatgggttgcaccagagttcttttttttctacttgtttctattgagatgttatttgtaaaatgtaatttatatctgaggtgtctacacatgatagatgatacataaaattttatctgtgacacaaagcaataagcaaagtagggcacatgtaacaaatggtcctgagacgtatagtgggaaaaaataaacttgtatccctaccttatattaagataaattccaaacagattaagagctaggttaaaaaatcacaaatacggaaaatgtagctaaacatttatctactcttaagataaaagccctcaaattattaaagcaaagaaagaagttacaaaagaaaaaaaatcaataaatttgactgtataaaacaccatgaacaaaagtaaaaaggggactaaaaattggaatatataattacaataaatgtgagctggagaaggttcatctatctaatacataaagaactcttgcaaaaagtaaaaaactatgcaaccccaatagaaaataagcgaagagacaaacagaaaattaacagaagataaatggctaataaaaatattaaaaccatttttattcacaccagtagtccaaaagtgttaagtaaaacaacactgaaataccactttaacctaatatgtggataaagattttttttaatgaaaaacatttcctgcagcagcacagtaagatgagaactctcaagcagtgtggcttggagtgtaacctggtataacctttagagaagtattttttgcaacatatattaatagtcttaaaatagtcatattctttgacatagttattttactaaggaaatattcagagataagccaatgtttcagttcaaagatgttccttgctgataattttaataattgggaaaagctagaaacagcctgaatatccaataattggcaaatacataagttacaaaatctttttagggtgaaacattttgtatccatataagtaatgtttgaaataatgttaagtgatatggaaaaatgctcatgataaaatgctaaattaaaaaaagaaattaaaactgtacaatccaggtaattgctattagtatcatacttgcttggaaaaagaatagaagaaaataactaagaattagcagtgattatttgggagtgtgttgaggttatgagaaatttatatttgtatttttattttttctatacgtgtgtcgtattgtgtgtgtgtgtatatgtgtgtgtgtatgtttaagagtcttgttccatcacccagggtggagtgcagtggtgcaatcatggctcactgcaccctgaacacaatcctcccacctcagcctcttgagagctggtactacagggacacaccataaaaaaataatttttattttttattttttgtagagacagggccttgctttgttgccaggctggtctctatttctaggcttcaagcagtcctctcactttggcctcccaaagtgctgggatttctggcattccaccatgcctggcctcttgctaggtttttaaagaaacctagaatgcacataaattgcctttataataaaaactattttaagggctgggcatggtggttcatacctgtaatccaagcactttgggaggctgaggcaggcagattgtttgaatccagcttgggcaacatagggagacactgtctctacaaaaaaaaaaacaaaaaaaattaaaaaaaacaagccaggagtggtggggcacgcctgttgttgcagctactcatgaggttgaggtgggagtatcgcttaagcatgggaggtcaaagctgcaatgagctgtgattgagctactgcactccagcttgggtaacagagcaagatcctgcctcgaaaaaaaaaaaaagaaagaaagaaaagaaaaaaagaatatgtaagggtcattgtgccttgaatataaatattttgtagattatatgacaagaattttaaattaatgttttcctatttggataaaatataaagatgtccaacaatagaatgtagttagaagctgtgaaatacagaactagaaaaaactttttaaaattcatatggaaccaaaaagagcccgaatagccaaggcaattctaataaaaaataacaaagctggaggcatcaccttgcccaacttcaaactataatacaaggatacagtaaccataacagcatggtactggtacaagaacagccagatagaccaatggatcagaatagagagctcagaaataaaactgcacacctaggaccatctgatcttcgacaaagctaaagaaaagcaatggagaaaacactccctattcaataaatggtgctgggataactggctacccatatgcagaagattgaagctggaccccttcctttcaccatacacacaaaaaaattcaagatggattaaagacttaaatataaaacccaaaactatagaaaccctggaagatgacctaggcaatcccatcctgaacatagcagcaggcaaagattcatgacaaagacaccaaaagcaatcacaataaaagcaaaaattgacaagtgggatctaaataaacttaaaagcttctgcacagccaaagaaactatcaacagagttaaacagacaacctacagaatgggagaaaatatttgcaaactatatatctggcaaaggtcaaatatcctgcatctataaggaacttaaacaaatttagaagaggaaaacaaacaaccccattaaaaggtgggcaaaagacatgaacagacacttttcaaaagaagacatacatgcggccaacaagcatatgaaaaaacccttaataacactgattattagagaaatgcaaatcaaaaccacaagataccatctcataccagtcataatggctattattaaaaagacaaaaaataacagatgctagcaaggttgtagagaaaagggaacacttacaaacttttggtgggagtgtaaattagttcaaccattgtggaaagcagtgtggcaattcctcaaagagctaagagcagaactaccgtttgaccatgcaatcctattactgggcatattcccagaggaatataaatcattctaccataaagatacaggcaaacgaatgttcattccagcactattaacaatagtaacgacatggaatcaacctagatacccatcagtcacagattagacaaagagaatgaggtaaatttacaccaaggaataccatgcagccataaaaaagaatgagatcatgtcttttaacatggatagacctggaggctattatccttagcaaattaacacagaaacagaaaaccaaatactgcatgttctcacttataagtgggagctaaatgatgagaactcaggcacacaaagaaggaaacaacagacattggggtctacttgatcagggagggtgggaagaaggagaggagcagaaaagataactattaggctttgggcttaatacccgggtgatgaaataatatgtacaaccaacccctgtgacatgagtctacccatataacaaaccttcacatgtacccccaaacctaaaataaaaattaaaaaaagaacctgtgaaatgtttacatatttcatatttgactgtggacaaactgctactctgctatactttatttttaaagttgtattgtaaagttgtactacgttccccataaagcaaactatccaagatacagtccagcagagtgcttaatggccataggctttggtgtccggaagtctaggttggagcactggctctgcaacagtgtgcaggtgattttatctctgcaagcctcagcccaactaaccaggtgtgtaattgttttcccctccatggatgccttgtaaatcttattttctaataactgaataatgactgaatatggttaaccatatcatctgggttttttttttccccgagatggggtcttgctgtcacccaggctggagtgtagtggcacaatcacagctcactgcagccttgacctcccagtctcaagcaatcctcccacctcagcctctcgagtaggtgggactacaggtgtgtgcaaccacgcctggagaatttttaaaaatatttttttgtagagacagggtcttcctatgttgcccaggctggtcttacattcctggactcaagtgatcctcccacctcggcctcccagagtgttaggattataggtgtgagctactgcacccacccagccatcatctagattttaaatgccaaagtgataatatggagcagatagaataagatccagaaataaacaaatacccaagtgatactttcattattgctttctttcctaggtacccttgctccccagcataacaacgtgcacacacagtcgtagcccagccatggttcttagcattgcaattagatcatcatcatcactgaagtcacattctctagtcacattatacataaaaatgtcaaagaatcttgccccctctttttttgatgagggagtaaactaggcaactgtgaggtttttacaacataaaattctttgttaactctgttgacatttggaaaaatggctttatgctggctttacagcagcataatctctatttgtttctttaaaaatgctgtgattagttactgtcttttcctttaaaataaacaatagtgctgccaaaggaaaaatgtataactgtttgaaaggaatacattttatgattaacatatctttatatataaacaaaataaaatatgacttctctctagttaaaatcatcttcataaacaaatacttcaggaatagattgttaattggcaagctaattggatgcggtacttgttctgggagcatctttattacttccattactcaaactccctccacctgcaaacacagtcactacacacagcgtactcctcattatcacgatgggatatagatgatgattgaagaaaatgtatgcatttttttcattaatgattttactcctctcaaagggacttttaactctaagtaaagtctgtttatgaatttctgataaaaccaaattattttacattattaaatttcattttcatagaatctcttttctatatctttcttaatgtacttttaggcaaagtcaagttatttttcaaaattgggtttggttagaattttgatcattaaaaaggatattaaattattcttcctccagctggaaatcaagccctctatggcaccctagaaggaatcatcactcagtgaggagtgatgtcataggagtgttgaataaataaatgcttaatgaatacatgagtgaatataagaatgaacaaatctataaggcaaacgaattttgattctttcctatcatttaataaggcaaactaatttaaccaaaggcagaaatcaaatctactggtgtgtttcatgtataaccactataggtaggttttgtcttaaaaaatagaaaagcccaaaataagacagctgattctcaagcaaagatgagaacaaacacaaagcccttccagagctacatgatggaaactgtgcggaaagtaaagactccctcttccagtcaccaacacatgatacttggagaagaatgtacaaaaaactgggaagcacttcagacagactgcccagctctatttgctaataccattaatgattagttcacataccaccctcctatttctcaatcccaaggttcactcagatgtctaccctagttttccctcctattttgcttttgatgtggattgatttgaataaaacatttaagaaacactaatttagagtaagagctaaatgtctgttttttaaatggtgtcttggcttaaagatagaaaagcagtcattaattttttgtcctaataactaaaaatgatgtcaagcagagcagatggcaagaagagtgcttgtacagcactaagcacctcatggtgccggatgactcaaacaaagcacaggtcaagaagcccctggcctgaccaacattggtcagaggagtccaggaaaatacatttcttcttcttcttcttttttattttttacatttcttcttctttacattaatgaatcaaattttcaattgaaaaattaattagcacacatagtaaaatttccccaagtttaaaatggtgagtactcagcccccttctacctcagattccaaacgtgtagccacctcttcctcaaagctagcaacttctaccatcaccttaagtgcatacgcagaaagatgcttttgagtgaaacatatttatgtatgtacagtcttagcatatttttccataactgggaacattgtgccttaacttttccacttaaaaatacaccttgactacatcaataatgatgcagccattcaagagaataactttctgctgtaagaaacatgagaatgcagatacactggaaaataaccaaaaggttaaacttagagctaccatttgtcccagcaattccactactaggaatatacccagaagaaaggaaaatatatgcacacacaaaatcttttgcataaatgttcattgcagcacatttcaaaatagccaaaaagtgaaacaacgcaagtgtctatcaactgatgaataaataagcaaaatgtggtatattcatataatggaatattattcggtcctaaaaaatgaaatctgatatatgctacaacatgaatgagacttgaaaacattatgctaagtgaaagaagcaagtcacaaaagacctcatattatataattccatttatatgaaacattcagagtaggcaaattatagaggaaaaaaacgtagattagccgttgcctagagctgtggggtggaagggaggcaggtgatatggagcaggtaatgggggagatggagggtgataactataaggtaaggggtttcttatagtggtagtaaaatgttctacattgattttggtgacggttgcaaaagtgtgtgaatatactaaaaatcacgaaattatacaccctgtattgatgaagagtagggtatgtgagttatatctcaacaaaggtcttccagaacaacacaagaagcttctctatgtattgacacactgtcaagtgcaaaatacaaactgcagaacaatgaatgtgcagattatacttctttttgtttaaaaagggaggaagagaatagaatttatgttttcattgcacttacataaactctaagagtatatacaaagaaaactagtgaaaatggatacatgggagtgtgcatatcttcttttcaaagtataaaaataatacaatagtaaatgtcatctggagatagtgtcatactagagaggtcttcctcatagatgcacagtattgtcttatagttgtgcatcagttgttcaatcagccatataccgattgacatttaggctttctccagtgttctgttacaaaaactccagcagaacatttttgtacatatattttttgcacctttacacaagtacatagagtaaatgttaaaaaatgaagttgctagataaaagatagacaagaaatccttaaagtaatgcagctaaagaatatcccttaaatttgttgacaagtatagtagctgtaaccccagtagtattttattgcaattactgagcaaaatacactttctttctgataagaataaatgaaaacaggatttccccattctctgtagttagagcattaaaaaggaagcacaataacttccttttaaaagaaagtcagacaaaaaccaaatggtttattctatgtaagctctggaagttgagaaagagaagcctccttttaataggcatgaatttgtttgaattcattatgtggcttctcgagtgctctgcagatttaaaatgacctttcagcctcaaagtgggagtctcagagcaaaaggatgaagagaatctgtttcaattaagataaacatcaactaccaagccccaattataccatttgaatttgaaaaaggcaaaactgttgtcaaaaaaaattggaaagcatcaggacagcagtaaacctggtaaaatttaattgcatcacgttttgatgatgttactgagtgttcatggaacgtagggctatgtttggatgcattcctccttttccttccctccactctccctggctcattttggagttgtttttgagtgattctatttagctgcattggcatctttacttaaatggacatatctgtgcagagaaaaccctgttattcattatggtcaaagaatggtagatattaactaacaactacgtaaatatactaaaaatcaatacattatataacctctatagatgaaaagtatggcatacgagttatatctcaataaagttcttccagagcaacacaagtagcttctctttgtatcaacatactgtcaagtgcaaaatacaaactgcagaacaatgaatgtgcagattatgctccattttgtataaagaggggggatgagcatagaataataaagtgatacatacatctttaataaatgttatgatgttgaaataattacaatgcaatacatttcatactaaataaaaatcgtatttagttacttttggttgttattgttgcttttgtcatgattttgctgttttgtgaccaaaaatatacttgagaacttgcatacatgaggaaaatgatcgtggcaatgatgtgtgatgggtttcagttcatacaggccaaactgtgtttgctgtttgaagctgatggaacccattcataaactccttaagggtggccaggaaaaagaacaccacatacatcctgagcagtctttccagtaagaatatcagtacctggcctttgatatgtgtggctgtcatgctcatccctactgcagtttggggaaccacggcttacatctgtcttttgcatcaaccatgtcattcatccagcaggcacatcctattaccagctgaaggccaatattacattctttgggaaaactattccaaccatttggtagaatttttttttactcacatatatctactatccaattacatttagaactcagatcagaggcaaatttagctcagagaggcattagaacactgaaatctatgcacttatggcaagagagaattcagcgagggttgcctggtgtgtcacttgctacttaaagtcaaagtgagatcttacacctaataaaaatgctcttgtagtttagcaagtcaaactcttgggagggtcttaaactttgtgtaaagagaagggatttacagcagcagaacattttcaagggcacttttatgtcagaagcctttccttttttcctaggtgaagtccactctctctgacctcggctcaccaaggcccctgggaagacaggctagcaacagaaatcaggtcagatatgtacagaaaacaccccagtcaaagacaaacactggagacttgtaggtaggaaacccatcatttcacgttgtccaacttttcactggaaatctatacatgagtgccatataaatttaagttcttaagacagcaatctttcacttcttttcctttttaagtgattgaaaaagatagcctttctgctcctcatatctgctggatattcaagacctttgtacctgctataatccccttctccccaatgtttgtttgactggttctttcagttctcaacttccctgaccactccaactaaagtacatctctaggacacacagccacaaagagacacacagacacagacacacacccatacacagacatacacaaacacactgtttaactcggtccctcctgtgttctcttcactggacttaaaacacaattaggaataattttatttagtgaatttgttttgcttggtaagctccaggaagggagggaggcaccattgcatctccagagcctagcacagaaaggagataaaatatgtattttttctgtatagaaactaccctaaataaaactgtagaaaattattctaaataagaatcttgctgttgaactattttatatataaaagtatatttatttcttatcttcttgtatcatctttgtaggctactattaaaatataatttacatatctctaagaactgagatacattgttatatcagttagaaatatatatcatatattatatatcatatagataacatatatataatcatatatcatatcatatatagatatatatatcagttagaaatatcagacatttcagtttagaaatagcatatttctaaataatatacaatttagaatataagatatatatattttaagaagactatgtcaaagaagtttcaaggccagatttagttagaagtgatactgatttttttccacattcatgtgactttaacagaataataaatttagattaaatctaattcatacttttattaattttcaaattaaggaaaaattaagttttacctagaactgttaagacattttcagtaaactttccattatcatttcacttgtgagagatcatatacatgtcatatcatacaccattttgtaaatggttaaaattctcacattctcaaacagtaacttgttttaagactaacatgaaaacacaaacataaacaagaaaatattaataggagtttttcccttctaataataaactggctagcattttttttggtttgctgtgtccctaccattacttcaagcactttccatgtattatttcacttaacattcacagaaaccctatgggtagcttttcccccttgtccaaaatcacccagcatgtaaaagaagatgagttccaaattcatttgacttcagaatccacccccatctctccagtacatattgttggcaattccaaactgccctggaattttaatagctcagctctatgttttcctacagcctaacaaaatagaaatactttgaatgaagttaagcacataaggtctgacttcgaaatgataccaaggtttaaaactagccattaacttttacatggaacaaaaaggaatatttataaagccatacagaacatggccatctggcctactcctgatgcaagaagctgaaacatgcttctgaaaactaagtgctttttatttctttctttagaattgttaaaagtttcttggataactgagaaaaaaaagaacctactttctcttgaggatgccagagtaagtatctttcatgtagcattaatgttctatttacccatcaaaaacaagggttaaaagcaacggttacacagagtccctccccaagcctctcatatataatcagaaatatcctaagggaccaattattttctattactcctattagtcagaaattcacatattgcaaataataatttcttctctccgtcggtctgaatgaatttattcaggatgttatactaaattagaaactgtgaggattatgaccaaacaagtttccatgaatttaacatttttttctacaaaactttataggatttcacaaattccagcatcagttgatacacaagggactcccctttctattatctgactacctgaatctaccctgtcttagccaaaatagattatctgttactcctttaaaaagattgtcctgagagtctttttttctttttctccccaagttggttcccattctgaatttggacactaacgaacatagaaatcaaagactgtaaagcaactatttattcagaaacatttcagaagacactaaggtttttatttagtattcaattaagacttgcctcgaaggctgggacttctttatgtgaatttgaaatttacagggtatgtcacacctacgctatatttaggatgcaactgagtgaagatgaaatgcctaaagcaattggcaccaagggaatttggtactttaaacattttggaaagcccaagattgcatgtgtagttacatttcctatattctttctctatctcttttatacacttaacacacaaatggcatgaattacgaaagcaaatgtgtttggcactttgaacaaattatccatcttattgaagtaagttagctaaaacttttctttgtgtattggaaatttagacaattgtttgactattaagaaatgatccatgggaaatttgaaagataaacttctgtactttattcaggaaattactaacaatttataagaaagtcaaatcgtcaatataacagaaacagtgaaaaaccaaaaaaaacaaagcttcaaaaaagctaattacttaaggagggatgaccaagcatataaagctaagagaagggagaggttcaaattagaaattaatttagaattcaattaaaatcttataagtaacgtttataaagcttacaaacaaaatcttacagtttttcccgattactggctaaagtttataaaaatcatttatggaatttcccacaatatacaccaaaaaaaaaaaaaaagcagaggatagtaaatgggatgggttttaaagtcagactaagttcaaaactagccatatagaactggagctgctgtaactgcacacaaatggtatagtagtccagatgtatgactggcagtcatagaataatgtggttcattgtgaaagtcagataataatttgatattttgttgtaaacaggttttccattcttgcatggtgcccttttatggcagttgtaatccttaagggcaggccttttaactgaactacactaggacataaatgccatttccttctgatttcctgcattgaatctggtctttgatagtccattcgaaagtttttgttagatccctatttgatgtaatggccttacttattaatgcagttatagccagggattatgcacagtaacaaaggaatatataacagcactcaagcatagtaatagtaaaatgagtttatttagagagctgacaaacaagctagtagcagttatttatagaaagaaaaagtttatttctcttattagtgaaatagagcctcaagcattcaaaaaatattttaactagggcctataaaaataaaggtctcccgaagattatctgtaaagacagattttggcaataagtgaaataatgccttatattcattttatgagttaattttgtataaaattcacttttttccaactattttttcctgatgtgccctttttgtgttccctctctacagatacattaaaatgttctactctgtatattttatctttgaaaactcaaaggctaaattcattaaaatgagaaagaaatctgttggttttaaaatttatttaaataaaaataaatttaaatatttaacttggctgacacagccttgttaggaggtgattaagtaaacaatttacctagaataaaaatatctcttattaaaatggcatggatttccaggccagtaagaaaagaaaatatctctctaacccagggaaagtattttggtctaaaaaatcaaatattccagatttattttatattactccaccccaaattcaagtagggaggttttaaaattatgttgtttaccactggatttctggaagcaactgaaacacttatataaatgcacactcctaccaggaaagtaaaaactattccaaggatatagtagaaggtgaaatagaagtctcctgccctatagaaatacttcagaaagtcactagaccataaattttatgaagccgagtgctgtatatttcaccattgtctctctaacagccagcagggtacctgtggcagaacaagcttaataaacacttaaataaagcaataaaaaatgcacctttacttttgtaactaatagacccacagaaataaaacttttctttaaggactatatattttaagctatagaactagactaaatgatcaggtagctagaaaatgtttctgtacaatactaaaacaaattacttcctcattattaaggattaagccttaatttccttctttttttttaagcctaatttcttgccattccaaatatttaagtctgggagtgtggtaaagctaaaagctggcttcacaatcggaaaagttcacaatacaagaaggtaagccaaccctaagttgttccctgactttgaaggtcgggggtcaatccctgtgttagggctccaggacaagcttgtcactttggttcagcatccctcctgtggaatctgctcatatgtgacaactgtgtggggtttcaagatgcacacaatgaggttagagtgagcctgaagtggtggtcttagtacttaccaccaacagatttcttggcttcatataaaaatcacccattgatagagtcagaaggtcagcatgtcagtcgggtgataaccatgtgcaacacatttatcagcatttctatatgcactactctttactagtttatgacacgagaagagtcattcgagcagtcagaaaatatagaggaaaacttggaagtatatattttagaatgggaaacacaggaggcaatggaaggtgtgcctagattagaattgccagtggtggtggcaaactaagggtgaaagaaagccacagggaagaggcaaaaatcctcccggatactatacaactcttgccataaagagtaactactgtgtctacaactcacccagtacaatctcctgaaaagtgccatctactaaaagaaaattaaaaataaaaattgactgtaatattctttgtaatatggaagaactcactgttctactttccatgcaaaggacagatgttgaatgcccatgatggagcaggcatggtgctgggaacaggggttcattgctctacaaagatgagcaaacccagtctactccaaaacatgctcacaggagaggtacgtgagacagaagacaataattgtaatccttcaagagttagagaaatgtacaaggtttcatgacagcacagagaagagagttttaattctaattggggaagtctaggaaggcccttcagaagaaatgtccactgagggtgaatctaagcaacagaatttggatattaaatcatactaaaataattattgtaaaatgacaacagtttaaaatgctcaaatagtcatatataccaaattattatttaaatagaaaatctgatttttaccctgaatttgtatctcaaacaaaagtttgcttaattacctatacttaagtgagaatgaatgaaccatatccgcatcaacaagggatcatctttcaaacataattttgcaagggggtgagggaaacagccaaacacaaaagagtacatgctatattattccttttatataaaattcaaaagcaggaaatttaaaaagtttgtgattttcaaaatcaggatcactattatttttagtaggtgggggcaggggcttaaaggggcataaaggtgacttttggctgctggtactatttttaatctgggtggtgattacaggggtgacctttgaaaattagaattacttatttttcttctttgcatttgcaacatccaaaaagagtttttctgtttacaatatttatatgttcttcataggtgacaaatagacaaaacatatcaaaaaatacacatgtatttgtatgtatgcataaaacctgtttctgctacaatgactttatttgcatgcaaatttaatggtgagattagatatatagagttatgatgagatcatcaaggccatttaaatggcaagcagccacactatgtccctcttctgtctggcagagatcaccaatggatcacagcacattttctctgagaccaacgcagctctcagtacattattccaggcagctactgctattcgtaattacaagttgcccatagattaaaaagactagctatcttggttttaaacaatgcagactgtctaattcttttgatatttacatgaaaaagatcttgcaataatggagggatttcacatatatttctaggtaaacataaaatttcattcctatgtacgtaaaatgattttttcagttacacgaatacctttaaaaagttgtctgctaacatcaaatttgcttttttgtgtgtgttttatattaccctagaagctcttactgattcatatactagtagactcttaacgaaacacagaaaagtaattgggctatctctttttaaagcaaaacactcagggaatctttaatggttaattttttttcccaagctggtgaactccaccctcaatcacacttaatccaatgtgcagttgttaattataacaaaataatgcttttacagtttgttttgttttgttttggtaactactcataataaaatagtagatatcagagacaggaatgctaaatgcctgctctaacgtattgcattcttgacatttctagcccctgtggctgttcagctcatcctaacacttcacgccacaagaacagacctaaccagatctctatttttgtctgttgttctttagaaatgatggagaaagcatcttaagccttctgcactgagctgggatggcgggacaaaggaaaaaggagtccttctcagtctggtctgatagagatgatgaggctcagctccagggagataataatctgtgaattacacaaccaggaatgcaccttaggactagaagagtaagggatttgtagaggtagagaatgcctggcagtgtgattaccgtaggaccaagccacagggtggcacccagtaggaaagatacatggagaaagtctttacaaaggtgcacctagagataatgctcaggtagctgaccattcctttcagatgaaacccctgcctagttgtgcttccttagagggttctcattgagttttaaataactaaatcagaggtggtttagcttcccactgaccacttcttattttgccacctccactaagtagtttacttctttgacccacctagatagcagtgtgtcttctttgaatcacactattaacgtgatttatctggaatacctagctctatataaatgcttaattctgactgtgttaaaaaagactaccttatggaaaagaaacccttacaaaatgaatcagctttcacatttagagttcttgattatttagaaagtcataccaatgtgtaaacttcaaaaatgcataatataagctaacagttcctggtcactcacaaggagccagccatgtgctaagcacttcaggtagatcaactcattgaacatattaacatatacatcattgctaaaggtaacattttataattaagaaaatatgcgaatcatgaaattatcttatttgccactcaaatttaggcaagccactttacttcattaggcctcagtctgaggaataagactaatgagtactgtctaggattcatcatgaggatctaatgagataattaggtcaagtgaacagcacagtgcctggcacatagttaagtacacaataaatacaaattgccacaatttttaattcagatgaagactatattgagaggaaagaagtaaatttaaaatttcaagatgcgaattacagctacttacttagctatatgacataagtttaggaattacattatagctcaatacaaattataatagaactgctttcacacatttgcctgacagactaatttttagctctctttttcagctcaaacttcatttttgaagttaaaaaaatatttctccagccaggcatggtggtgtatgcctgtagtcccagttactgggaaggctaaggcaggaggattgagactaggagttcaaggctgtagtgcatatgatcacacctgtaaatagccactgtacctcagcctgggaaacacagtgagaccctgtctctaaatatatatatatatatatattcttcaacaaatctttttaccacttaagcattgacattgtttttaacagtttttcttgaccctacttgactggaaatgttaaagactagcaaaatgtttccagctccacattggggttaggggtggggaaaatcagattataggttattctctgtggtctcttttatttcaaaggttttatggtgctactaactggtcaaatgccagagagaaggaaaactgcaatttatagtctgaccagaggaagagagtcaataagctgaacgagtcaggaactagctagatctccaaggaatggagccgtgtcaaagtccatgttctatttctcaatatatctctagggctcacggttggaggcttgtatacaaatcttggggggaaaggcagacaaataccataggcaaacatgttcttgatatacataagattaaaagaagaaacttgaacagtctaggacaggaaggaaaagtataagtagcagcttgttgactacttttctaataccatgaaacagaactatgtgtagccaaagcagtttagatagtgaggaaaagcaaacaaaacaataagaacaacaacaacaaatatgggatgtagtttcgacagaccaagatttttctgcagcactgtaattttataagctgtgcgacttcaagttttattcatacagtttattcatacagttgcttcaactgtatatagtactaagttcattgtctgtcaaagagtagatgcccaatacattgtagctatcattaatgaggttatgactccaactatgactatagacctagaagctgctttctccagctagctggtgatctagctgccaatcagttacttgctattctataacaaagttgcagtatcagagcaaaaatcacagcccgctgttgcctatcccatgttagaatgccattggttaaaagtggacacattttacagtaatttatcctgactaaaatagtatcagtcatataaattccttgatgcaaagaaaaaactctgtgccacattgcaatggaatgacatcctgaatgttaggaattattattttctgtattccatatgaatgtctcaagcaagttcactaaaaagagctcaatttctcatctttgatgtattttaaacaagaaagagaattagatacaacgggagcacttttctctaggaagtctgaaaacaattacatactgaaattatgtttaatgaaacatttattttaacaagtcacactggtgccatctattttacaatttagaatgaatattttgcaatatgaaatgaaaaaagaccaagaagtcactcactagcagttttcaaaggccataaagaagaattggtttatctattgattcactctcattatatctactgacaactaagaggaaatgggttagaatttaagcaaagaagatttgtattagatataaagaaaacttcctaactctgtgggtttaaaacaacaggactgcttcctataagggtactttggaagatgcaatccttggtgtgcatacattctacacctagtttctagttttctaatttcttattcttcctcatgtgtagtagggaaatggaagggcttgcaggtgaccccctttaccctatggcagaaattcttagggctgagatggggggcaaatgtcctctacactgagtttcattaatggcagcttttgcccagaggttgccagtgttattaaacagggtagggtgctagatggtggatgcttagttcaaactgggctggaattcttccatattggtctctgtataatctcttttttcttgccacacttccccagctcttctcttgaaatattcccttgtgtttttctaactcttattctgaagagcagttcacccttctgttagcttctctaattcgcatcctcagccatcacccaggatgctcattagggagccaatccccttagaaggcttaggacagataataaatacttacaatattgcccctgtcatgctaaaaaactgcatccataggttctggcattcttcctactttccatacttttgaaatgctttctaatttaggtcaaacttgacaaagaactaggcaatttgagagctgagacatatcactggcacgggctctcattagttagttacctgtacacagttatatttaacagtgtctcacccaggcttgctgtcattgtgccccatgtggtaccccagcccttcccataggcaccaatccctggagagatttggtgcttgtggctgaagtataccttacttctgtccattttctaatataccttcaacccctgtattatattttgagatattggatcacctctggaaaggcttccaagaaaatctatattgattttttattaagactgtgctttctttgtgactatcttccttaccaacctagctaatatccctcaggccctattctctatacctttatctaaactttgacaattctatatgtttagtattagtattattgggaatatttatacatatcgctcagcatctttccctaaaaagcttaaaaactccttaaaggcctcattaatattcttccccttcagtttcatcttagaatctacttttctcaatcttgctagtaatggttgggtggatccatgactaaccattcgtatactcatggttaccttcatgtcatcatcccttctgattcaatagaattcactacatgattggaatgattgacagaggaactactaagtgagctattcctttacctctcctaaaaggcaagttttaatgataaggccaaaaccatggtgtgcctcagatccgtggggaagaaaaaaaaaagagttgcagtcaggactaagtattattgcacacataaccacagccagttgacatgatagaaaaagagggtggagaaccccattttgaaataccaaaagaagcgtcttgcttctgaagaatttcataccaattcagcatttctttaccaacaaccatactcacttcctgaattatcagctatgcatcatacagtgtttagtgcatgattttctcattccagatgagcctaaaataaacttgtaaaaaataagatgctaaataaaatgaatagatcttaactattatagtgataactcttctgtgatatctcagaagtgggaaaagttacataacttcaaggtcttataaggcagaggtatttgaactgctacattacctacgagtttatcccaatccatatagagatacagaatacacaaatgactctcccgcggtaaggcagcactgcagagagtaaaactgtaagtgatcttaacagtcattagcttagtggttttcaaacaatattccttggaatcctaaagtctttagaggtattttaaggagagggtttgaatttggggtggggggtaaatgtacaaactcagtggctgttttattgttttatgtgtgcttatactttttacttatatatttcacacatatctatgtttttaaaaattatatctatatattgaatttatatatgattttatatctaaaaattacagtataaatattcatttatattaacttcaactcacatttcattaataaaaaatgtcccattgaaataaacgtgtttaaaatccattgacctgccttgccccttttattttacaggacagtagacttggcttcagagggactaggtgactcctccagggacacagagcatgttagaagtacagtggacaaatggctttttccagggaatctcatacttcatgactttaaagagtaaacctatctgtgatccactctgtgtctttctagttatgttttaaatacatcaaatatttcaaggtatcttaatcatttctaaaagctgtatatctttaagtatatttcataacagatacatcactaacttgggtaataggaccaaaaaaagtttacctcatgctcaaaaccctgaaccaactttgacagtagtcacatacctaaaccaaatcataatatatattgcacaggcagaaaatatgagaattccatttgtttgcgtatttacaagtttctaagatagaagaaataggaaggaagattgcatatttttttcaaagctgatcttagatgtcatacaaaatctgatatgtactacttgtttccaacctgaagccttacagagcttgcagagaacagaaaaacttggtaatagaattggaaagataatctattcaaaattgtgaggcattggccttttgttctttattgtctgttataaagaccagaggaccttatttgctaccagtagagaatataatggtctacaagctgcaagagcctttcacaaagctatttttcaacaaccaacagtctttcacaaagctatttttcaacaaccaacaacgtcaaccctgaatttcataggctaccatacttccgaaaagaaaactgccaaatactgtaatgcatctagaaatattcacaacatgaacacttttatggccattaaaaagataattatatccacagtagaggaaggcaacaagctgaagaaccagagcacgttctttgaggtagacagacttgggttaccccagcctatgaccttgctcaagttatttcatctcacggaatcattttctcacctgtaaaattaggattaacaactccttcttttcaatattgtaataagaactaaataatatatatgtaaaattcttgatagagctctttcataagacactcaataaaatgaaagctataagtattagaaaaatggattttttttttttttaaattgagacagagtcttgctctgtcacccaggctggagtgcagtggcacgatcttggctcactgtaacctccacctcctgggttgaagcaattctcatgcctcagcctcccaagaagctgagattacaggcatgttccaccactctggctaatttttggatttttagtagagacagggttgcgccattttggccaggctggtcttgaactcctggcctcaggcgatctgcctgcctcagcctcctaaattgcaggtattacaggagcaagctacgccgcctggccaaaaatagaaaaatattgatatgttaaatgaagaagcagagtacagaaatagtatttacagctatttaagatatgtaaggtaagttgaaaatgagaataactgaggatggaataatggggttaatgggttattttccttccaacatattaatgttattccatctttttgattctcaattataaaattggacattttagcttatatgaatgctttccactgtgatcatgaggccaaaataagaatgctaagccagtctagatttttacaaccttaagagaaaagagctaataaaaaaattataatcctccattggtcagagttgcaagaaaattcagaaaattgtatccaaccagtactgaaatactcatttgcatattatataacctgagcaaattgtggtttaatgtctaagtagatattggcatatataaagatgagcttgctaatacatatagtaggtatatttttaatattttaaactttcatatataatactttattgataaaaactacatacaatatgcaaatacagtgaagaaaagagaggcagtcccccttaccttcactcctaccatttttttttttactcctaaaaaataaccactaccaaaagcttggacagagtcttccagaattttttctgcatctacaaacctaagtattacatgtatacttattacataataatacttataatgaaaagtataagtactattacatatacaataaccaattttaaaatttgctttaaaaacaaccacagtcatattttgaacagtagcatctcttttattttcagattacataatgaatgatcttacatgtaacacataaatcctaaacactgttctgtcagcaggaaagaaaaaagtccacttccattgactaaacttctctttatatttatatttgtaagactaataatgttttacttacttaaactaaatcacaagtcttaattacattaatgagaagtatccctgggaaatgtttataaatgtttataaaagtgttaaagagatatcaaggaatatgtaaggtaatattttcatagtatataacaactgactaaatctgaatttaagatatgcaagaaaggcaaacaattctgcaatcaatgaatctgctaattttattagctttatgagcataagaaaatatataaagtttttctcaatttcatgcaggcacatttttttaaaataatgcttaagaataaatactataatcactttctgctagaacgtggcatataaataactgttccttaaataaaagcaacctagtatacacctttattaaataaaccctaaatttggacacctatgttacaaagagacaaatagattaattttaaggttatttgtattttgtcttgaaattaataaaattttaattataacaggctgacctttaataagaggaagggtataaaatacaagtttgccatgaaatcccatttaaaatgtgaatatctcatagcaatttaattaaggctgtaaggacaagttagtgtggactgctttttatgatacttggagagaaacaaatagaaaaaggtaaagaagtaatccaaaacattggattcttgcacaatacaacaaacttccaaacgtaatgtttggctttagggaatcccggaggacagtagacagatttggagaaagtagaccaatggaacacaaaatagatttatgtaatcagagtgaagatggtaaagccagaaagatgtgtcccaagaacaaagtattttggagatcaacctggaaacaaataaacatctgaaaaagagataaatggcaaagttttaggtctctctcatgggaagtcaactgaaaaggaatgagggtagggtggtggtggagaaatgcagacagcaacactggtgagaaaacattgtccctctgagcaatttgaggcctgtggcctttatgtgcagaggcacaagaagagaggccgtttgggtttttttaatgctcaagtaaacatgtgtgtgtgtatgtatgtgtatacatatatatacacacaaacatatattttctctatataccaaatctataatctatattgattttatacatgtaattaaataaataaatataatagatgtgtctaatatttgactgatagacggataataaaatggcaaaactgttactacagctgattataccctcaggccaaattttttggcagctgcagtgatatacccaagcggttatattattaagtcagatgtaagattaataactggagaggtttctatagtgtgtagttaaatctaagaatcatgcatatatagagagagatttatttcttacacagaaatcattctatccccaagtctatggagaatatttttagttaaatggaaaaatacacacattaacaaatcaaaatatttaaaaatgcattttaaattgtggcttgacttatgaaaatatcccatacaatttaaaacaaaaaatataataattgtggataaaaatagactatgataatctcagagaggtaaagggtgtcaatgttactcatctcctgaaatgaacaaattatttccaattgaaacctgaatttgaaaatacatctcctggcagtttagacaaaaagagaaatagtttggttaaacactatttttaaagtagtaacatcttttcacataggaatggtataaattataaatgagttaaattcatgtatattataaattctgtttactcatgttggtgatttatattagctatggtaattcatacaaggattttaaggattttccagtatttattgtttgaggaaaaaaaggacaggactctccaaatttgtttgcagatgcaatcttttctttaaataaactcaaggaataatttattgcacgtgttattttgtaagaaatggcaagtaacgttaagagacaaaatcttcatctataatttattaaaactcacagaaatactgcggatggggcaattcttgtttctggttgactgtaaaacactacaataacagcaaaggctaacctatccacaaaaacacaagctaaattcctgacgcaaataatttgagtatttacatgtgtgtttgcctgctcacatgataatgcatattttgctggcctgttttcctcccattctcaaccacctcacttcaatcattgcttttatttccccagtgtgaggtatgattatttccatttcaaagaggtgagcttagttatttataatcaatcactaagaaaaacaaaataagactaacccctaaaatagccataaaagtattttgtaaatacctattgtagaaaaaaaagttactttgttggaaaatactccttaagggccatgccatatgctgattagcatatcaaatcaccattggggaaataatagaacattagaatacattgaaactgacatattttttcatcagagtaaaagcattaaaataaccaaaaatataattactaggaatcatttctaataaaataaaacataagagatgaatgaatgataagcaacttgatatacatttagccacatagttaaattcaagtttgtttcatgtgtatgattaaatataaataacattattaatttctaacacatctgtgctaaaagtgagggtattgcttttaaagacaagggcaaagcctgtcaaccaccagcctgcttgcagcaagcaaagaagataagaaaacaagcaactgaatcaaacactgaaaaatgacaagttttcattttcaaaactcccaacatatctgcaagtttctttcctcctttaaaaattatcatcagataaattgttacagtccaagaggaattaaaaaaaaaatcagcacccatttggttaaagcacatgagtttgggaacaaaataaagaataaaagagccgccaatactgccttctttcacaaagcctcgacatcacacaacttactaaatactcaaggagtacgtcaatcttaaaagagaaaaggggaaaagcatgagagaaaagaacgttaccaaactgcctctgcagtccttagggaacttgtagatcgggatcttggcttcataataatgctcattttgaaaaaaaataaaaaggaaaataagtcttcaactattctgattaatacattctaactgtctttctgcaaagaagattttaaagatattccatttccaagggaggctgcttgaagaaatccaattttcctggagtccatctcctgtcctcggtccagctcatgggcaaggttctaacacgcaggagcgctttcttccttcatactgaatttactccagtactaggctgttaggaagtgacagtttcttctgtgtcttgcaatgccaagggaggaactgaattctgaattgattcttcatctgggtcacaagggaaaccagcatagtgaaagagtcacttgatctcttttttgcaattccatagtaacagctttaaaggtttctgacactcgaagagcgcaggtagagagagagaaaaagaaaatgaccgggaggtactgtaacacgggagagctgtcaaggaagttccatttcagggcaagcacaggaaaacactcctctccgtggagcaaagaagtcagccaaggaacaaatctctccacactttggctgggtgggctgatttacctgcgaaagtaatttctgtgtgtccctgcttagaatccagggttttgtgaatgagaactatcattcaatctcaccaggcagaaactattcctcaagggctgtatgacgtctgtaagaaggcagttcaaaacaccgcagggcagtgagaa
